United States Patent 7,745,391 (HUMAN THROMBOSPONDIN POLYPEPTIDE) - sequence listing, part 40

SEQ ID NO: 95049 - DNA, 489 bp, Homo sapiens
taacatcctttctggtatccccacccctccacattgtagcatggatcagtacttcattccttttatgtcctagtaatctgccacagtacaggcagaccacatttcgttgatccctaagaggctcctgtgagactggcctgcctcaggcactgcagtgcatgtgggaacctccctagggtgccaacccagtcgcctctttcgtaatcctgagaaggagaacgagaacgctgcgtctcttttcttttcctcgtctctttaaatgtgtgtgctttaacccaatgtctcagacacttcatgagctcctggtttctcctgtaaagtgggaacggtcaaatgtgaatccttaaaaaaaacccaaaaacccaaaactaaaaatctaaacccaaaactaaaaaactaaaaatatacttgattcctagtgatgacataagccagtcttcccagaacttgtaatacgggtgtctgggtggagactgaactgggtggggt

SEQ ID NO: 95050 - DNA, 326 bp, Homo sapiens
gcgaagtgccttgcctgggtcacccgccgtcatcctccggaagaccattccctcctgtatgttggtccagggcatccccagcccatcacacctctgggctcagggcttggcccccagggacatgctggaaacagccccagcctagaagcccatccggccgtaactgtgtttatttgcccaagcacagaaggacccactatttattgctttcttttgaaaactagctgagcctttgtgcaaaaaccaggcaggcacatcatcagtggcttaagcttgcaaaaagcacagacaagaaatttaaaaagaaaaatctttaaagctttgcc

SEQ ID NO: 95051 - DNA, 776 bp, Homo sapiens
cttattctgaatacaagaagaagcaatttacttattcatgaagggaattctcttttatactaattcttgtcataaaaaaacaaacttattattacagataattggtcaggtgcaaaacatttaaaactttgtatttaggtatataaatgtggctttttaagtctaaatttgactgtggagtgacccagaaattggcaaatcttattacagactcctgatgggaaaagaagccaattctgaagtaacaagttagttgtaagtttaacactgagagtcatctggcccatgctgtttaaagctttcttaattttgtgcctttcttagccttgatcttctacaagtcgttcatatttactcttgtacttgtaaatatcttgacatttttattgaggcacaatgttttgttttaagtttattaagagttgtgtataggccggtaaaattatgaactgctaagaaaaatatttctaatgaaattgtacatgtgagcagtaagtgaggttgatttatgggtacttgacaatggtatagtgaagtttgttattgcatagaatgcctttcatcagtatccagcccttgctcatattttacagcatttcccagattcagtcgaacattgacattcctgggtctcagcaggcccaagttaattcagtagtcatgggtggggctggcgtctgtgctgttcattacccaccttccctgtgactctgacgcagctgccccagctgccagggccaacagctgttgcgccattcctctctgctggggcttgg

SEQ ID NO: 95052 - DNA, 355 bp, Homo sapiens
atgaaaagctaaaaagctacatggatttgaaaacatgtaaattaacttgattagactttatccaaaaaggtaacattataatgcagttatattaaaattcttttaactgtaatcaaaatctatggcattataaaaattttcttaaaataacaagttagaatttaaatttttaaaatgctacttaaaatgccataattaaattacaaaactaaaaatgagtgctaaatgtgaagagattgataatgtagatttttttttctctctctgtttctctctgaggatattaatatttctaaaaaacaaaataaaagaaaattccttttctttttatctgtagtctttccctcagggccgt

SEQ ID NO: 95053 - DNA, 391 bp, Homo sapiens
gtgaaagcccctgtcacattcctctgactgcagcacatggggcctggtgcgggtgagtgtctgagtaggaatttgatgtcagatctacccctgccctttcctctcaggcaggagatctgcagagaatcactaagcaaactctacagcttgggcaaggtgcttttcacccccatctttcacccacttcacacccggatttttgttttgttttgagactccatttgaaaaaaaaaaaaaaaaccctgcataagatctgtagagataatagactccaacaggcgtgatttccaggcctggttagcccacatggcattttcctgcaagttagaaacacatgtcccttccaggggacctaacctcttgattgcacagtgtggcaggccaagcacca

SEQ ID NO: 95054 - DNA, 313 bp, Homo sapiens
cttcaatgctcccgggcctctgcctgcctccccaggctggcatgcctggtgtgtagagccagaaactgaataggctgctctctgttgaagagacactcaactgtggtcgcaacaagccaaacagaatgaaggtgctaagggaggcagcatgtctgcacagggacagttcaggctgacaacaggctccagctccggctctcctccaacttccccgagtgaccctggacaaatgcccccactccaccccagatcctatttcctcaacagagaacttctggactcagtcccctgtaaggaccctaccagctcagcc

SEQ ID NO: 95055 - DNA, 236 bp, Homo sapiens
ggaatgcaaagctgcagtgagctgattgtctcactgcattccattctgggcaacagagtgagatcctgcctataaaaaataaaagacttccacaagataggacatagacaaggtaggcaggaacaatccaagtagtaatggtggcttgtttcaaatagcagaagatggtaataactgattagactccagatatatatagtttgaatcaactgtgaatggtcaaggatgaccacaga

SEQ ID NO: 95056 - DNA, 435 bp, Homo sapiens
ctggtgacacagatgagattggctccaggcatatacacattggttagctggttctgcccaatccctgtctggagttgaatgttccatttagtcaagactgccaagcagcaacataactggattcattagcttgagttctgaaagctcctcttaaaagttgtttttgtattcatactactttaatatttagggacaggctgcaccattttctaggttgcaaaagtgatcactcagttttttttttattaggtgctattttagattcaaaaatattttattttttatgaactgttttgtgcctttgacctagttctcttttcactgggatatgtatcctaagaggatgaggtttatgatattaataatacctgcattattaattcctttcaaatgaaaccagctgtctctgttcccctccaacgtgtgtgtgcacac

SEQ ID NO: 95057 - DNA, 777 bp, Homo sapiens
gccaatttctcaagcaaatttgtcttgcccactgccccccgcaaccaatgtaatttttatcagagtttctttgccactttccttactcattgtgccttcctctcccctttctttcaaacccagctcgcttgcctcactcaaaacttgctaaaatccactgaccaccatatctcatgtatccaggaagctccttagagctgaaccagttttttactcaccctcttttcagaacccctgtactaagatttcagcatgtttgttgattcaaagttttcacattgtaccatacagtgggccttcccaacctgaaattgtaaactagtactcagggaaggaacatgccttccatccttatcattcctcagagcaagaactattgcaatttggatatggtagacgttgaataaatattattacttctattatattactttttttctttctttcagtcttaccatggttgggatgaaggagagtaatattcatatgcgttataacatctcccactttattgtaaatagtgccctgcctgaatacctgatggttttggaaaaggatgtactatagttctttctaaaaccctactttctcacaaaagagataaaattaaatactcatggcatgttgttacccaacagagtggtagcttctttttaggttttttggaatatccagctcgaaagacattgtagatgaatgaaagatgaatgactgaatataagctgagaaggcccatctccctctagctctcacctagatgcagttgcagctcaagat

SEQ ID NO: 95058 - DNA, 178 bp, Homo sapiens
ggagggagggcgtgagggattacccaagggaggggcgagtatcgcaaaataggccaagtcgctgccctctactcaactcgcagggcgggaggatggagacagagggatgcggcgggagggcgggacagcccagtcgccgccaaggaggcgaagcggggtcggggtagctcacccgccc

SEQ ID NO: 95059 - DNA, 584 bp, Homo sapiens
tcatcagggaaatgcaaatcgaaaccacaaggagataccacttcatacccactagggtatgaacaagtgttagcaaggatgtggaaaaaactgtatacattgctggtgaaaaataaaatggtgcagccaccagtgggcagttcttcaaaaggttacagagttaccatgtgacccagaagttctattcctaggtttatgcccaatagaaatgataacatatctacaaagaatttgtagataaatgttcataatatcaccactcataatagccaaaatgtcaaaacaacctaactgtccatcaactgatgaatggacaaacaaaatgtgatctatccacacaatggaagcctgttcagcaataaaaaggaatgaagtactgattcatgctacaacacggaggaatcctgagaatattatgctaagtgaaagcaaccaggcacaaaacaccatatattatatgattccatgtatacaaaatgtctagaataggcaagctgtaggcagagtaggtcagtggttgcccagggctgggagaagaaggggttagggtgtattgctgaagggtacggagtttccttttaggg

SEQ ID NO: 95060 - DNA, 758 bp, Homo sapiens
acattttacattgagtcagtgatccatttgagttagtttttttcctcatagacagtcgattattccagtcttgtttgttgaaaagactgtcctttctctacaaaattgccttggcaccttggttgaaaattaactgttctctcttcctgtttactagaagaatttttaaaagaccagtgttatttttttccttaagggattggtagaattcacatatgaactatttctaggctttgacttttctttttggggttttagtagtgaattcatttgctttagtagaaataggtacttcagattttcttttttgtcttgtgtcagttttttcaaagttgtgttttttcaaagaatttgtttacttctaaattgtcaaatttgtttgcatgaattcttattacccacttaatgtctatagggtgtgtagtgtgtacttcctaatattggtgatttgctttctctctttcacttggttcacatagctatagatttatcaatttgatcttttcaagaaacagcttttggttttaatttgtattgtttgttttcaattttattagtttcttttctgttatttattattccctttctattttgggtttactttacctttttctagctttttagggtggagtttatgccattcatattagaccttttctaataaaaatatcttaagactataaattttctttcaaaatcacctttagctgcatactacaaattttgacttttaaaatttttcatttagttaagaatgt

SEQ ID NO: 95061 - DNA, 194 bp, Homo sapiens
gagtactgtgcactttcatccagtaagtgccctaccacctgttggagagttgagcatgttttggaacatgtattgtttctctcctggaactgtcttttcttgccatttatttagggaggaacaaagggatgcaagtaaagactatcatgctgtttattaacatgcaagctttacagaggccactggcctgagat

SEQ ID NO: 95062 - DNA, 620 bp, Homo sapiens
  misc_feature (17)..(17): n is a, c, g, or t
  misc_feature (398)..(398): n is a, c, g, or t
cctagctgcaccctcantctcctcttctggaaagtgggattggaaaccacatctgcttctctcccaggactgctaggaagacaagattagatggcaggtctgttcttcccctggattgtaaactccctgatgtctgggtcatcccagctcatgagctgagctttcagtgggtgctcagtggaacaggtgctgaatggagtcaggctttagggaggccagcgtgtgttggaaggaaaatacctgtacagccaacttccttgagggttcgttcttttgcatcagggtgtctcaaactcctgcccttaaaacacctgcaagagaatcatctaggcggcttgctcgctctgcatgcaggccctttagaatcagagtcagaatacctggggctggagccacanaatgaaatgacatttcaacaagtttgtcatcacgtaagagagaatagataacttcactcttctctgcaacgaatcccaaaagtatataattgagctgactgcaaggtacttgacacgcaagagactccacaaatgggattcagcctctggaaagtggtggtagttccagatttatgtggatgttactttgtttttccctataaaatatattatttaaactat

SEQ ID NO: 95063 - DNA, 706 bp, Homo sapiens
agcctctgcagaggcgctggagctgggtcagtccgccgctcaccccgcggccgcaccttcccgccttctcaggtaactaagtgcgggtctcgggcctggcagaagcttcttcggccccgtgccctcgcctggccccgccccgtcggttgtgtgcttgtctcgtcctgcccccaggccctgccggtccccaccgttaggccggcgtccctgcccggccccgctgcgggctggcgccagctcaggaggacgccccgaagccgaggcctcggaagcaggtttttcccagaccttctcctgtcccgcgttccccctaggccggccgtagggaccagaccccaccctaagcccatagccggccttcgcgctccgggtgaccctggctggccctgtttgtctgtgggtcctgggatgcgccactcccggcaggaaggggcgccgccgaggcccggtctcagcctggaaccccgctcctgccgtcggggcgctttctgcggctgcccacacacgaccccaggcaaggggtgggggcgcgggaccctccatgacatggcggcggggcgctctcacttctttgaaaccagcgtaaactggacccgccccacctcccataccttgggggagccccgggaaaggctgtggcctgggggtctgcagggcgttggcagtggaggtggggagagaccccagccctttcctgtccccccca

SEQ ID NO: 95064 - DNA, 259 bp, Homo sapiens
caccaccacgcccagctaatttttgtatttttagtagagacggagtttcaccacgttggctaggatggtctccatctcttgacctcgtgatccgcccgcctcggcctcccaaagtgctgggattacaggcgtgagccacggcgcctggccccctaagtgattcttctgcactttaaagcttgagacatcctgccttaagacaccatcaatccatgaatagattgtgatatgtctttttgttttccctctcatgggttcc

SEQ ID NO: 95065 - DNA, 407 bp, Homo sapiens
atcaactgacagctcaagggaatgggggtttgtgccaagggaatgttgttttatgctttaagcttagatgaacctgtttattgcttgaggggagaagtcaggatttcagaaagaaaatgtgatattgtggtgttaggccaatgacatagatgttgagatagcccagggcgtggttgaggtaggcagccctgtggtagtgtgaactgcctgccttgatgatccatacttcttagctattaagtgctgatttgaccagctttgtctaggtttctttcaaaatggaggaacacagtggtagaagtcagcatgagggaattttattttatcattatttttttaaactgatagaattgcaaggagagtgatggaattttaaagcacatatatgtaaagcccttgtgaagtat

SEQ ID NO: 95066 - DNA, 338 bp, Homo sapiens
attctagaggaaccccttttgcggtgccctttccaagatgaatatagcttcactcaacaatatggaaggaggagaaagtagggtggggtgggaggatcttccatttctctatgtcttcattttatatggcttgtacctgtaacatacagggttcaaaagatgaattagaactgtctctgtgctagtgtttatgcagttcagtggaatagaatgggaggggaatcatccatgttcacaacactgggtggggcatgctctcttctgttgtttgttgttctgtgacttaaaccatatactgcaaaaggctaaaaaaaaaggacaaaactcatctaagcata

SEQ ID NO: 95067 - DNA, 469 bp, Homo sapiens
aaagaatataagaatagcagatctaaggagcagccactacttctgtcggggggaattgagcacccaaggaaaagctcatacccgaggctgagatccagagctctctggagacgctatggccttgactcactagacctcacggtggtgctgtgcccatagaattttctgccaagtcctccttcatttcatgcttgaaattagccctccagagtgccagaaaaattcatgtggaggtatctcactagaggactctgctacgaaactgctttgtgaggagggactgcagaagctgggcactgaggaaggtgtgtacactggaggggctgggtgctggagaagctgcctgtgctgcaggagcctgcggagccagcatacaggctctaggaagcaaaatcccattttcttctgcagtgtctctctatcgccctctactgatgatagagtttagcatggtagcagctgggaaagg

SEQ ID NO: 95068 - DNA, 392 bp, Homo sapiens
gtttgtgatgggaatatccaaggctgctagtcttcaggcagtgcttctagagtgacctttcattgccatttatttttattactttctaatagtgcctatttaaggccgtaaagagggaaactgtaatagtgaatggcttatctagtctttaatctctttgcatattttacaaactaaaaaataagttatatttgcaccttgattactgttcctcatgcttcttcacttgagtctcttgtctagaatattgcattggacttttaagtatgaaccactcccttttgataatcacactactttgtaataatgaagtataaaatctttccaacattataagttcttcacaatttgactttaagcagtctttcagatgttaccaatatcaaaaaagt

SEQ ID NO: 95069 - DNA, 269 bp, Homo sapiens
ggggaaaagaaaagttgtgcctagctgtctcctaggtgtccagcttgtgggatgggcagataatggagcagtcactgaaataaagaacatcaggggaaagcgtgggcttagttttggacatgtggacagggtttggctttggacaggcctctgagcacctagcgtcacacaggcaggtggactctcaggtcaggaagcagaggtttggggtcatctttcctccctatgcaggaaccctctatataagactttgtgagtcttgtctaagt

SEQ ID NO: 95070 - DNA, 245 bp, Homo sapiens
gaaaaaatactgtattgatggttaggtggcttgcaagctttgatggaggaatttgacttgcttaaaatcgggtacctgtgggtgtcttgaaagcaagccaggaagtttttctgcctcacttttgttttgaaagtgtcaaacttacagaaagattgaaagggtatgcatccttatactttttccctggattcacccctgttgttaacttttgctacattcatgttttctctatttacacttttttt

SEQ ID NO: 95071 - DNA, 691 bp, Homo sapiens
agcactatacgttccacctgtatgtttggaagagaaagaactatgctcactccttctgagctgtccctatttatttatttatttttggtctgatggctaaataaagattttttgtattcaagagaaataatttaatgagataaaatattatttcctaagaaaaatatatcagctgaaacctgggaaacatctagataatttaattgaaaatgattgacattctcaaacaaaaaagaaaagaaaatcagatacaccgctttcttctctccctatctgcggagcctgcctcctccaacctgcatagctgcatcccagtgcatgtgcacctgcctgcttggacacttcaatgactaacttctctgcaaatacatcaatagtttcattgccttcaggcttcttctatgtcttttaactcttgaaccttctggtgcattttagcttaccaaacagcacatgctgctttgtacttgtgttgttttatgtattcatttattgcacaaattttccttgagtgccttgttcatggaaggcgctattccaggaattttatgtgtagtttaagttacctccatctaaactataagattttcatataattcatctttgtagttctaccacaagcatattagtagattctaaataaacgttaactccatatttgtgtgcatgtagaaatatgtcatgtttatgt

SEQ ID NO: 95072 - DNA, 522 bp, Homo sapiens
agggggtcaaagtggtcgagtgtcgggaggaaggactgcttgtgtgcggggtgggggggggtggtggagagcgggggcggggattcagcgcgtgtatgtaaaggtgcagcccgtgtgctaggcgctgggtgcgcgcgcggtgtctgctcgggtgcgcgcgcgcgccgctgcccgcctgcccgccggcccgcctgctcgcctgctggggctgctccgtgggtttgacgggcgagcgggcgcggaggagctctgtccggaatcacatagataccatcgtggaaacagcagcgcaggtcacggcgccgcgggccctgcaccagacgctgggctctagagattatttctctttattcagaagcatacagttgtttgctgattgcaagaagatgtttctgtggctgtttctgattttgtcagccctgatttcttcgacaaatgcagattctgacatatcggtggaaatttgcaatgtgtgttcctgcgtgtcagttgagaatgtgctctatgtcaactgtgagaagg

SEQ ID NO: 95073 - DNA, 1042 bp, Homo sapiens
gtcaatttaattttcacatgccttctcatttcaggaaaggttgaatccaggtgctcaattgattttaggagataaaatttaatttataaattaggcacagtaagatattaacaacaataactaataacaaaatagaacaattatagaactatagtgtaataaaagttatgcaaatgtggtttctctctgtctctgtcaatatcttattgtattgtaccattggtaactgaaactgaagaaagcaaaaccacagaagagggttgactgctatactccagttggactgaggggaaggcactttagattaaagactaccaccgtgtaggaaagggacaattctcacgagagaaagtggaattcttttaccagaaacaggagaaggactcaagccatgtaaaacacacacaccatttcaccaacccataccattctgttttctactaaaaatgttaaactgttttccaatggtttctgtaggagaaaatttccagagttatatattctcctctgggtcatcaggttattatctcctgattttccatatttattttgtttgttttttagtatttattgctgatcccgtttttccactgcttacttatcctaaaaaagagatagatctgcccaaatccagcatcaacacagaaatgtgttttttttttttttctcgtcattttcatctacagtgtactcagttactatatgcaaaccttttgtaattctaagggaagggtatacaggtcccttcccaggatgtagccaacatgaattgattactgctatgttatcctgaaatgagataagttgctaaaccaatgtcatgtcttattattttctcaagcacatgcaaacatgtatttctgcctccattgatggatatggggcctaatgttgtgttattcagcatataattaataaatacataatcaacaatctaccctgcatctcaccttcgtgactgattaccttgatgatgatgattttgatactgcaatgtacatatgaatgtagaaataagtaaagggtgagcaggagattgtac

SEQ ID NO: 95074 - DNA, 304 bp, Homo sapiens
cgtcctctctctacctgccacctccacctctctccccctagagcaggtgcctgcagtgcttctcggactctgctcccatgacagctgccgagcggagcctagactcaggggctgggcctgctgggttcacagacgcttccctcacccttcccagctgtgtgaccttgcacaggtcactaggattccgtgtctcagtgtcctcatctgtacaatgggcacgatgacaggaggtctttttgaaatgaaagtgggttaatctgtgtgaggcatataaatggtatatggcaaacgtagaactatctat

SEQ ID NO: 95075 - DNA, 543 bp, Homo sapiens
gttggtttttggtttcttttgttgttgtttttaagacacagggtcttgctctgtcacccatgcctcctgtagtggtatgatcatagctactgcagcctcaacctcctgagctcgagggatcctcccacccagccaagtagctggggctacaggtgcacaccatcatgcccagctaattttttaagtagggtcttactgtgttgcctaggctggtctccaactcctagactcaagtgtttctcctgccttggcctctcaaagcactgagattacaagcatgatctaccttacctggccaacatttgggtattgatcagaaatctcaggacgtgggctggaggtttggtttgttctggggagaaatcagtaactaagtggtggtgaaagtgatcaagcgtcgatgaaaccacgtgggatagtggcagggtgtggagaagaaaatttctcatgtcctttaaaaaagaaaaatatttctggtggctgggcacagtggcatatgcctgtaatcccagcactttgggaagcagaagtgggaggaatgct

SEQ ID NO: 95076 - DNA, 502 bp, Homo sapiens
agtagggaaggagagaagtagggaaggaaggaaggaaatgaacaaatttacatgaagatgagaacatccaggggaacttacaccaccagtattttccattaacaggaacacgctaactagttattggagacagacgcactactgtaaaactatatactgtttccatggggtacaaccccttcttcctcctctgaaacacataattcctctggcccactgttgccagagacactgagtcttgtctttggataagttctggtgcccaaaagaatgagatgagacagtggatcccagaacaccagggcggcaacctttcgtgctgctcagtgtccactacagaagctgcccagctgcaggtgagggcctcagcccctgggtctgacatcgtccatttgtcattctcactggacttccctcctcgcactggctcccactcccccaggacctggtggacggccacgtgagaaggatacaaacaggccatgcccctttctttctcccc

SEQ ID NO: 95077 - DNA, 304 bp, Homo sapiens
ttcaagaccagtctgagctacacagcgagaccctgtctctacaaagtagttttagaaaattaaccaggcatggtggcacgtgcttgtagtcccagctattcaaggtgggccatgggggtaaaggggtactaaggcaggaggaatcccatgagtccgggaattcggggctgcagtgagctgtaactgcaccactgtactctagcctgagcagcagagcaagaccctgtctttgacaacaacagccaccttggccactgagtctctgatgagcttgcctcatagacatttcacatgtgttgtcaca

SEQ ID NO: 95078 - DNA, 705 bp, Homo sapiens
tctttgaaaaattttattaatcacataaatcccttggaggctgaaaatgtttcttgcttgacaaatcatacaagacatttcaaggccaatgcaatggctctaaatgcttgaagattttgctcctggtgacaatgtgggaaattgaagatggggggaggaaagttctatattacaggggatgctgaatatttcatttctttggacacatcttcatcaagacaccactagtaagtagtatggcacaagaaaaggagctttatacggtgtaccttttagtcagaaaaaaaaaacaggtttcttatgcatttaattgccatgcagaaaaaaactttaaggcagctcataattttctgcatctgattatcaacactgatctatatttacacttgagctttgtgtgtatggaatgggaaacagggtctcactcttgcccaggctagagtgcagtggtgtaatcaccactcactgcagccttgaccttcccaggctcaggtgatcctgccacctcagtctcctgagtagctcagactataggcgcacatccgcagctaatttttgcagagacagagtcttgccgtgctgcccaggctggtctcgaactcttaggctcaagtgatccacctgcatcggcctcccaaagtgctgggattacaggtgtgagccacagcgcccagcctagtgaagagatttaattaataaggggaa

SEQ ID NO: 95079 - DNA, 1048 bp, Homo sapiens
tagttttgatgaggtgaccaaagattacatggttatctcttggaagcctcctttagatgatggaggcagtaaaatcaccaattatattattgagaagaaggaagtgggtaaagacgtctggatgccagtgacatctgcaagtgctaaaacaacatgcaaagtttctaaactacttgaaggaaaagattatattttccggatacatgctgaaaatctgtatggaataagtgatcctctggtgtctgattcaatgaaagccaaagatcgtttcagggttcctgatgcacctgatcagccaattgttacagaagttaccaaagactctgcattagtaacctggaataagccacatgatggaggaaaacccatcacaaactacatcctggaaaagagagaaactatgtctaaacgatgggctagagttaccaaagatcctattcatccatacactaaatttagggttcctgatcttctagaaggatgtcagtatgaattccgggtttctgcagaaaatgaaattggtattggagatccaagcccaccatccaaaccagtctttgctaaagatccaattgctaaaccaagtccacctgttaatcctgaagcaatagatacaacatgcaattcagtcgatctaacttggcagccaccacgtcatgatggtgggagcaagattctgggttatattgttgagtaccagaaagttggagatgaagagtggagaagagccaatcacacccctgagtcatgtcctgaaactaaatataaagtcaccggtcttcgggacggtcaaacctataagtttagagtgttagcagtcaatgcagctggtgaatcagatccagctcatgttccggagccagtcctagtaaaagacaggcttgaaccccctgagttgattcttgatgccaacatggcaagagaacaacacattaaagttggtgatactctaagacttagtgccatcatcaaaggagtgccattcccataacacacattttgatatttatggagaggattcactatgcatgatccattggatgtccct

SEQ ID NO: 95080 - DNA, 454 bp, Homo sapiens
tataacaaaaaccattacagtatctttctcctcgagttataagcattggttttaacagctaaaacaatgcaagttgcagatttctcaagaagatggtttgaaaactctatagactacagtataaaataaggtattgaaaatactctcataaaatacgttctgaaaaaaattccaggttctacctcctaagagccataggatcttgggcaaatcaagggcaaattatttaacctctttgagatttagtctcttcatctataaaatgcagacaaaaatagtgcctgcaaggcagggcatggtgacccaggcctgtaatcctatcactttgggaggctgcggtgggaggattgcttgaacccaggagttcgagaccagcctggccaacacagtgagacctctacaaaataaaaaataaaaaaatcagctgggcgtggtggcacatgcctgtagtccc

SEQ ID NO: 95081 - DNA, 363 bp, Homo sapiens
tgagcaaggcctacttggccctggatagaaattgttttcaaagagaagggcagctgcttagagtgaacatgtctatggactttaaaaagaccccacgcaatttgactttgtggcaatagaaaacagtaaaaaacagggcatagcctagtttgttataagaaaaagcatccattttctatccttttagagtcttatttgattatggtgggagggaatgttttcaaatttcccatttctcaagaaatgttcatattaattgaggatttcccttcaataaatctcatgtcctcaattaggatctaggctagtaatgatgtttaattacttggttctcattggaaatggaaaattatgaaatggaaa

SEQ ID NO: 95082 - DNA, 136 bp, Homo sapiens
gagtagctgggactacattgtctttttattgttgatttctagggcctggcttgtgacttgcctatttatttcctttcctttcctttttttttatttgagatggagtctctgttgcctagagtggtggtgcaatctt

SEQ ID NO: 95083 - DNA, 1122 bp, Homo sapiens
tggaagtcctggttaatgcaataaaacaagaaaaggaaataaaaagtacactacttgggaaaggacatataacattaacattgtctctgctagctgatgacatgatcattcatgtagaaaatccaaaagaattgattacaaatctcctggaacctatatgcaattacagcaaggttgcaggatacaaggttattatatgaaagtaaactgctttcttatgtaacagtaataactcaaatttgaaattaaaacccaatgccatttatattagcaccccaaaatgaaatatttaggtaaaaattaagaaaatatacataagatctacatgagaactacagacctgattaaagaaatcaaagacccaaataaatggagagatatttcatattcatggataggaagactcaatattgtcaacatgtcagttcttcccaacctgatctatagattcaatgtaatcccaatcataatcccagcaatattttgtggatatttgataaactgattttaaagtttatatgcagaggcaaacaacctggaatagcaaacacaatattgaaggagaaaaccaacactgaaggaggaatgattgatagcactcatcctcaagatttaatataaagctataataagatagtgtggtattggcaaaagaatagacaaatgatcaatgaaacagaacagagtttagaaacagactcatatttagtcaactgatacctagcgaaaggacaaaggcaatacaatgtagtaaaaatagtctttttgacaaatgatgctggaataactggacatccacatgcaaaaaaaagaatctagacacagactttccacccttcacaaaaattaactcaaatggatcacagaactgaatgtaaaagtatacaactcctaaaagaaaacatagaaggaaatttagatggtcctctctttgacagtggcattttagatacaacaccaaaggcatagttcatgatccacaaaggtctctcccctcccatctctgaccccaaacaaccattaatctgttctccatttctataactgtatcattacatgaatgctatataaatggaattatatgtgatctttggggactggatttctttaaaacccagcatt

SEQ ID NO: 95084 - DNA, 261 bp, Homo sapiens
cttggtccatctggatgctgagactagacacagaagggtgcaaggacctgcctggcttttgaaacccctggagttgggcatgagcctgtgccaggtgcacctggtgctgcctagcctcctgtgcctcaagcccacaggagcccccttggaggcagagacctccccaggttacacagcaagggagctggagccaggcggaaactaggtctagtgggccacgccaccctaaggggcacagcttcggaaagtaggacatatgcg

SEQ ID NO: 95085 - DNA, 231 bp, Homo sapiens
cctgtgactgagccagttgcatagcagtttccatgccccagggcctcagtttcccctcaggcgatgtgctttcctgtgtacctcaatacacacattgtctccctctggtctgggccagccccatgaaaggagagttgagactgggtgccaggtgtctgtgagtcataagcatttgggttccaaattgtgtgtagatgaatacagatgtgttttgtgtgtgtgtgtgtgtgt

SEQ ID NO: 95086 - DNA, 637 bp, Homo sapiens
gctctcagccatctcaacaagaagatgtctttctgcaaaccaggaaaagagccctcaccagccatcagatctgctggcaccttgaacttggacttcccagcctccaggactcgactgaagactgacacagcccgatcgcctcggaagccccctgggccatcatggacgccgagcttcgggtaactcttacagtggaggacaggaatgtcaggcctctgagcccaagctaagccatcatatccccagtgacctgcacgtatatatcaagatggcctgaagcaactgaagatccacagaagtgaaaatagccttaactgatgacattccaccattgtgatttgtttctgccccaccttaactgatcaatgtactttgtaatctcccccacccttaagaaggttctttataatgtcacccacccttaagaagtttctttgtaattctccccacccttgagaatgtactttgtgagatccatcccctgcccccaaaacattgctcttaactctactgcctatcccaaaacctataagaaccaatgataatcccaccaccctttgctgactctcttttcggactcagcccgcctgcatccaggtgaaataaacagccttgttgctcaaaaaaataaaaataa

SEQ ID NO: 95087 - DNA, 367 bp, Homo sapiens
atgttttgtcctactcagtgcatcatataagaagttacatgaagttcatttaccttattattagtaatgttaactttgatcacttggctaaggtagcatctccactttgaagttactattctgtaattatcctgtgggaagatactttcatattatgcaaatatgttctttcccaacatatattcaccactaatcttagcatccctccaaggttctttcttcctacaattactatgatatttgcaaaatgatgattcttgcattttatgtctcctacatttaataaaatcttactgtaataaaatactgcccattctccccctttggtttatatttaatgtattatttatgtcaatatggattcatt

SEQ ID NO: 95088 - DNA, 732 bp, Homo sapiens
agcagaggcaacatggcggccttagcaagctatagctgcgagatttgaattactccactcgtagctattgcattcctgacgatggcctctgtggcttcgtgcgattcgcgtccgagctcagacgagctccctggagacccctcttcacaagaagaagatgaggactatgattttgaagatcgggtcagcgactcgggttcatattcctcagcgagtagcgattatgatgatcttgagcctgaatggctggacagtgtgcagaaaaatggagagctgttttatttggaattgagtgaggatgaagaagaaagcctccttcctgagacaccaactgtgaaccatgtcaggttcagtgaaaatgagattatcattgaagatgactacaaagaaagaaaaaagtatgaacccaaactcaagcagtttaccaaaattttaagaaggaaaagacttttacccaagcgctgcaataaaaaaaatagcaatgacaatggaccagtatccattctaaagcatcagtccaatcagaagacaggagtcattgtccaacagcgatacaaagatgtgaatgtttatgtaaaccccaaaaagctaactgttatcaaagccaaagagcagctcaagcttctggaagtgctggttggaattattcatcagaccaagtggagctggagaagaaccggaaagcagggtgatggagagaggcttgtggttcatggcctgctgccaggggga

SEQ ID NO: 95089 - DNA, 300 bp, Homo sapiens
gtagagatgggggtctctctatgttgcctattctggtcttgaactcttggcctcagcgtgatcacttgacaagaggggcagttcttagccactcatggaaaatggaatggatggacacagactcaggtcaaaagcccaccttggggctctagaactttcagtagtcaagctgcgggaggagggaaagccacagtggtgggcacaggtaggaggtgccttgaggccagcactccccaatcttcttcccaattcactccagactctcctagacccctagcagccggcagccttttgccactg

SEQ ID NO: 95090 - DNA, 391 bp, Homo sapiens
gaataggtgacattattatgcaaagtggtttcagttcccttgtcttgtttttggaatagtataagaggcctacaatacgaataaataaggcccatcacaagcctcaccaaaggacaaaactaatccacttctgaagaaggctctttgttgggccagatcaaatccttggacagaactgtactcttaatctctgtagtgaaagtggggggtagtttaagaatttattaaccttctaccttgagcaatccctcagaagtaagaggtgtcaggcctctgagccgaagctcagccattgtaacccctgtgacctgcacatatatgtccagatggcctgcaggagccaagaagtctggggcagccgaaaaaccacaaaggaaataaaacagccact

SEQ ID NO: 95091 - DNA, 188 bp, Homo sapiens
tctgataatcagcctctcctactgattgccttctttcagttcacgctatcttcactctggcttaaaaccagatgtgactcctccgtcttcagtccctttcatattaaagcctttcagtctcctttctgttcccccatttcctctttctccaactactgcaaaagttcctccctcaccactagtctcta

SEQ ID NO: 95092 - DNA, 514 bp, Homo sapiens
cgacattgtttctatgggaaaatgtgccccagaaggaacaaggtcttccttcctaccccacttcctacctccctgtgtaatgaagcctgtgtgtttattataggaagtgctgctcccaagtgtgggcggctgggctttgaggcagccttggacacttacccccaagggcagagatattctcacttctcctgtcccagctctggcagggaggggagtgggagcaggtggggagtctgtccctgacccaccttcttcagggctatcttctggggggtggggttctagcaagactggctacataatttctggggccctttggttcaaaaggcagaaaaataaaaatgctgctaagctagttaagaagacaactttttttcctcctgctctctctctcttgacttgttacagtgttttaaatatgtgatttaatgttattctacgtaagaaaaaagaaaaatttaaattactagcatgaatgttataattcatttttatactgtgcaaagccagtttt

SEQ ID NO: 95093 - DNA, 568 bp, Homo sapiens
ggtttctatgcaagttgcactaaagacaggctcattctctattactggactgtataaaatatagaaagctatctggcactttaacttcctttgcagtaaaccaggagataatgagattccaaattagctgaagaaataggcacagattaagttagttgcccaggggtctcataaattcagaggtgggcaaagaactgtaagagggctgcatctctgctagggatagtaagtgggaatcagcctcgggcctacttctgtcgcaccacaaggtggcaggattccccttgtctgaaacctgaaaggacaactgatttccatagtgtatatattatctttgagtttaggtgactgtgtcagactgcttgtctatgagactaacagtgtttccagaacctgataagtctatatctttttcgagatgttaaccagcaaaatattttccacatcagcttggtagtagcttttcaaaatattcagcccctatctccgtttgcttcgtgcaacagtggtgccagtagaaggtaataaagtcaaagaccagctttcagtaaaactaaaaatagctgtt

SEQ ID NO: 95094 - DNA, 375 bp, Homo sapiens
aacacaggtctcaataaagttaaaaaaatttgaaatcatacagaatatgctctctgatctcagaataaattagaaaatgcaattaaattggaaaacagtgacaaagatctgaaaaatctgtaaatttttggaaattaaacaatacacttccaaataagctatggattaaataaatcgtgataaattagaaaatattctaaatggaataaaaatgaacacaaaatataccaaaatttgtcagatgcaccaaaagtagtgcttattggaaaatttatcattttatttgcttatgatagaaagatcaaaatcagttatctagtcttctacattaagaagctagaaaaaattacaaattaaatgcaaagtaagtagaag

SEQ ID NO: 95095 - DNA, 367 bp, Homo sapiens
aaaattactccctggtcttgaattttgtctgatctcgcatggctgtgatgttttattcctagaccaatagatcccacgttattaggaatgctcatttttagcaggttgtgaaatcttatgtcctgcaaagaaaaaaataggaggaggaagagagacaaacacacagtagaaggaacaatcctggaaaactgatataggccatatcactctgaagtgtgttgtcagtaggcacatatgaaaatgtttcgtgtgtataaatcggtttctgttattttcttctgaagtttaagttgtctagtttgcatccccatggcttaagaaaatcacagcttaatatttagtaatttcaaattggacaataggggga

SEQ ID NO: 95096 - DNA, 463 bp, Homo sapiens
cagcctgggtgacagagcgagatccgtctcaaaaaaaaaaaccaaagaacaagtggggactgaacttcccaacctcctccttgctgtcttccctctctgctcagagctcctggcatgcgtcatcttacccttgggtgtcttcccatctctgtactcctggcatatttgacagtctgagggtcctcaaacttttccactccccttcctagccccaaactgtagttactgcctgacttcttgcctcaccacattcccccggccaaactacatgccccgtgaccacattccacacccttcatgcctcacatcattgtcctccagcacccactctccacatagacccacgttacctctgttattatataggaaagaatgtgaaatacagtggaaagagtatggattttggagtcaagcctggggtgaaattccagctctgacatctaccagtcctgtgatcccagct

SEQ ID NO: 95097 - DNA, 634 bp, Homo sapiens
  misc_feature (603)..(604): n is a, c, g, or t
ccagagtataatatactggtgaagtactccttgacctcgaggtgtcatcaaaaatgtgacttcccaagaaaagccttctcccagtttgttaaatcactctgcccttcttattgtctaatgctgcactctgtctcctttacaatattttctatgctgctttccttaagggtaggtgttatgtcagtttctgtcacctctgttgacagaagacttgaatgcaagacctagcatattgctaggcccaaaataggcactcaataaaaccatttgagtgagtggaagaatggatgaaggcaacatgctcatagggaaagagacaggccaaggcagggccattgctacacaatgtgatgggtaccaaggcagagaggtggggtgaggacattgtgttagtctgttttgagctgctataacagaataccacagactgggtaatttacaaagaacaggaatttgtttcctcacaggcctggaagtcaggaaatccaagatgaaggcactggcaggttcagttatctggtgaaggtctggtctttttgcttccaagatggcagtttgactgttgcgtattgaggagcgggggcagggactgcttcagtcganncggccgcgaatttagtagtagtagtcgacc

SEQ ID NO: 95098 - DNA, 352 bp, Homo sapiens
tagattacacatattaggaaataatggatttgtattccataggtatgcttgatctttataaagttccctgtctctggaaaaactaaaataaggcaaaacaatcttcttagtagagttatttttacaagaaagttgcaagccagttttagttcatcgattggataatttttcctgcttgctggaggtatttcagtattggtaatacctgaactatgagatgcatgaatgatgcattttaggaatttgtttctgtgtccataccaggcataatgaattaagttatctgttaaaaatacaggatttttgctcaatatacagttgtagaagaactcattgtccaaatttttaagac

SEQ ID NO: 95099 - DNA, 295 bp, Homo sapiens
cacttagacatttatagactcaaaaaagtagggcactcagtgttagcatgaacccagggagacgggcacttctgtgcacatgaaggggcatgagaaacccgcagcatggcagggggtgcagggggatggtggtgcaacttggccttacaaaggcataggttgagaggtgtaattccacctctgagaacataccctaaggacaagagacatgcaccaagatttataaatgagaatactcttcaccgcaccttctatcatcgtgagtgagtactatggaggtattacaattttttcc

SEQ ID NO: 95100 - DNA, 213 bp, Homo sapiens
aaggtcatgaggctggaacagccaggcagctcaggcgaactttattaaaatatcagttcttatttccctctccggagtagaagaaagtgtgggacaaagaactggaggagagtttgagaccagcctggccaacatgacgaaaccccgtctctactaaaaatacaaaaattagctggatgtggtgcacacctgtagtccccgctacctgggagg

SEQ ID NO: 95101 - DNA, 308 bp, Homo sapiens
ctggcctcatatcagagcccaggaggagatggtccacctaggaataagggttctaatagttaactctgaaactggaagcaagccagtgacaaggagttgaaactaaagaacacaggagacctccgtaaacgtccttccagcatagacctgaggttctgagcaactgtgggtaacgcacaaaccattattaaaaccaataaaataccattattttacaaaaaattaaattcaatgccttgaagccaattatttattctataataaattaaagctaataacatactattaaaaccaaaaaaatccttacc

SEQ ID NO: 95102 - DNA, 655 bp, Homo sapiens
ttcccagtgatacgaatatttccaggctcctacatgaagtaattacactgctatgaacacatttttgcacagaatataggtaaagcatgaacgggcattttaacagaagaatcacagtaccgctcacttctaaggcagtatttgtttcaggctttgcgaccaatcagcagttttcacacccagtcctggattcggtctctgctattttacacccaggcaagggcactgaggacagcacttgcaagcctctcttaggtagtacaggaagcataacattggcatctgcttctagggaggtctcaggaagcttttactcatggtgagtaaaatgatccacccccatgatccaaatacctcccaccagaccccacctccaacactggggattatatcctaacatgagatttgagcagggacaaatatctaaatgatatcaatgaccatccccaagacacatagtcatcagattccccagggtcaaaatgaaagaaaaaatattaaaggcagctagagagaagggtcaggtcacctacaaagggaaccacatcaggctaacagcaaacctttcagtagaaaccttataagccagaagagattaggagcctatattcagcattcttaaaaaacgtaaattccagctgagaatttcatatcc

SEQ ID NO: 95103 - DNA, 405 bp, Homo sapiens
acatgcttgaaaggggtgtgctggtctcagagggttgggtttctcagttggctgggcatcagctggccatgctttagttatttgatgggaggaaaaataagtgggaggtgaggagtaactcctgggctctgatgagtattcaaggcaagtacagatctggaaagcctgtatgcaaaggaggaactcactgaaaagtgctggcctgaggagggcagaagggagggctggggaagccagcagcgggagcaaaggagtaggctccaactgggtgaagatgttggtgtggtgcgttatgtaaaatatacaaattattattggaaataaccacgtctcagcagtgctagttctcagtttggagaatgggaaatcgaaaggatcagattcagagacggcaacttactcaag

SEQ ID NO: 95104 - DNA, 319 bp, Homo sapiens
gagggaatggactcgagggtgtgttcccggccgtcaccacctgagggcagtgtggcagcgcctctggaaggagactggactgaggcgacttgtaaatgctgagggaaaccgattgacaggaaaggaagccatacacttcttcaaggaggaaggtagtgagaggagaaacgtggatccctggggcttccactcttgcggaaagtatgaaaatctctggtttgcaaagttgctacattccctctgctactgacgtgattgtttttcttttggttaaggctgctttctacactttatttggacccagaaataatttaaatag

SEQ ID NO: 95105 - DNA, 374 bp, Homo sapiens
tgtgtgcgcgcgcgcacacacacaaggctgggagctgtgcggcaggcaccctggcttcgggaacccaaactagccagcttccctttctgggcctgctggcctaattcccagccgcagctgccattctgggcccccctccctgaggccatctccctgcagatttggcagcggggaaaggaggggccgagagaaggggagagaaccagagacaggactgagcgctaatctgatgtagatgatccggcagccttctccagcttggttcccctctgccatcagctctccaggtgactttccctgtgccctgcactctccccttctgctttcatctccttaagaaagtgcccagaaagttaaacccacacacaaacaca

SEQ ID NO: 95106 - DNA, 468 bp, Homo sapiens
ctcaccatgcccattttacagagggagaaactgaggcacagggaaggtagactcttatccaaggccacatagcaggtaaacaaacaaactaggactccaaccaaaccttgtgctctgtctcagccttaaaagaaaactcaataaacattctggcctttttgtttttgttttgagacctttattctgttacgcaggttggagtgcagtgtggtgatcacagctcactgcagcctcaaactcctaggctcaagcaaacctcctacctcagcctcacaagtagctgggactataggtgtgcaaccgccagagctggctatttttgtgtagagatggggtctcgctatgttgcccaggctgctgatctcaaactgctggcctcaagggaacctcctgccttggactcccaaagtgttgggattacaggtgtgagcctccatgttcagtccacattctgtactttttttttta

SEQ ID NO: 95107 - DNA, 652 bp, Homo sapiens
tgccaaagtctattgactatcctgatagcattccttgtcttagtgggatctgatgcagttgaccgtaaacctctacttggtggttctccgtgaccccacatatgcctggtttttgtcctttcttgtgggggctcctctgtggtatcctatgctgactccgccttttctccccttccctttccttggtaaagctccaggactcaggactccatcttctccttttctctctccattttcaatcctctggcgatctcattcagggtcctggcctgtttgacctctgcaactgggtttaatccatatctcacgcttcacatgttccaaatcagctcttgatccttcccctgccccaccccagtgctcctgcagtttgcttttctgctgtcttctctatctcgggcttatgcccatcctccccattgctcagcctaaaacctcgaatacactcttcacttccctttctctcacaccattcttgtggctttaccttcaaacatgcagcctttcctccctacctctactgctggtggccttgggtgagccactgccatctctcctgtaagtggtatctttgctgctaccgaccaacccacagggggatctctagagtgacctgaagcatgaagctggactgcgcggttaacgaagaagg

SEQ ID NO: 95108 - DNA, 632 bp, Homo sapiens
ggggaggatggtttcaggatgaaactgttccacttcagattattaggcattagattctcataaggagcatgcaacctatatccaaagcatgcagcctagatccctctcatgctcctatgagaatataatgctgtcactgatctgacaggaggtggagctcaggtgatgatgctcactcatctggcactcacttcctgctgtgtggcttggttcctaacaggccatagattggtaccattctgtggtctgggggttggggacccctggcctaatggatcatcttagtaaagttcagaggcatttaggaggaagacccatctgatgacatgcaaggaggaaatatctgtagacccctggagaagagggaaagcagtgcttttccatgtgtaagcttgggactgagggttggatttttgtggtaggtacatgactgggtggagaggatgacattcctcagttctccatttggctttcagtaggacacacttcaggagtcccacatcaggatggctttttttctccctgtggctaattaaaaccatcgtaagcccaaaagctaaactcaaaggcctttgagagccttccattgggctgcccaaagtccttagaggctggttggccaatgtaatgaa

SEQ ID NO: 95109 - DNA, 324 bp, Homo sapiens
ggaaaagtcagtgccaataaggaaggatggattagcagctcaagattcaagcagacaagacagtcctaagagtccaggtacaggggaaggtaaacaggaagaagcaggttcgagcaggcaagacatggcattgaagcccggggtgataagacttagcccgtggagttcgtggtggagacttctggatccacagaccaggtttgtaacagggtaagaatctcggctgaaagattaggagccacagtcctaaagcctgggtcagaaactgggtaacgaggtgggagccaagcacaggtgagcagcagcatctccctgtttctccat

SEQ ID NO: 95110 - DNA, 222 bp, Homo sapiens
ctctagcggatcttatggagaccaggctgagcccaaactgtgatatagacttagcccgtggagttcgtggtggagacttctggatccacagaccaggtttgtaacagggtaagaatctcggctgaaagattaggagccacagtcctaaagcctgggtcagaaactgggtaacgaggtgggagccaagcacaggtgagcagcagcatctccctgtttctccat

SEQ ID NO: 95111 - DNA, 1058 bp, Homo sapiens
aaaccaccttcactcatatataaaaattattatgtgctacactagatatttcaggagaattgataaaagaaagactgttgtattcatatgcttgtcttcctggctagaggatctgttttaattaatcagctcatggagtttggaaaatatttatagtatacatagctgagtgttcatgtaaattttgaatacgttcatcttttttttaaaaaaagattgaacttcaaaaccattttcttacatactcagtagaagttgttatgagccaacattttttgtgagctatactattttaaacatctaaagtaaattatttgacatataaaaagacttcttcatttaaaaatatatcttttaaaaataattttacaagtgatgggcatctcattttagaagaagaggcatcaatgacagcagttacagtaactcgatgctggaatatgtttttaaatacaagatgctgtgttcagcattgtacatacattatcaaattttattctgataatatgctgcatgatgtattaggctgggttctctcagacagaacctacacgtatacatatatatatatacacatgcatatacatacacatacagagagagagaaagagagagagagagagatctctacatttattagaggaattggatcatgcgattatgggggctgagaagttccaggataggttgtctgcaagctggagaaccagggaagagagtagagtagctttctccaagtcctgaagcttcagaactagggaaactgatggtataactctcagtcagaggccaacggcctgagaactcagacagccactttgcaactcctggaatcccaaggccagagagcctggagtttggatgtccgcatttttgttttatccatacccctgaccaattggatggtgcccacccgcattgagggtgggtgtccctctattaaatattttaactataattttaactgtgatataggcactgaattcttgttgctaataatctggtaagatccatctgaactatgaagtgagtacgtggaggaactcctacattttagg

SEQ ID NO: 95112 - DNA, 850 bp, Homo sapiens
aaaccaccttcactcatatataaaaattattatgtgctacactagatatttcaggagaattgataaaagaaagactgttgtattcatatgcttgtcttcctggctagaggatctgttttaattaatcagctcatggagtttggaaaatatttatagtatacatagctgagtgttcatgtaaattttgaatacgttcatcttttttttaaaaaaagattgaacttcaaaaccattttcttacatactcagtagaagttgttatgagccaacattttttgtgagctatactattttaaacatctaaagtaaattatttgacatataaaaagacttcttcatttaaaaatatatcttttaaaaataattttacaagtgatgggcatctcattttagaagaagaggcatcaatgacagcagttacagtaactcgatgctggaatatgtttttaaatacaagatgctgtgttcagcattgtacatacattatcaaattttattctgataatatgctgcatgatgtattaggctgggttctctcagacagaacctacacgtatacatatatatatatacacatgcatatacatacacatacagagagagagaaagagagagagagagagatctctacatttattagaggaattggatcatgcgattatgggggctgagaagttccaggataggttgtctgcaagctggagaaccagggaagagagtagagtagctttctccaagtcctgaagcttcagaactagggaaactgatggtataactctcagtcagaggttgcagtgagcagagatcgcaccaccactccagcctgcacgccagcgctaaatccgtctca

SEQ ID NO: 95113 - DNA, 881 bp, Homo sapiens
agtgggagtgataatggccacctcgtggggttgctagggactgaatgagacgatgctcaaagcaggggtaccatgcccggcacattccagcactcaacacctagcccctgctgtcactgtccttgtcattattaccagattcacaagcggagccggctaaggccaaggagctgtcctctgagatccgtttgctcccgctgctgggaatgaaaacgtcgctgacaccgggctctgcagagcagttttctgattagatggaggtaacccaagttccaaaaaccacagctgaggagcagcagctgacaagctggtttgcatggatgtggaaaactaccgcgttccagccgcctccagacagaaacaggacgcatagccaggtcccacggcagctccaaagagggccttgcacgccaagcggggcaccccccagcctgagggttcaccaaccacgcggaccacgcggaaacctagctgggcttctctctcccctcggggcgccagtgcgggaggcggtttctcccttggaagtggaagtcagatctgcttccaggttcccggtctagggccggtctagggcagctaagcctgcctgctccttcctttccatcctccctggtcaggggagcccaacagcaacgcgagggcacccgaccctctgcctgcacctggagggcgcccgggtccccccaagccacggccaggacgtcgcgtggtggggcagggaaaggggcgccgccgctgctggaaactagccctgtgcgctccgcccgcgctcccctcccggagatgtctcgagcgcctctggcgcgaacaaagcccggccgcccccgagaaacttccgtgcatgaaggtttcctccttgactcggcagcagcggccgc

SEQ ID NO: 95114 - DNA, 609 bp, Homo sapiens
taagctacatcttctcatcgtaaaaggtttggaatgttttaccgtttgattcgggaattcaggggtggggggcaccagggtcttagggcggcctgggagtgcgacccgaggctacgggcgccggggctagcaacctcctgtcagacgcggtctcctccgccggggacgaggaagcccaaacgggcgcaccaacttatttcacaccactctccacccagccccgcaaaaacgagaaacgtttgccattcccagtgagtttcaaggctgcaaatcctccggagaggtcctagatggtctctccgggtccgcgacgcgaccacagtacctactgcgacttctgttttcgcaccgcctttcccttcgcacggaaccctcccgaagtcagacattgccgagcgcccgcagagcagcttggagtggcggcgccggacccggctgtcgggcgggctcgggtcccggctgctccgggccgggcactgcgcgcaaggacgcgaccccgccgcccagcgcatctcccaccgactcccgggctgacgcgagggcagccccggggcgccggctgcgtggaggccgagcctcggtcacctccctcgtcacggacgcggccgc

SEQ ID NO: 95115 - DNA, 297 bp, Homo sapiens
caccatcaagcactcctgcaagaaaggaagaaaccctttctgcttagagctgtttattttacaactaacaaccaggaaaaaatatctatctggatggccgggtgcggtggctcacacctgtaatcccagcactttgggaggctgaggcgggtggatcacctgagcccaggagttcgagaccagcctggccaacatggtgtaaaccctgtctctactaaaaatacaaaaattagccaggcctggtgcgggcccctgtgatcccagctactcaggaggctgaggcaggacaattgcttg

SEQ ID NO: 95116 - DNA, 289 bp, Homo sapiens
tcactcttgtgaaggaatcattaatttgagtgttcctatttcccatcacatgcagattcagggggaaattcttccaaatctcctctcctgcctcttcttttacagtgtagaaatacctgcccaaatcaaacaaaactaacaaaagtagccaatctcatgaagctcatgttctatacacataggaaggccccttagcaccttactatcttagaagttattttgcacattaatattaatattgtgcaattggctatttggtgtctaaacccacagaagataagttaacagc

SEQ ID NO: 95117 - DNA, 300 bp, Homo sapiens
tcatctggtactcctattttgccttcgtcagtgtgcttaatggtatcaaatatttctttgacgatctgttcattttcctacattccttttactctttgtttttcaaattgcataatctctaatactagaagtagacattaattcgttcttgtaattctttcttctgccagctcaaatgtattgttgagcaccccttgtacatatttttttttttttttttgagacagagtctcgctctgtcaccgaggctggagtgcagtggcgcgatcttgggtcactgcaagctccacctccctggtt

SEQ ID NO: 95118 - DNA, 821 bp, Homo sapiens
aaagaaaaagtcaagtgagaagagatgaagatagggtaataggagtatcattagtgatcttaacagagatagtttagtggaatagatctgaagttggattctactggattgagtactgaaaggaagaaaggaaatgtggttatcctgaggttggtctattatttcaagactcttgactgtaattgggcagagagggaaacaagagtaactacggagagtggacatttcgttgtgcaggttttgtatattattaatggtagagacttaggtaagtttacttactaagagcaaagtagcaagtaggagcttatagacagagagagagtgagagggagaataatcaatgaaacaagtacctcagagaataagaaacatggtggccatagcaaaacatggcagaatgagtcttagacaggtatatgtatgtaacttggtaagtgttagtacaggaaatagggagatctcagctgaaactctggaatcagtgaggaacagaacaaattaagggaagggaaataaaattgaatgagttctttaccccaagtggtttctccaagcatgatcagaatccagggtaaatagaaaaatgaaataaacatatgaacttatgaaatgagacactaaacagaaacgtatttcctgaaattaaggaggttttcaagaagaaaattctcactccatttctgaaaattactcctccacctccaattccccatgaagagatcaatgcctaagagtctctgagataaattcagattttttaaaaaaggcatgtgcagacagtacaaatcacatgattaactaaaagcagacaggaacta

SEQ ID NO: 95119 - DNA, 417 bp, Homo sapiens
gctctgtcttttaattctcatattttaaaaaaatttctcaaaggttaacgtcactaatcataagcctaagattcctaatgatatttgtcactgaccctggaaatgagatgtttacagatggagttctctcatctgacaagataagtcaaagacaagacatcaaaattatgtcccttgcttttgtgctatgagagcaatttttagtgagtctttcatttataatatactgtattaggatggtctttaaaaattcctagccaatggtagtaaagcattagtggagcacctattctgtgcaagaaacatgataggtactttatgtaattgttttatcttcataataacttggtaatttaggtattgttattttacctataaagaaataaagactgagatgttaaaagatatacaatttgc

SEQ ID NO: 95120 - DNA, 461 bp, Homo sapiens
ccttttggtgtagtcctcagatcatgagtgagttctcacgatatctggttgtttaaaaatgtgtagtatctcccctctccttctgtcttgcacctgcttccaccatgtgaaacacctcgctcatcctttgccttctgccatgattgggagcttcctgggacctccccagaagcagaagcttctatgcttcatgcaaaacgataagccaattaaacctctttatttttttaaataaattatccagtctcaggtttctctttatagcaatgtgagagcgaactaatacacagggtcagggctctggcagggaaaacacagtgctacgttagggcagtaccacacaagtcctgcttctctgaggagatgggatcagatgactgtgttggaaagaacttcctcccttcttactttaaaaccacagcatgaagacatgagcagttttggaccctgttcttacttat

SEQ ID NO: 95121 - DNA, 114 bp, Homo sapiens
ctaaacatccggcacccttgctctgtccatcttttagtgtcgagttggggccactttactgttgaaaattgcttaattccatttgtgaaagttcctctgcccatccctatcccc

SEQ ID NO: 95122 - DNA, 158 bp, Homo sapiens
gcataatgccatcaacctttattgggacactgtcagaaccaaccctgtgaaatttcaccccttgtgcttattgtaagaatgatgttgaggatgttatttgttgcattacacaatgctgtactcaggggacccatgcaccaattattttctgtctcagt

SEQ ID NO: 95123 - DNA, 464 bp, Homo sapiens
gtccttttagaggagttccccgtgggataccaggcttctccctctgtggcttagtctgggaagccgggcatggggctgaaaatcaaggacttatacattcgggagcacaaaaggaaaaagcagtttgatacacttcaaaatatgttgttttgctgccttatttttcagtcttttaaaaacaagatattccaatccttatcttcctctatcttggaatctaggaatggtcctaggtaaagaagatccttcctcttgggggagccgctttaagagccatctctgcagtgctcttccctggatcatccttctttgggcctcataattgacccaaatttctctagcagcccatccaatcctagtatctcttcttaataatatcaaaagcctcgaggccgggcatggtggctcacgcctgtaatcccagcactttgggaggccaaggcaggtgagcgagattccatctc

SEQ ID NO: 95124 - DNA, 345 bp, Homo sapiens
cttcctgggttcgagcgattctcctgccacagcctcccgagtagctgggattacaggcgtgtaccaacacacccggctaattttttgcatttttagtagagatggagtttcactctattggccacgctggttcacaaactcctcaactcaagtgatccacccaccttggcctcccaaaatgctgggattacaggcgtgagccaccactcccggccaggtagtgacagtttttagaggctctgggtgcttggcccttgccttaaccgaatgctttaaaaggcctttgatctctgtcaataaaattgcaagtgtgtacacacatttgacttaacaatcataataata

SEQ ID NO: 95125 - DNA, 265 bp, Homo sapiens
gccttgtgaggagccccgtcatcactgtctctctgttgtctttcctacttcctgaacccttgactcaggtggttggcgtcctcatccacagttctcactgacctctaagctccaggaaggcagatctcacctctaagccttcacatcctttgctgtcacgcttgtgcccacaggtttctcattggctttggtcagccatgtgccagtgtagacagaaagcctggtcagaggactcggctttctgaccaggggccttcccatgggg

SEQ ID NO: 95126 - DNA, 798 bp, Homo sapiens
ccaaaaaggaaaagagaaggtgaggacacttacattttcacattttatttgatatatttatatgtggcttgaatctcttacattcatgcattacatgtgcaagtttgaaaataaagtgcaggtggattattttaaaatttggaggctgggcccggtggctcacacctgtaattccagcactttgagaggccaaggcaggaggatcacctgaggtcagaggtttgagatcagcctggtcaacatggcgaaaccccgtctctactaaaaatacaaaaattagctgggtgtggtggcgcgtgcctgtaatcccagctactcaggaggctgaggcaggagaatcacttgaacccaggaagcagaggttgcagtgaactgagacggtgccactgcattccagcctgggcaacaagagtgaaactccatctcaaaaaaaaaaaaaaatttggaaagcacacaaaacaaaaagaacaacataagtctctctcactgtcacactgctcagtggaagcactgttaaaaggctggtgcatgtgtttccagcacgcactaggagcactgaggaacactgcttcccctgcttgcccccaggaagggggcctggccaatgccctggactagacatctattctgctgtccagcatcacccatgccactgccctgccccaccctgagccactcctggagacacctcccagtgcagggagtctcccagaagctttgggccagcagaatgctcagctcccaagccaaaatgtccttctctttgttaactacaaaataaacatctccaggccccct

SEQ ID NO: 95127 - DNA, 369 bp, Homo sapiens
tggaaccttggagctctaaggaagcagcagccctcagagaagactctcttccacaaaactggtcacccagaagctgtgggttcactagttgattcattcattcattcaacaaacacttctggagcacctccttctattccaggctgcactggttctcagcacacagggttctccagtgaagggtaacctggccctgcctgcaaggagtttacacctgcttttccctactgcttctaacatattggcatcatcccccacctgggcacagagcctagcatcctagcaggagcacactcaaaatctgttgtttactgattgacttgtggtaaggaaacagcttataaaacacattattaaaataaattacgc

SEQ ID NO: 95128 - DNA, 323 bp, Homo sapiens
ctccaaattaggacactttggggagtgaaaggggtgctattgatagttacactacttggaggctataagtgaatttggtagaggaaggaaagttctgggatattgccacccttgaccttttggagaaatgtagacagcatctcccaggcatgacgcctagggatcgtgtttatctgtcatcagttggtgactccatgtttattgagcactggctataagccagacttggtgagggactgaaacaattacaagacacagttctgcactggaagaaataggaatcaacctaagatttcctgtcctgctaggtcatcaggttcctg

SEQ ID NO: 95129 - DNA, 572 bp, Homo sapiens
agggcacccaacatacacacagacttaacactgtgatggaaagaagggaagaaggtgggaaaagacaaaactcctctattaaagagggcaccaaaaaaactgcactcttaggtgaataatttgtgattcaggcagacaaggtcatatctgacatccatttaaatcgagcagctttttcactttcagtctcccacttgctcaagctttactcttttatttatgtggtgactgagagaaatttaattggcatttatgtttaacttaagagcaaaccaatcctccaatactgagacagaaaagataataaaaattggtatgaaactgagctagagtttaagggggaattggtggggtaggaacaaaagtaaataaataaatgaagacaagtttcacaagacccactgctaatgacaacggaaataaaggaataaaaaaagcatcagaaatcatcaaggcaggaggcagcataagattcagagacagcaataaagatctttaggataccacactgaggggtgtggagaggacaaccctgagactggtgtgcctgaacctcaaaacctccttagagt

SEQ ID NO: 95130 - DNA, 121 bp, Homo sapiens
gtaaaaagaaaaaagtatagtcctatcacatagataacttgataacattttgatgtattcccttccattttccaaatacgtatatacatgaaaatatagtaattcttctctagaaattgaa

SEQ ID NO: 95131 - DNA, 498 bp, Homo sapiens
caaggtcaagttgaatctggtacaacatgtccgttcggtgaagcatcagcagactgagggcctacggaagctccagctccaccagcaaggcctggcaccagaggaggacaacctcagtgagatcttttttgttaaagattgcccaccaaatgagcttgcatcttcttgccaaatcttctggagcgcttgtaatttcctctgtacagagcccaacaggctcatcagcagcagaagaaactgcctcattgggagccaggacttgtgatgatgatcttacagagcagcagttgagatcaacctcagaagaacaaagtgaggaggcagaaggagctattaagcctacagcagtggccgaggacgatgaaaaagacacaagtgagagagacaatagtgaaggcaaaaactctaataaagactctgggataatcacaccagagaaggaactaaaagttagtgtggcagggggtacccagccactcctgctggcaaaagaagagg

SEQ ID NO: 95132 - DNA, 448 bp, Homo sapiens
caaggtcaagttgaatctggtacaacatgtccgttcggtgaagcatcagcagactgagggcctacggaagctccagctccaccagcaaggcctggcaccagaggaggacaacctcagtgagatcttttttgttaaagattgcccaccaaatgagcttgaaactgcctcattgggagccaggacttgtgatgatgatcttacagagcagcagttgagatcaacctcaggtaatggttcctactccttctcaaaatatttccttgtcctaaatgagttgcttttgttactctcataattgatggaataaacattctctgggaacttctctaattagatctgatcatatgccttattcaaataagtaaaaagcaaaatgaaataaattcaataattggaagtatatgtaaattgactttacattttagagcagttttaggttcacagcaaa

SEQ ID NO: 95133 - DNA, 385 bp, Homo sapiens
acagtcccctctagtttacctctccctcaattcagtcctcacctttaatggctggcacctttactaatgtacaagaataagaactgtaaagaacaataatctgtttctttcttcacccagctttcttcagaaggacctgacttcagtacacataaatcatcctgcttggttgtgaatgcaattagttttactttcacaagaatcgtgtcctcttgttgatctctttccattttcttcatacttacatctactttctaataccgtcacacttcctttctaggcaacttctccctttttgccaacttcaggtggccaaagaaatatgctatcagtttcatctctcttgtttggaggctgatgtgctccctgaacatacagtcctaat

SEQ ID NO: 95134 - DNA, 249 bp, Homo sapiens
aatgttaagagcattacaaacggaaaattcatccaacaataagtaatttcttctacaaaatactatattctatgaaaatcaacctgtagcctcatatgtttgcattctggattcaaacaatgtttgatacaatatgaaaaagaatctggacctcacagagaaattatttgactaacttttcaatcttttcaatgtaaatgcaatgaaataaaaaagaatatcaaacatcaaatataggtattctttttt

SEQ ID NO: 95135 - DNA, 681 bp, Homo sapiens
tttctctataaacaaaccatgcatgggcttttaaaggagaaaaggaagagtggattgacagagaaaataactgtttaggatagaggttaggaaaagactgagagccagagaaaaggcatcaatcccagttgttaatccacgaggcatcccccagacccttctgtaaaggttaatgaaggcagtaaggcagttatctctgtttcgtgcactgatgcaatccaagcttccacggtttagcacatagtagacgctctataaatatttattgaatgttgaacgatgagagagtaattaaaaaccggtaagttgatatcataaatacaacgacaacggctcccctatcaaatgtttagtgttcccagagacagccccattgttctacatctcgttatactctggccttttcccgtttttgtcattcgaactcatatacatattgaaatcgaagcacacacaaatccctgaaatgacaaacttaaatgctatccaaaggaagttacattaggttgctgctttgaaaatgaagtcaactcctaatgggttagctgtttctgcagcattctttcccgccttcttggagttgaggtgagggattaaacaatcaaccttctctctcctttctctcattctcaaagtttttctcgccttttctttcctttcctttgcttcatttcttttccc

SEQ ID NO: 95136 - DNA, 277 bp, Homo sapiens
ttgcgattagggcagcgtgggctctggagccaggatgcctgggctcgaatcctgactcttccagatatgtgaccttgagcaggtgacttcactcttctgtgccttggctggcttctctcataaatagaggtgctaatctgcacatccttgataaagtcatggtgaggattaggcgaactcatatagatgaagtgcttaaaacaggggctgccagatcctagcaactgcacacacgtgagccagcatctttcttttttatttttatttttattttgag

SEQ ID NO: 95137 - DNA, 480 bp, Homo sapiens
taatttctcagccgggcgcaatgactcactcctgtgataccagcagtttggaggccgaggcaggtggctcacctgaggccaggagtttgagaccagtctaaccaacgtggagaaacctcatctctactagaaaatacaaaattagccaggcatggtggtgcatgcctgtaatcccagctactcgggaggctgaggtgggagaatcgcttgaacctgggaggcagaggttgtggttagccgagattgcaccattgcactccagcctgggcaacagagtgagactccatctcaaaaaaaaataaataaataaaataaaaagataatttcccatttgtcctttatagtatctattgaaatacattttctttgaaaacaaagtagcttgcattgatttttattttacatttttctagattataataaaatttcttgttcatataacgatatgtgagaataaaacatatctaagtctaattaaaa

SEQ ID NO: 95138 - DNA, 211 bp, Homo sapiens
taaaaagaaaaaaaaaattttaagtaaaatcacatactaatttcagaagaaaacaaaaactaaataagctatacaaaaccaaaacaaagtaacgtttacaaaaatgaaatgtattatgcctgccagctgtttgctcttttttgctctagaacaaacacatcttcatttttttttttttttttttttcgcaaaaaggcttgctgacctacag

SEQ ID NO: 95139 - DNA, 503 bp, Homo sapiens
gttttagatttaaaagagtatcatctaaaggatctgacattacagacaaaagagagatctgtctatggcagtgcagaaattttcccagtcattgcaagatttccagtttgaatgtattggtgatgctgaaacagatgatgaaattagtattgctcagtcactaaaagaatttgcaagactactcattgcagtagaagaagaaaggcgaagactggcaatgttttaagaggttttgctgccagcccccaaaaagcaggcgataaaaatgagaatagcctgacatttccatggcaaacttcttggtgttgttgtaactggagcttggatgaggatgagacaagccacattggagaatgatccaaaacgctaacgatgtattaattgcaccacttgagaaatttcgaaaagaacagataggtgcagcaaaagatggaaagaagaagtttgacaaagagagtgaaaaatattactctatccttgaaaagcatttaaatttgtccgca

SEQ ID NO: 95140 - DNA, 692 bp, Homo sapiens
cggccgccgctggcagcgcctgtgccatggggctgcccactctggagttcagcgattcctacttggacagcccagatttcagggagcgcttgcagtgtcacgagattgagctggagcgaaccaacaagttcatcaaggagctcattaaggacggctctctgctcattggggcgttgaggaatctgtctatggcagtgcagaaattttcccagtcattgcaagatttccagtttgaatgtattggtgatgctgaaacagatgatgaaattagtattgctcagtcactaaaagaatttgcaagactactcattgcagtagaagaagaaaggcgaagactgatccaaaacgctaacgatgtattaattgcaccacttgagaaatttcgaaaagaacagataggtgcagcaaaagtaagtgttacattttattattcttcagttattctcctgataattaaagatgacataatttcagatgttaacatttttgaaattagaatgaccttttaaaagattttgtacatcatttaaaactttttgcatagagacttaacaaagactggacttcttttagacataaaagatgttattattctactgagtagataagaagcatgttataaatgagttcttcctttcccaaaaattataggaaattaatgattttgaagacacggtgaaattatgaggagc

SEQ ID NO: 95141 - DNA, 814 bp, Homo sapiens
ataggctgggcatggttggctcacgcctgtaatcccagcactttgggaggccgaggcaagcagatcacctgaggccaggagtttgagatcagcctagccaacatgacgaaaccccgtgtctactaaaaataaaaaaattagccaagcatggtggcatgcgcttgtagtcccagctgctcaggaggctgaagcaggagaattacttgaactgaagcggaggttgcagtgagctgagatcacgccactgcacctccagcctgggtaacagagtgagactccgtctcaaagagaaaagaatgaagtaaatctactctgccctccagagagatcttccatgtccagtgcccttcccgctctcctgcaaaggcgccttctgcgggcgtcctttcggccgggagccctacccggaacaagtcatggttaatgcagttctcaggtctgctgctagcaaagcacttagtgttcatttctctaagatttatattttgcctttattcttgaagggtatttttgctggatatctagaattatgggttgactctttttttaatttatttttcttttttttttttttttttaacaatctaaagatttggtttttagcagtttgcacgtaggtgcctcggtgtgattttctttgcatttattgcactttggcatcttgaatctataaatttgtctttcaccaaatttgggaagttttagaccatgtcttcaaatgcatcttctgtccttagtccctgcccctctgtgctgcaatacacacgcatctgtgctgtccccgaggctcagggggctggggtttgttcatcac

SEQ ID NO: 95142 - DNA, 208 bp, Homo sapiens
aaatagcatcctcttcttgtttcattgatgataatgtcttttctctggatgtttcttccatctttatagtccatttgctcttacattttctttctctcatttgttttggtctcaatctaggatgctttcctcaaatataaatcaatacttggttggctgctcattaagattggattgggtggggtgtagggacacttcagacatgttt

SEQ ID NO: 95143 - DNA, 222 bp, Homo sapiens
ctggaaggaaagagggggcatgtgtgaacagagctgtctatgacataaggtaggaagcaatagagacacagcaaactgctgtcagagctctctggtcagctcagggtcttagaagggtaagcttcaagtcaatgagtagcatatattcaaggacagggaagctgaaggcacaaactagctgaggtgccattgcaaacattgagggaggaagtgatgagtgcc

SEQ ID NO: 95144 - DNA, 668 bp, Homo sapiens
gaatgtgcctgtgtctggtatacggggttcccatcacaggaagcacgtggctgcatctgatatacagggttcctactgcatgaagcacgtgcctgcatctaatataccgggttcccatcacatgaagcacgtgcctgcatctagtatactgggttcccatcacatgaagcacgtggctgagtctggtatatggggttcccatcatgggaagcaccaggctgcatctggtatacgggttcccattacaggaagcacgtgtctgtgtctggctgcggacggtatacagggttctcatcacggaaagcacgtggctgcatctggtataccaggttcccatcacaggaagaatgtgcctgtgtctggtatacggggttcccatcacaggaagcatgtggctgcatccgatatatggggttcctactgcatgaagcacgtgcctgcgtctagtataccgggttcccatcacaggaagcacgtggctgcatctggctgcgtctggtatctggggttcccatcatgggaagcacatgcctgcatctggtatactggtttcatttattttcctgcccttattctgtacctgaacccatcatctatttcttacgaatttttattttcatcaatatgtacacttctatcaacttcctaaaactctttgacacatatct

SEQ ID NO: 95145 - DNA, 315 bp, Homo sapiens
aacagctggttttttttagcaaattggctgtgatctgccttcctcccaggctgaggactggtctgcatggtagagggtcaggtgctcctgcgtctcactgagaatgactcacagctggagcatgcatcctgggcctcctgtgccctggccgcccatcctaggatgttgggcaggtaacagttgtaggtatgtggacttaccagtacatgttgacataccctttcagcctcattaatttttgtatcatatatttattcctagtgaccactgaaatactgtgtgctgatatctaggttcctcaacttaaatttccac

SEQ ID NO: 95146 - DNA, 550 bp, Homo sapiens
ccctctccacaggtaggcagcttacttctccacattgattttcatttgtctgcctgcacttagagaaccttacagaaccatgtggctggtgggtgagaatgactcccagcataaacggccctgcagtgcatgtgcggttctgagcctcatcctttccacaagtgcatcctggagagccagcacagcggccccactgggcccctgctcccctgtcctggcctcggcttcttctgtaacatccccttttctttcatataaacatcaacgcagatcagaaagtctccagggtgacgggcccctgagttccaagcattgcgagtacgtagccctgtggcctaaggtggtttttgttgttgttaatgtagacacggcctctgcctgtgcttcctgccacaggcagctatgccggctggacgtaagaagccaaacttctatgaggctacctaagggtttggcttttggactaagactcttgcagagtcagggaccaagtcgcgaggtcgtttatttggttaccatatttgatagcaactctgcagagtgctggtgt

SEQ ID NO: 95147 - DNA, 780 bp, Homo sapiens
tattgatattttcattgaggtttatttataccttaactctttccacaaactatttgagacagcttcaagaaaacacccttactgaatctatatgcatagggaaagatatggaaatgtataagactggtgaatgctttctggcttcccttagctaggtgagtccatgtaactaaattctggtcagctctggaggggtagatctaatttttgggaaagctccttagagggcagggagttcaccctttgtctgcccttttcccttcttgcatccctggaatgcagaaaacatggctgcaactctaacagccctcttgggccatgaagtgaccttgaagtctctctaggagccccattaagatgacagcagggcagagagacagaaatctgaattcttgacaacttaatggagccaccatatcagatctagactgcctatctcaggacttcttttacatgagagaatgagcagttgaagccactgtgacttctagactgttttacttggcaatttctaaagatatagaaggaaaattatatattcaaatctttatgaatgctaaaatcactgcgttataagagtattggcgacttctttttttctatttcccaaaattcataatgactacaaacatttttattattagaacaaagctttaaaatagcaactaagaaaatctaaggagaaattttaaaacactggaaaggaaaatatgtatgtcaacatacacaacaattatatatgtgataaagctttaatgcatgtgattatgctttaattaa

SEQ ID NO: 95148 - DNA, 321 bp, Homo sapiens
aggttgcagtgagccgagattgcaccactgcactccagcctgggtgaaagagtgagacttcgtctcaaaaataaataaataaataaataaataaataaacaaacatgtactacttttattgtcaaaaaagaacaaggtaatgttactttgtaaaaacttagtcattcccactcttaatttgccagggcaaggcaattggataattcatctcctttaaaggagttaagggctgataatgactaatgtgctaattcctcctaagtgtatttgcattctaaccaaggagcctttggacaggggtctacagactatggcctgtgg

SEQ ID NO: 95149 - DNA, 439 bp, Homo sapiens
tagctcatgcacaggtagaccgggcctaattgtcagagagttccagcagaacggcctccccactgacattcaccagcccgcctgcaccttcccccaactgcaacctcccccatactgctttgtcagtacacacacacccataaccaacccccacaatcgtttgatgggtcatgtgggatcaggtggaccttccttcccttcccctaccactggcaggtatttgcatatacaccccaccatgccatggctgccagtgtgagcacactctgccccctgctgtgccaccattgacaacatagatgcacataagaccagcagccctgcctgccattctgtgccacaattgccactggcacaattgcaaatgtggtgacctctagcaccactttcaccagtgctctacccctgcattgataccaccggcacaaacctgtgcctg

SEQ ID NO: 95150 - DNA, 292 bp, Homo sapiens
tcttggatgtggaacaagaactcaggacccaccaaacacaggtacaaagaaggctgtaatactgtggccctccacgctctgccagtggagggcagctaccccacgcgacgggaagcagcagcgggcgggagcaggggcgacaggacagacagagctgttaacatgccgccatccatggggctgcagatggtgggactaaaagagctattagcacacggtaacaccccctctgaggtttcagggttgcggacacccgtctgggcgccaccatgttcccctcagtgtgacatgc

SEQ ID NO: 95151 - DNA, 590 bp, Homo sapiens
acctcagaagctggagacgtggcaccacagcgagggccaccatgggggaccagaggctgcaggactggctgaggtccccgggcatggactccaagccctggtactgtaacaaacggccttccaagtgcttcgcgaagtgcaagcacaggcgcctgaggttcccacccatggacacccagaactgggtatttgtgaaggagggcatggacgacttccgctacggctgtccgtctcccgaagatactctcgtttgtcgccgtgacgagtttttactccccaaaatatctctcagaggtccccaagctgaccccaaaagcgggcagaaaaagctgctcaagaaagcggccctattttccaagctctctccagcccagctagcacggaaggcgttcgtagagcaagtggaagcccagctaatggccaagcatcccttggccatgtaccccaatctgggagaagatatgcctccagatctcctactacaggtgctgaaacacctggatcctgagagggagctggaggacgcttgggcttgttgtgagacccaggagaagacaacagaggtacccactgagcctggtaaacatccc

SEQ ID NO: 95152 - DNA, 332 bp, Homo sapiens
ggattttgagcttctcttgaaagacggaaagttctggcaacattgggcctggattccaacatggccatgatgactgggatgccctctccatgggccccatgctctcacccagcctggcctgtgcaggcgtttccgtttgtgtcggatagctccttgttggcacctgtcataaagcatttttcactttctctcttatctcaccttcgtgaggctgcaagcttccttttttatttctgtcttctctgctgtgtttttcctctctctagcatggagtcagtgcttggcatatcatagactctctttttttttttttattgaattgaaatataagc

SEQ ID NO: 95153 - DNA, 215 bp, Homo sapiens
tgctgggattacaggtgtgagccaccgcaccctgcccctggcctcacatctacgtcaagccttggtatctgtgaaatatctcttctctggtagtcctgaggttctgcttccctctcatagagtccctctgttggttgaggaatgatacggggaggacaatcccattgaaagcaaagagtcgacagagttttactttttagagttaatgtaagagg

SEQ ID NO: 95154 - DNA, 1126 bp, Homo sapiens
tgccctgcgcccgcaacccgagccgcacccgccgcggacggagcccatgcgcggggcgaaccgcgcgcccccgcccccgccccgccccggcctcggccccggccctggccccgggggcagtcgcgcctgtgaacggtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagggcagccgctctggctctagctccagctccgggaccctctgggaccccccgggacccatgtgacccagcggcccctcgcgctggagtggaggatgccttctacacgttggtgcgtgagatccggcagcacaagctgcggaagctgaaccctcctgatgagagtggccccggctgcatgagctgcaagtgtgtgctctcctgacgcagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttga

SEQ ID NO: 95155 - DNA, 262 bp, Homo sapiens
gattatcaacagaaactttatttctcatcggttcaggaacaatcgaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttga

SEQ ID NO: 95156 - DNA, 1484 bp, Homo sapiens
cggccgcggccacggcacgcccgggcacccccgattcagcatcacaggtcgcggaccaggccgggggcctcagccccagtgccttttccctctccgggtctcccgcgccgcttctcggccccttcctgtcgctcagtccctgcttcccaggagctcctctgtcttctccagctttctgtggctgaaagatgcccccggttccccgccgggggtgcggggcgctgcccgggtctgccctcccctcggcggcgcctagtacgcagtaggcgctcagcaaatacttgtcggaggcaccagcgccgcggggcctgcaggctggcactagcctgcccgggcacgccgtggcgcgctccgccgtggccagacctgttctggaggacggtaacctcagccctcgggcgcctccctttagcctttctgccgacccagcagcttctaatttgggtgcgtggttgagagcgctcagctgtcagccctgcctttgagggctgggtcccttttcccatcactgggtcattaagagcaagtgggggcgaggcgacagccctcccgcacgctgggttgcagctgcacaggtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagggagtggaggatgccttctacacgttggtgcgtgagatccggcagcacaagctgcggaagctgaaccctcctgatgagagtggccccggctgcatgagctgcaagtgtgtgctctcctgacgcagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttga

SEQ ID NO: 95157 - DNA, 1044 bp, Homo sapiens
tgccctgcgcccgcaacccgagccgcacccgccgcggacggagcccatgcgcggggcgaaccgcgcgcccccgcccccgccccgccccggcctcggccccggccctggccccgggggcagtcgcgcctgtgaacggtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagggagtggaggatgccttctacacgttggtgcgtgagatccggcagcacaagctgcggaagctgaaccctcctgatgagagtggccccggctgcatgagctgcaagtgtgtgctctcctgacgcagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttga

SEQ ID NO: 95158 - DNA, 1662 bp, Homo sapiens
cggccgcggccacggcacgcccgggcacccccgattcagcatcacaggtcgcggaccaggccgggggcctcagccccagtgccttttccctctccgggtctcccgcgccgcttctcggccccttcctgtcgctcagtccctgcttcccaggagctcctctgtcttctccagctttctgtggctgaaagatgcccccggttccccgccgggggtgcggggcgctgcccgggtctgccctcccctcggcggcgcctagtacgcagtaggcgctcagcaaatacttgtcggaggcaccagcgccgcggggcctgcaggctggcactagcctgcccgggcacgccgtggcgcgctccgccgtggccagacctgttctggaggacggtaacctcagccctcgggcgcctccctttagcctttctgccgacccagcagcttctaatttgggtgcgtggttgagagcgctcagctgtcagccctgcctttgagggctgggtcccttttcccatcactgggtcattaagagcaagtgggggcgaggcgacagccctcccgcacgctgggttgcagctgcacaggtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagggagtggaggatgccttctacacgttggtgcgtgagatccggcagcacaagctgcggaagctgaaccctcctgatgagagtggccccggctgcatgagctgcaagtgtgtgctctcctgacgcagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttgaaaaaaaccaaccacacccaacacaaacaacacacccgccgccccaagcacaccaggaccccaaacaaagcacacaaggagaaaggcacaaacagaacaagaaacacaaaatagcaacacagcggaacaacacacgaccccctaaggagacccacaaccgaaagacggaaaccccaaac

SEQ ID NO: 95159 - DNA, 1592 bp, Homo sapiens
cggccgcggccacggcacgcccgggcacccccgattcagcatcacaggtcgcggaccaggccgggggcctcagccccagtgccttttccctctccgggtctcccgcgccgcttctcggccccttcctgtcgctcagtccctgcttcccaggagctcctctgtcttctccagctttctgtggctgaaagatgcccccggttccccgccgggggtgcggggcgctgcccgggtctgccctcccctcggcggcgcctagtacgcagtaggcgctcagcaaatacttgtcggaggcaccagcgccgcggggcctgcaggctggcactagcctgcccgggcacgccgtggcgcgctccgccgtggccagacctgttctggaggacggtaacctcagccctcgggcgcctccctttagcctttctgccgacccagcagcttctaatttgggtgcgtggttgagagcgctcagctgtcagccctgcctttgagggctgggtcccttttcccatcactgggtcattaagagcaagtgggggcgaggcgacagccctcccgcacgctgggttgcagctgcacaggtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagggagtggaggatgccttctacacgttggtgcgtgagatccggcagcacaagctgcggaagctgaaccctcctgatgagagtggccccggctgcatgagctgcaagtgtgtgctctcctgacgcaggtgagggggactcccagggcggccgccacgcccaccggatgaccccggctccccgcccctgccggtctcctggcctgcggtcagcagcctcccttgtgccccgcccagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttga

SEQ ID NO: 95160 - DNA, 1611 bp, Homo sapiens
cggccgcggccacggcacgcccgggcacccccgattcagcatcacaggtcgcggaccaggccgggggcctcagccccagtgccttttccctctccgggtctcccgcgccgcttctcggccccttcctgtcgctcagtccctgcttcccaggagctcctctgtcttctccagctttctgtggctgaaagatgcccccggttccccgccgggggtgcggggcgctgcccgggtctgccctcccctcggcggcgcctagtacgcagtaggcgctcagcaaatacttgtcggaggcaccagcgccgcggggcctgcaggctggcactagcctgcccgggcacgccgtggcgcgctccgccgtggccagacctgttctggaggacggtaacctcagccctcgggcgcctccctttagcctttctgccgacccagcagcttctaatttgggtgcgtggttgagagcgctcagctgtcagccctgcctttgagggctgggtcccttttcccatcactgggtcattaagagcaagtgggggcgaggcgacagccctcccgcacgctgggttgcagctgcacaggtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagcctggggaagtggctggtggagtcgggagcttcgggccaggcaaggcttgatcccacagcagggagcccctcacccaggcaggcggccacaggccggtccctcctgatcccatccctcctttcccagggagtggaggatgccttctacacgttggtgcgtgagatccggcagcacaagctgcggaagctgaaccctcctgatgagagtggccccggctgcatgagctgcaagtgtgtgctctcctgacgcagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttga

SEQ ID NO: 95161 - DNA, 273 bp, Homo sapiens
gcttatgaacaacagaaatttatttcttatagttctaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttgaaaaaaaaaaagtcgtatcga

SEQ ID NO: 95162 - DNA, 431 bp, Homo sapiens
agagctgggtgcagggtggtcaaaccctggccagacctggagttcaggagggccccgggccaccctgacctttgaggggctgctgtagcatgatgcgggtggccctgggcacttcgagatggccagagtccagcttcccgtgtgtgtggtgggcctggggaagtggctggtggagtcgggagcttcgggccaggcaaggcttgatcccacagcagggagcccctcacccaggcaggcggccacaggccggtccctcctgatcccatccctcctttcccagggagtggaggatgccttctacacgttggtgcgtgagatccggcagcacaagctgcggaagctgaaccctcctgatgagagtggccccggctgcatgagctgcaagtgtgtgctctcctgacgcaggtgagggggactcccagggcggccgc

SEQ ID NO: 95163 - DNA, 948 bp, Homo sapiens
cggccgcggccacggcacgcccgggcacccccgattcagcatcacaggtcgcggaccaggccgggggcctcagccccagtgccttttccctctccgggtctcccgcgccgcttctcggccccttcctgtcgctcagtccctgcttcccaggagctcctctgtcttctccagctttctgtggctgaaagatgcccccggttccccgccgggggtgcggggcgctgcccgggtctgccctcccctcggcggcgcctagtacgcagtaggcgctcagcaaatacttgtcggaggcaccagcgccgcggggcctgcaggctggcactagcctgcccgggcacgccgtggcgcgctccgccgtggccagacctgttctggaggacggtaacctcagccctcgggcgcctccctttagcctttctgccgacccagcagcttctaatttgggtgcgtggttgagagcgctcagctgtcagccctgcctttgagggctgggtcccttttcccatcactgggacccatgtgacccagcggcccctcgcgctggagtggaggatgccttctacacgttggtgcgtgagatccggcagcacaagctgcggaagctgaaccctcctgatgagagtggccccggctgcatgagctgcaagtgtgtgctctcctgacgcagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttga

SEQ ID NO: 95164 - DNA, 1703 bp, Homo sapiens
cggccgcggccacggcacgcccgggcacccccgattcagcatcacaggtcgcggaccaggccgggggcctcagccccagtgccttttccctctccgggtctcccgcgccgcttctcggccccttcctgtcgctcagtccctgcttcccaggagctcctctgtcttctccagctttctgtggctgaaagatgcccccggttccccgccgggggtgcggggcgctgcccgggtctgccctcccctcggcggcgcctagtacgcagtaggcgctcagcaaatacttgtcggaggcaccagcgccgcggggcctgcaggctggcactagcctgcccgggcacgccgtggcgcgctccgccgtggccagacctgttctggaggacggtaacctcagccctcgggcgcctccctttagcctttctgccgacccagcagcttctaatttgggtgcgtggttgagagcgctcagctgtcagccctgcctttgagggctgggtcccttttcccatcactgggtcattaagagcaagtgggggcgaggcgacagccctcccgcacgctgggttgcagctgcacaggtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagggagtggaggatgccttctacacgttggtgcgtgagatccggcagcacaagctgcggaagctgaaccctcctgatgagagtggccccggctgcatgagctgcaagtgtgtgctctcctgacgcagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttgaaaaaaaaaaaaaaaaaaaacaacaagcaaaaaaacaaacaaaagaaacacaaaaaaaacaaaacacagacggggaaaaaaaggggggaacagaaaaaaggaggaaaagacggcgcagagacgagtaagagaggagaaggacaagaaaagtagaaaggaggggagagagggggaccaaagagaggagcagatgacgcaagcacagggggacgacgtaaag

SEQ ID NO: 95165 - DNA, 1504 bp, Homo sapiens
cggccgcggccacggcacgcccgggcacccccgattcagcatcacaggtcgcggaccaggccgggggcctcagccccagtgccttttccctctccgggtctcccgcgccgcttctcggccccttcctgtcgctcagtccctgcttcccaggagctcctctgtcttctccagctttctgtggctgaaagatgcccccggttccccgccgggggtgcggggcgctgcccgggtctgccctcccctcggcggcgcctagtacgcagtaggcgctcagcaaatacttgtcggaggcaccagcgccgcggggcctgcaggctggcactagcctgcccgggcacgccgtggcgcgctccgccgtggccagacctgttctggaggacggtaacctcagccctcgggcgcctccctttagcctttctgccgacccagcagcttctaatttgggtgcgtggttgagagcgctcagctgtcagccctgcctttgagggctgggtcccttttcccatcactgggtcattaagagcaagtgggggcgaggcgacagccctcccgcacgctgggttgcagctgcacaggtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagggagtggaggatgccttctacacgttggtgcgtgagatccggcagcacaagctgcggaagctgaaccctcctgatgagagtggccccggctgcatgagctgcaagtgtgtgctctcctgacgcagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttgaaaaaaaaaaagtcgtatcga

SEQ ID NO: 95166 - DNA, 1370 bp, Homo sapiens
cggccgcggccacggcacgcccgggcacccccgattcagcatcacaggtcgcggaccaggccgggggcctcagccccagtgccttttccctctccgggtctcccgcgccgcttctcggccccttcctgtcgctcagtccctgcttcccaggagctcctctgtcttctccagctttctgtggctgaaagatgcccccggttccccgccgggggtgcggggcgctgcccgggtctgccctcccctcggcggcgcctagtacgcagtaggcgctcagcaaatacttgtcggaggcaccagcgccgcggggcctgcaggctggcactagcctgcccgggcacgccgtggcgcgctccgccgtggccagacctgttctggaggacggtaacctcagccctcgggcgcctccctttagcctttctgccgacccagcagcttctaatttgggtgcgtggttgagagcgctcagctgtcagccctgcctttgagggctgggtcccttttcccatcactgggtcattaagagcaagtgggggcgaggcgacagccctcccgcacgctgggttgcagctgcacaggtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagggagtggaggatgccttctacacgttggtgcgtgagatccggcagcacaagctgcggaagctgaaccctcctgatgagagtggccccggctgcatgagctgcaagtgtgtgctctcctgacgcagcacaagctcaggacatggagtgatcttccgtgcccagccaacagctggtgggaggaggggcagatgttagagcaggttgagtgaaggaaggatcccatcagagcataacccagatttcacaattatctccaccctggaaggggggcagggacatcaccaaaggcacg

SEQ ID NO: 95167 - DNA, 870 bp, Homo sapiens
agcgggaggacaaactgcctggcaaaccagcagggccaggcaaatgaggccaattggcagcaagggctgggatggagatgtcagagatttagaggctctcagggttggaagggggacctcaaatttcatctaggtcaatgctgtgtccccttacctgagtcctgtctataatatccctcccaatagtgggctaacctcagcttgaatgctcccgatgatggagcactcattacctcctgggaccacgaactcatcaatgggtggtgctgactgtgcaaaaaccctccttcattttgagcctaaatctgttttccaacatgaagagagaagacccccgcagtgggttcatccttcttctggctccagccctcagtgctgcgaaggagccgcaagtcactcttcatgaggaaacatgcccggtgtcttgggtgggggcagaggcaccactgatccacaaagatgtggtgtgattttttcctctcaggggactttgcttgggggaggggccactgggaagagccaagaagctgctagaaaaaaactgaagtcgttcctccttctcaagtgcgaagtgaacctgcagcagaacattagaaaccctgatgcaggctagctccgtctgtggggactgttacatgctggttctctgttgccagctccagggagtcagggtctaataggagccaccccaggtattccacttatagttatagctccaagcaggggtcatcagcagggtgactggaactccctgcggttccagagagccacagatgctcacccatgctggctttggtaggcagggagctcagtaagcctctccgaggctcaggattttgccagtttggaagagcactggatgatttggaa

SEQ ID NO: 95168 - DNA, 673 bp, Homo sapiens
agcggaaaaaaaaaaaaaatctacaagtgcatccttgacctctagctctaagtttacacgtctgtgggcaaagtcccacttgaatgtcctaacatctcaaattctaacaaccttgactttatctctcaagtatgattctgggttaggattagccacaagggaaatctgtgaagataggaaaggcagaagtgaagcagcagccattacagtctgaaggtcagtctaggacactaggcacatctcacgcacattggctgctcatctgctggctcaccctggtgcgaggagtagctaagtctagagctcttgcagttcctactgaatattctggtttctgcaagtctgggtgagacgcaggtgcagcgcatggctcctataagcacctgcaccaggctactgcaggcacctgcctcattgaggtgtaagtgataagagacagatgctcagtctagtttatccccatgggatccagattctcttggggggctccagttgtgttcctgcccatgttcactctagcttttctggcctaatgggtaagcagtactggatttacagaaatttcaagaccaataccagacacagagatgttagactccttcatagaccttttcccatgctcacaatttcatgagacttaacccctaaaaaaaaaaaaaaatctcttattcca

SEQ ID NO: 95169 - DNA, 387 bp, Homo sapiens
cttatcttgctgagaaaatgagaccggattttcttgttttgtttgtgttctccatctctaggactatgaatccttaaaaaaaaaacctcttttgcccttgagagctaatgtttctgtttaacatgagctgctttagctatttcttattgttccgaatgtacaattttaacacctttttatttaaaaatgctgcctaaaaatcctattaattacaattatttatttaagagttcatcttactgttaaaaagataaataaatgctgatagaaaaaatagcagaagatgggtgtttgcatcctaagactgagtaggctatacaaatgttaaaattcaattatgtattgactatcattttctttttaagatttggcattacagctcttatg

SEQ ID NO: 95170 - DNA, 459 bp, Homo sapiens
atctgccctgtaaattctggatggtaaatatgacaaaaactctctccttgacccagctctagtgagactgctctaagccctcttctcaacatggctcaaccttgggcttcagtgtacattttgttgggcctgcattgctcagttttagcaagagtccagttaagtgaaagagaatctcacagctttgatatcagattcttccatatctaaacaaattcctcatcccctaccttcaatatctgatcactctgccctgtttgcaccaagaatctaccctcacccttgatgtctcctcttaataattttccatccaccaatctctccccactcttcaaacctgctccttggctataagtccctaccccttcttgtcttatttgcaatagagctcagttctacactggggtctctttttcctgattgcaatagttcctgaataaaatctgtttttaccacttt

SEQ ID NO: 95171 - DNA, 372 bp, Homo sapiens
aaaaataattggcttgaactcaccagatggtataaaagcccaatttaaccatcttttgagtggaattaaagttctgttcttttcaatggacttggtaaaaactgctaatcaaccagccttccagtcaaggtatatagtcacacataataatttgacaaaatacaccattaggaaagtgattttgcagaaagaagctgtattgcttctcagtgctccatactttgatgtttagtattgaacaacatctccagataatctggacccatggacagatcacacacttcttgccattactgaatttgcagaaatagtactgaagtattctgctacatttttatatttgcattttttttgaaactttttttcattttt

SEQ ID NO: 95172 - DNA, 402 bp, Homo sapiens
actaatgtgtactaaacacttagaacagcgcctggtgtagtaagagtggatctgaagtggcaaacagaaaatattcagcatggaagtaagtcacagagacaagattggctgagataaacagaatggaagaggggaaggagtttaaaaagatgccaagaattcttgaccagaatttacaagaatgtgcaaataacccttactgattgccttctcagtgttcaactctgttctaggtgctagaaatacaatgttgaactaggtcacaatagttagaaaaattgtatttttatggtggatatggcagaaagagataagagaaaagaatggaaggcaagacatatcaggaggtggtaaacgcaatgaaaggacagaagtatgagcagatgactgtatcagacagtg

SEQ ID NO: 95173 - DNA, 361 bp, Homo sapiens
tatttgtggaaggaacgatgactgccttgccttctgtgtcctgtttattagaattcaaacatttgcgccatttaatcaagtctttttcacttaccaatggcgtgtatatcccagcctgcttgaagctcctctgagcagcataataaaggttggctgcgtgcttcctctgtctgcaggtgcactgggcgggatgaggctgacctgccctggcctcagggggctcacagccgggtgcatcaagttctcacacttcgtggtctcagggaccccttcatgctcttcaaaattatgaggaccctaaagagcttttcttttatgtaggctatatatttattaatattgaccgtattagaaatttaaa

SEQ ID NO: 95174 - DNA, 473 bp, Homo sapiens
taaatagtcactttggccaactccacattttacagactgggaaacaaactagagaggttaagtgacttgccttaaatccacagccaattagtgacaatactgagactagaacacaggctaaaggtactttttaaagagagtgtttatcacttattaaaacagttgcttttgacaataatagtgataggataattcatcattaattcaacacttattgactttgttatacacaaaatatggtttaagcattggcagtgaggtaaatacgaagacaacatcttttgtggaaaggatcttaaatggagagattttaaaataaagaaaatgtggtatattcgtagatatagatatagtgacaaggatgacagacatgacttgtaagaggcgttgataggaagaaaggctgatggcagcagatgcaggactagtcccatctttgggtgctagggttgccatttcgttaacggttccta

SEQ ID NO: 95175 - DNA, 315 bp, Homo sapiens
tttatgtaatattctaaattctctgtcatcatttcaacaatattcacagcatcttcacccgagatagattctttcaaccaaaaaatatctccaaatatgttaaattttttcgggagttagaaaagagaattataaactgagatgcacaagggcaagccacatatgcaactgaagaggggagggtaaagggaagcttttatgggcagaatgagaggttcacataaggtgcttgaaaacagagctcatgggtttcagggactcagagatggcataggttcatgggtgaaaatgccgttacgggtcagggatgcggtt

SEQ ID NO: 95176 - DNA, 331 bp, Homo sapiens
ccccgagaaagtcccttcccctctcaacctgagtggaccaggtgatctgcaaggcccccagagctgagaccctacagctcagatcaccaaagccaacagcctctgggatcccagggccacgtcgggtaccacacgggcacggctctcgcagcaaccccgtgtggtaggcactgtcatcaccaccatttcgcagatgaggaaacagcccagaaaggcaaagcgactcacccagtcacacagctggcaggtgaggagctgacccagagtccacccatcccttataccacgctgggatacctcatgaccaagtggaccctgccacacggccctg

SEQ ID NO: 95177 - DNA, 273 bp, Homo sapiens
attgcactccagcctgggcgacaagagcaaaaaactccatctcaaaaaaagaaaaacaatccaaattggcggggaagaagtaaagctgtcttgatgtcttcccttattagagagaaatatttggtagtttgcagtctgttctacctcaggagagactgcagtaaaactgatgtgaacatctcagaattcaactgttttgtaaataccaccaccccttccactttccttcagcatcccagttaccactggaatattttatagcatatttatttt

SEQ ID NO: 95178 - DNA, 1297 bp, Homo sapiens
aggccggggaggggccctgatccaaggcatcactgaatactaatttatttagcaggctagactgaggctttggagaggaaagaagtcctcagtaagcttcagtggagactcttagggcttgattattgtgtcaggaatcaaattaatctcctaagcatcccttatggccttggccttgcaaagccagcctctgccatgctcgggggaagggatgcagcaggcttcctgggcagaaggatccagctcttggcctcctttctctgctcctccctctactgcagggacctgcccctcctccatttcctccacctggaaattaatgagcttaggtcttgccccatccgctgcagcttggtggttaatacagagctggaaatgggatgagactgtggcagcgcagtacgaggggggtctctaggaccagctgctgctcagggtctagtgatgggaggaaggcctgatttgggaagcaggttcttcaggatgaaaagcttaaccctttccattccctgacagcctctttcaaaacagtctttcctcagacccccagttgcacacattctgtttttccttctgttcacatttttaaaggaacacatgtctcccttgggtccatgtaggttattgtgcctctcccttcctctgcagctcctggatctctgcctgaaactgcaataacagctacagggagggcgtgaggtgctccttagagccatgaccacgctttcaactccgatagagcttgtgagaccgctgggagctggctccttcttgtccacatagcccaacgacttccttaagcttgtcaggtgctctcagctctacagcaaagtgtgacaaacagctccccctctcccttcctaccgcctgccctcctccccaaacctcaagcagaacacagtatatccgcagtccaggccctgaggcagtctgccagtctctggatgccaaattattatttttttaagggcaaaccaaaaaactcagctcagaacaaaaacacagtcacggaggaaggtgttgacccacatacaatgagtcctgagcccagagaaaaatctgcacacacaagcactccgcaatgcgctcccaggcgaccccctccccacgcacaccgcatctgtgctgcacagatctgcttctgtcacagaatcagcttctgtttctctccctgagtctctttgcatctctaagcccctgtctgtcacaggctgcacacctccccaccccacgggctccggtgcgggacaggcagccggagggagctccagacccctcccctcgcgcccgcggccgc

SEQ ID NO: 95179 - DNA, 677 bp, Homo sapiens
aggccggggaggggccctgatccaaggcatcactgaatactaatttatttagcaggctagactgaggctttggagaggaaagaagtcctcagtaagcttcagtggagactcttagggcttgattattgtgtcaggaatcaaattaatctcctaagcatcccttatggccttggccttgcaaagccagcctctgccatgctcgggggaagggatgcagcaggcttcctgggcagaaggatccagctcttggcctcctttctctgctcctccctctactgcagggacctgcccctcctccatttcctccacctggaaattaatgagcttaggtcttgccccatccgctgcagcttggtggttaatacagagctggaaatgggatgagactgtggcagcgcagtacgaggggggtctctaggaccagctgctgctcagggtctagtgatgggaggaaggcctgatttgggaagcaggttcttcaggatgaaaagcttaaccctttccattccctgacagcctctttcaaaacagtctttcctcagacccccagttgcacacattctgtttttccttctgttcacatttttaaaggaacacatgtctcccttgggtccatgtaggttattgtgcctctcccttcctctgcagctcctggagaaggtccaggtatgccgggg

SEQ ID NO: 95180 - DNA, 413 bp, Homo sapiens
attacaggcatgtgccaccacaccaggctaattttgtatttttagtagagacggggtttcaccatgttggtcaggctggtttcaaactcccgaactcaggtgatccacccgcctcgtcctcccaaagtgctgggattataggcatgaaccactgcgtctggcccatatttgggatttttaaacaggtaggtgatgggatcagacttgtagtcactttgtttggctacagtgtgaagaaggagttgaaggagagactgagaatagggagaccagacaggagggctgttgtaattgtctaaacgtacattgatgagaacctaaattggaaacagatgtgagatctgttaggtcctggtggggatagcacatagcacattatttttgacaatttgcttgtctgtcattggactata

SEQ ID NO: 95181 - DNA, 889 bp, Homo sapiens
  misc_feature (837)..(837): n is a, c, g, or t
taggattccccccccaaccagaaaccaaacttaaaaactaggaacttccagtccagtctgtatccctagatgtaagattcttacctggataaattgataatgctgcgaaacaaagtgacctagaaatccagctaatcttatcagtgctcgtttttaattgagaaaatctaattactcagataattgtggagcgtgttgcatactcttaattactgtaaaaacaaaaaaaaaaagacaaatttatgctgctatataggcctcacgccctataaaactggatatacttttttatgacccatttagcttcattcattttatcagtgcatagaatgcagtatgttttccttatttcatactattttgttttactttttgtaaccataaaacatcagctttcatgcacaagcatatttttggttggatgagtttgtttaattaattaagcatttgagaacatcagtggtttagttttgaggtgtcacaaatagaaaaacttagggaaaatttctcattgtattggaaacaatttattctgcattaataagttgatataatttggctctgtgtcccctacccaagtctcatctcaaattgtaatccccacgtgtagagggagggtcctggtgggaggtgattggatcagggaggcggttgtccccatgctcttcttgtgatagtgtgtgaatgctcatgtgatctgatggtttaaaagtatttgacagccttccccctgttattttatttaaataaaggtaatcaggaaggcctttcttcagagaagtttggtttctttgctgcaagaggaatgaggctctgtaaccttatctaagaacttgngaagccgtcagccaagtcgccacatttctcttgcaaaatgtcaatagcttat

SEQ ID NO: 95182 - DNA, 450 bp, Homo sapiens
ctaacttagcactaatcacactgcatcagatgacacaatatatatgaaagatctgggtcagtagtctcatttcataaataacaaagcatgtataattgttcttatttttgagatgctgaggtgttataatcatgtacacccccaaagacatgtataagtatgtcgattgaaggtttttgttttaaatggactaatttacctctgaattgactatcttctgattctgaaaattgaattcatctcataggtaatgtagatgttgcccagacttctaaaatgtggctattttgtatagtccacatctgattcatacattaaaaaaaaaaaattcatgacctactttgctttcagaaattcttcctctgacatgccagaaacaccccaccccagggcctgtgccctcactgtcccctcagcctggcagcctggaactctcttggcccagatggt

SEQ ID NO: 95183 - DNA, 420 bp, Homo sapiens
gttgtgggtgcctgtaatcccaggtactcaggaggctgaggcatgagaattgcttgaacccgggaagtggaggttgcagtgagccgagaacgcaccactgcacttcagcctgggcaacagagcgagattttgtctcaaaataaataagtaaataaataaataaataaataaataagtgaaatgaaaggatttagaaaattagaaatactctatggaaatagtaatgggtggtggtgaaagactggttctcattaaatacctcttctatgaaagaggtgttttcatgaaacatggttttcagtttttgaagataattttggttgcatccaagggcaagttatagtttgtgggcctaatagtagtatgatggaaatttaaggactctggctcatgtccttgaacatttatcattgataaagg

SEQ ID NO: 95184 - DNA, 380 bp, Homo sapiens
acagccggccggccaatggccactgccgtgctaagtgggagaagaagggtctggaagcttcaggagaaaacgaaaccttccatctaagtaaggacccacaagaggagttgagctggtgagggaaggagactgaggaagattgagtaatctagattctactgttttctatgctttatttatagtttaatttgtaattattttgaggagtgaatacaggcttatggtatcaaattcaaaaggtacgaaggatccagagtgagacagctgttttcttctcaccctgctgtgaagccacccaggtgcactctgttcccctctgaggcccctccttgccattcctgccacctgaccatgggacttaccacagtctccccagatgc

SEQ ID NO: 95185 - DNA, 219 bp, Homo sapiens
tagctcctagactctgctaagatctggtacagtgcatggtatatggtagctgatcaatatctgttgaatgacataaagtgtgcttctccaaacactgtttcccccaggaaagggggccagagtgaagcagatttaggagctgtgtatgttcattatgcacatttatttgaccatctctcccacaaccctctccctccctccctcctttctctctccact

SEQ ID NO: 95186 - DNA, 705 bp, Homo sapiens
  misc_feature (64)..(64): n is a, c, g, or t
ccctctaatgagatagatttttattgacacaggacaaacgaaaacaacgaaacgaggtgagtgnagtactcgctaccttatgaatgaaaaagcacagtgcagttcattcatacaacggaagactatttaccaccgcgtccggccaaacgttctgatgaaaacgctaagtccaccaaagctaaggacaggagttacagcttccatgaattttaaaacaagacccacagatttgaggaagcaattcctctcttgaaggtgaaaagtcagaaaacagaatgatgaaatcaataggatccaaccggcctgtggaactattctctgcttatgaactatcaactttaatttcatttccagatggcatggtctcagcagttatacggtgtttacagatgttctaaatcaagggaatttgtatcagtctattcgaataaaataaaatatttgagttcttaatttcctttaattaggataacctttttcttaaagtgaagagaatggtttgattacatagtttccgtcggtaaagataggctgtattttctagcaatgacgaatttgttatataggatgatctcgttcttggaacattcttgaatctagtgtctctgaggcaggtgtgtacaacaagaagtgaatcacacagaaatcaatgatgaaagcattagaagacaattgagattgtcagaagtgcaaactattgctgag

SEQ ID NO: 95187 - DNA, 520 bp, Homo sapiens
caaaacaaaacaaaacaaaacaaaaaaagaaagaaagaaaagaaaagaacacagagacagggccaggagtggtggcttatgcttgtaatcctagaactttgagaggtcaaagtgagaggatcacttgagacaaagagatcaaggctgcagtgagatatgattgtgccactgcactccagcctgtgtaacagaaaaagaccctgtctcgaaacaaacaaacaaacaaacaaacaaacaaaaaaaaacagagacaaagacagagacacatagagataataccacaggatgtcaacaattgtgagacatcaccagaagctagaagaaaggcatgaaccaaattctccattagagccctcagaaggaacccaccctgcctacatcttgttttgggcttgtagcctccagaactttaaaagaacaaacatctgccttttacagccatctattttgtggtactttgttccagtagctatagctaactaacatactaatagaggaaaaaatactggattattctaag

SEQ ID NO: 95188 - DNA, 201 bp, Homo sapiens
ttacaggataacttcctgctatgagtcagctaaacattcctgaatccaaccattctacccctggcaaactccagtatctgatgctctatcacatgtgcaaacaaagtcactcacatgggtttcaacaagtacactgcttagtgaaatatgggtctttaaaaacatactggaatttgaaaaaataaaccacacactgatggt

SEQ ID NO: 95189 - DNA, 176 bp, Homo sapiens
actaccagaacaaaataccacagactgcgtggctcatacaacagaagttactttttcacagttctggagtctgggaagtccaaggtcaaagtgccagcagcttcagttcctggtaaggactctcttcgtgagaagacggctgccttctcactgtgtgctcatggggactgcccttg

SEQ ID NO: 95190 - DNA, 687 bp, Homo sapiens
cgcgaacggcgagatacgattgacgacttgcatggcacacaaaatctgcggtcgttccagacaactagaccagtgcgatgggcggagccaacgaggaggcacaatttacatccttggccgtccctactcggatttgctgaaggagtcacgtcggtcgttaaggttaagctttgtagagaacagcggcgtttgtttaacgtccggggatgctgaactcgaaatccccgttctgagccggctacctaaacaaccttcccgaccacctctcctgacctcggtgcttgggaccagggaaaagcagatcttgccacagacttgtcttggcccacactctgccctatcgtcatggcctgctcccacaggtcataacttccgttcaaatcagtacccccacatttcccactgcaagggtaaatttgaaagtttctcaggtgactccttggatgtagcagtactgagtcctctaaccggaaagaaggaactgatgtccaccctcactttccaggggcctccaggagcccctagacacttctgtggtctactgtagctaccaaaaatgtagctggttataacatggggagagccagagtcggaggacctgacttccaattctgacttggatactaatatcacatcattgtacccatttcaaactccccctctgtaaaatggaaaattggactagat

SEQ ID NO: 95191 - DNA, 193 bp, Homo sapiens
cacagacatacacacacatatatacaaccagtgagatggcttttggcttcaagaaattgatgacttagctctggaactctccgctttcaaagaacactgagattagctagatgcccagttgccaactccagcaggaatcgtaactccaagtgaagtgactacaccagagaaagaaactcttcattgaactccc

SEQ ID NO: 95192 - DNA, 328 bp, Homo sapiens
cttgaacctaggaggtggaggttgcagtgagctgagatcgtgccattgcactccaggctgggtgacaagagtgaaactccgtcaaaagaaagaaagaaagaaaaaagttgaactagatttggtctgatgcagttacagatttacaaactgtgcccccaccctcctgcagacaccttccactcctcattcttgagggattagggatggaggtcatgcttctgtatcgacttcatgctgaccagggtcactgagtcccctaaagtgagaggaatgaaactcttgggcttctgagttcaaatgagttctggggtcacctggagtagcttga

SEQ ID NO: 95193 - DNA, 302 bp, Homo sapiens
agcgcgtcctccgccagccctcgcgtctgctgcccccgccatccagttggtgcggtccatggcgagcgcatcatggcgattgaaggtggagagagaacctgtggagtacatgaacttatctgtattagaaaagtatctccagaggcagttggatttttgtcagctgttggggtgtttattatcttgatgctgctcctttttctctatattaataagaagttctgttttgaaaatgttggcgggtttccagatcttggttcagaatacagtacaaggaagaattcacaagataaaatttgtaa

SEQ ID NO: 95194 - DNA, 384 bp, Homo sapiens
acggggtttaaccatgttagccaggatggtcttgatctcttgaccttgtgatccgcccgcctcggcctcccaaagtgctgggattacaggcatgagtcatcgcgcccagcccagaatggctaatttctgaatgttatttggcattgtacttgatcataaataaatgtgaattggaaaaaaaaaaaaaaaccagcagcatcatctccctccctctcttgcatagcacagacccaatctatcagccaattctgcttgctctacctttaagatatatccagaactggaccacatcttgctgtcccctaggcccaaaccatcagcatctctcacctggatttctgcaactgcctccacttcaggaattcctgatactgcccctgctcc

SEQ ID NO: 95195 - DNA, 503 bp, Homo sapiens
aattgggctattaaatatgtgatatgaattaatcaagcagagaaaaagttactagtgacagggaaaaggagaaaatatgtattcaatattatgttgtaaacaatttataaatatgcttcacctatgagtttcttctcagtaccttagaaactataacaccatggaaaattttggatagtttagggaagtgcatcatttggtaatgtgaaaaataagatggtcgtgataaaggaacttgggaaaaaagaaatggcatgaattttgagaacacgtactttctgagaattttcatgtttagaaaagagcaagctaaaaatctggaagcgtgtttgttcacaggcaattttcaattggtctcatgcatttctgtgcatcttgcaaatagaaaggcactagtttcacatttattacaggttttcctttttaaagatctttatatagtggatagccctggaagatcaagatattgtttatttatggatgagagaacagatttgtttatt

SEQ ID NO: 95196 - DNA, 352 bp, Homo sapiens
gaatgttctttgacaagagtaaagttttggggagctggcaggctctgcttggtgagtgatggcagtgggtaaaactagtcttagagtcatgtcagggtgttttagtagccatgagatataggttataggcagtttccgcagccaggcttgcagacaattacatttttggagcaatgttttgtgccctgagtgcattcccctaggcctcttgagtctgtttaagtcagatgtgacaagaatgatccaatttttatgatcaactcccacagcctcaatacatactggctgaataataatgatgaatgagaagaaaggatgagtgaagccaagtgctcaggagaggagcttagag

SEQ ID NO: 95197 - DNA, 442 bp, Homo sapiens
tgggattacaggtgtctgccaccatgcccgcctaattttttgtatttttagggtttcaccatgttggctaggctggtctcaaactcctgacctcaagtgatccacctggcttggcctcccaaagtgctggaattacaagcgtgagccacagcgcctggcctgttttaactttttgaggaaatgctaaactgttttttccacagtgcttgcaccattttaaattcccaccaacaacaatgttgtgcaaccaccccctctatctagttccaaaacactttcatcgcccccaaagaaaactctgtatccactaagcaggccctccttctctctccaccccactccatgcccagcccctgggatacaccaacctaattggtgtctatggatttatttgttctgactatttcctctaaatggaagcatacagtttgaccaacaatgt

SEQ ID NO: 95198 - DNA, 471 bp, Homo sapiens
tctttccttttcaaactatgacagatagtttcatactcagcagcattttaaaaggtagttctaatttggtgacaaatgccttataaacaagagtttctatttgaatttttaaaaaagatcctttttagcctgaagaggttccaaagtcttagatcatagaaaataaataggaaggaattcctcacaagtttagtttgttttatgcttttttccatggaagaagattcagtaaaatacaccaaaaaaaaaaaaaaagaatgctaaatttggagtggcagaaaataagaattttagttcctgtattcctatttggcacataacatctgagcctcagttaatttgcggaatgaaagtgtttggccagattttctaagtttattttcaacttcaaagttttctgatttttaagccaaattaaaatagggattagacttaactacctacttaaagactactttaagacactcttca

SEQ ID NO: 95199 - DNA, 751 bp, Homo sapiens
gtgcccgccaccacgcccaactaatttttgtatttttagtagggagggggtttcaccatgttgccctgcctggtctcgaactcgtgacctcatgatcctcccactttggcctcccaaagtgctttgggattacaggcgtgagccaccacgcccggacaatatctcagtttttttaaaaaaaaccattccctatttgcagtgtctcttataaacaaatgtaatggggcctattgggactcatttgtaggaatcaaatatcctttcatacagtgtagacttattcttggcaagaatgttttactgtctaaccaagaattttaattggtttatcttatttaaaattttaaaagtaagtaaataaaaataaaaagccattccttgcaactatgtatattatgctaaaagaaagtctctctcattcctgaagctgaactattgtctgactcacgtgggagggaaccttccacagtcgtgaatgggatttttcttgcctgtcatgaatagagttatccccccactcatctgtcaagaatcggcactaggccaggtgcggtggctcacacctgtaatcccagcaccttgggaggctgaggtgggaggatcacttgagcccaggagttcaagaccagcctgggcaatatagcaagaccccatctctagaaaataaaataagaaataaaaataataataaaaagaatctgcactagctgcttcaaggaaggtctatgactaggatccaacaaaccagaag

SEQ ID NO: 95200 - DNA, 756 bp, Homo sapiens
atgatgagaagcatcatgaaaagttgcagtaccacgtaattcaaggctctgggctcagtttattcattcatttccaaggcatgctgtccaggctttccctgggcacaaaccttagaagaattctttgctccctctcccagatggctgacaatggtctgctcttttgaccctctcaatgacttattaaaatctgtggacatcatgtttctgcaaaacactctttatggtcagatttactgaatgtagagacacattttcatttgaaaaaaaagaaagtgagatttggtacttactaacagctgtggacaagaaacttgcttagtcctttggtgacacaaagattaaataaacacagacactaccccaaggactctataccatatatccatggagggccaacctatgcgaaggaggaaagctatgcttataaccccaagagtcatagaatgggtgaccctttcaaataatccatatgttaggtaaaagctttgtattccaggcactgccacttaccagctgagtaatcttgggcaagtaatttaacctgcaactctattttgttaatgttcatctgtaaaatgaaaataataataatatccacatgtgcagatttaatgaattaatttctgtaatataccaagaacagtacctgttaaatgtcaattgttcaataaaagttgctattatttaaataaatatataaatagcaaatacggctaacagtgtgagaatttggttgaaaatctacgatctatc

SEQ ID NO: 95201 - DNA, 729 bp, Homo sapiens
  misc_feature (1)..(1): n is a, c, g, or t
  misc_feature (4)..(4): n is a, c, g, or t
  misc_feature (6)..(6): n is a, c, g, or t
  misc_feature (11)..(13): n is a, c, g, or t
  misc_feature (16)..(16): n is a, c, g, or t
nagnantcggnnnganactgaaaaagggaagctgactaagtaaaatcccggaaaccagaagaggaggatgtaagtgacgctctaacatgaagggtttttgggcatcccaatcagcagaatttctacctgccttctgataccctgagacagccaggtcaggatgtgatggtgcagtacctgctagcactttgctgcagaatgcctctgcactcagttctgcaaatgtactgttttagtttcatttaaaacccctttttttgtgagaagatttcaaacatcaggcaagtttgtaatgaattcaagctgagttctctcgagggacaaacatgtataactacagttccagtgtcagtgccagctgtcaggttttcactgtgcagctagggctgcctgcatacccagtcatgtaaaccaaattcactctagaatcggccaggtcttaccaaaatgcaaatagaatacaaagcaactggaaatatatttcgtaatttcattttatgtgtgattttaaaagttaagctacttcaaaactcatctgtctaacttattttcactaataagtgtaacttgcctggaatttggcagatctaagctgggcttgggctagatggtttcaagcctgagtcattaagatgtgaaatttacagaaacaacagaggattgaggaacaagttaaaggacactctaatggtgcagtctgcataatgcagtagtatgaaattctacaaa

SEQ ID NO: 95202 - DNA, 849 bp, Homo sapiens
atccagcaaagacagccttgtccccaagagcctcctcaatcctcaaatgagttggttgtatttcgccagacgctccaaggggtagggggcgccagtcttgatctgtcctgtgcagagccccaccacaaggtcagcaatgaaaatgtcctcagtctccccagagtggtggctcaccatcaaccctcagccgttagagtgagccagtttgcatacctggatcgattcagtcaccgagccgatctggttgaccttcagcagcagacagctcgagaccttcttctcaaaggactgggcaatcctcttggggttggtgactgtcaggtcatcccccacaatctggatgtccacccctgagaggaacgaggtccaagtggcccagtcattctggtcaaaggggtcctcgatggagacgagtctaggtggcagctgggacagtgtcctatacctcatttttaatactacataggctacaagttctagaataatgccaaataacagtaatgatagcaagtttcttcatcacatgtctaattttttcatatacttgtctctagcaatttatcatcattgtgttattggctgttagatttttggggggggcggggggggggagatgggcagcttttctcaataaagcaattcaaaaaacaaggctctttccaatatgtggtaagccatgtggtgagccatgtggtgagccatggagttcttctgtatccaaccccaaaagagaacacagagaaaaagcacaccctattcttgagtaccttggctaggaagtgacacgtattacttctgctcacattctactgcaaaaatagtcacttggcactatctagacacaagaga

SEQ ID NO: 95203 - DNA, 163 bp, Homo sapiens
aaacctcgaatacatagaaaattcacatcatttttgagaaagttgtattggcaaaagctctgccagtttggacaaaaaaaagaccaggacaatttgaaatataaagacttctgtgccccaactttgttttcttttcttttcttttttttttttttttttttga

SEQ ID NO: 95204 - DNA, 352 bp, Homo sapiens
ggttcactgcagcctcagcctccccggggtttaagccatcctcccacatcagactcctaagtagctgggactacaagcatgtgtcagcacatctggctaatttttgtatctgttgtagagatggggtttcgccagattgcccagactggtctcgatctcctaagttcaagtgatctgcccaccttccaaagtgctgggattataggtgtgagccactgtgcccggcctttcttctttttaaatgtaggcatttttcactatgaacttcctgtttaatactgcttttgctgcatcccataagttttgacatgttgtgttttcatttttgtctcaaggtatttttaaatttcct

SEQ ID NO: 95205 - DNA, 328 bp, Homo sapiens
tgggatgcaggctcagtggaaggagaggagtctccttatgagactcagatggccagtgtgaaaaagacagaagataccaactgctggtaagaatgggaagcacactgcatggggaactctcctacactgctggaggcgtgttcttcctgttattctagattcagacagcactctggtcgctggttggtgcaggccaccatttgggccaattagaggaaccccaatatctgcacttggactatcagaaatgagagctctacgcccagagcaatttccaagatgggcctgaatccatgagtcatggcactacatggagcccagggttggc

SEQ ID NO: 95206 - DNA, 610 bp, Homo sapiens
gagtatttgtccatatttttgacagcaaaatatattagggaaacagagtaaaagaccttataattcataaaaatagattcatatatatatcaaaccttcctgaattttaatttttgataccaaatctgtttaaaatttgctattttgataattatgaaagggtgttaaaaatcacacctcaggcattcctagattccctgatgttggtgcccagttactttattcagaagtatcatatcgttttttgtagctcctctatcagtgaatacaatccaggggactagagtgctattgctggttagcccattcaggcaagttctattctcttagcacattcagataaaaaccacacagcaaaacaccaagctgtcccaggatgtgctttaggccattgttgaagttaaatgagaaaaggaatgtaaacattaacaaaatctgaaaggtgagtggaaattaggttttatagcataatttagtataaaaattttccaaatgttagagcaaattatgtgttttcctactccttcactaatgagatattttacatcaagaatatttattattttttgaaattgctgacttcccttggggtgaaaataagtattttttt

SEQ ID NO: 95207 - DNA, 409 bp, Homo sapiens
tggtttgttttggttttggtatgacgagttgttttgattgtattcctgagatttggttacttatgttaggggattcttagactacttaaatcttttgttacagcacatagttgccctattttggtttaatgtataggttctttcctgtgttatttatttatttatttatttatttatttatttgtttattttttgagacagagtcttgctctgtcgctcaggctggagggcagtggtgtgatcttagctcagtgcaaccgccgcctcctgggttcaagtgattctcatgcttcagcctcccgagtagctgggattacaggcatgtgccactacgcctggctaatttttgtatttttagtagagatggggtttcgccatgttggccaggctggtcttgaactcctggcct

SEQ ID NO: 95208 - DNA, 212 bp, Homo sapiens
ttgagtagggtggggtagggtggggcaggggtgggtaaagtgggagtggcctgaatcttccaacggctggatttcaaaaatgtcactgtattccagcacttcaataagacaaagatcaaaacgtcagcagctaagaggatgggcccgagcaaagactgcctggccccgctgggaaaatgaaagtggctcaccccaaggagggaaggacagtg

SEQ ID NO: 95209 - DNA, 120 bp, Homo sapiens
aagcctctaccctcatggaatttacactgttgctggggaaacagactataggcaaggaaacaggtaaataagcaatctactttcagataggaagaagtgcttatttactgcatcaaaaaa

SEQ ID NO: 95210 - DNA, 498 bp, Homo sapiens
gctgggattacaggtgtgagccactgtgcctggcttccatcctcttctatcatttttttaaatctcttctcctatcataaaattaatttctcattttttggtcaggtagaattgggaaagtcccacactgtcctcctattaccttaacatcccaagcttcctttccttttttggtctttatgaatatatttatatggacagaattaagataaacaaaattgattgccccattctctcacttccccatcttgtcttcctagaccccacagagttaaaacttgggattcccctggcccccccagaacacttgtatattgtttgtttgaggttcgtgccgcagtaacagacacagtatttaattgcacatacagatgtttgctgggtatattcactgtaaattttatttaatctgtttttttgtttgtttgggggttatttggggggaggttggttttgtttttaaatataaaaaaaaaaatctgtcactggaaaaaaaat

SEQ ID NO: 95211 - DNA, 461 bp, Homo sapiens
ccgatgacctttgcctgctcttctctttataagaattccacagaactcttttgaatatggatttccacttaatctttgatacttccaggctcttgggtcctgataagttttagaaactgcaagtttaagtgaagctgtttttaacttcccttttattttgctttaaatatttttagcaatgaatgacctttgaatacttttaaatgttgctatacaaacataaacagtgcttttactaacatattttataaatatttccttttccataaattcataaattgcttttgtcataaaaatagtaatattttatagtattttaagagtaaattctaagcctttaagaacttttatgcctacactaaggaaaataggactagagacttaaaatacataaccatgctacatttatagtgattgttatgttctctgattcatacattaaaaactgatgtgattccata

SEQ ID NO: 95212 - DNA, 203 bp, Homo sapiens
caaaagtaaaatgggaaaataaatcatggtgaatttacataacagagcactatatagcgatgagaatgaatgatctacaaccacagccaacgctgggtgaatctcacaaacgcaatgttaaaggggaaatccagctagtaaagtgaacgtgctagaagattccgttcgatggggttagactcagaatagtcacccttggtggg

SEQ ID NO: 95213 - DNA, 285 bp, Homo sapiens
ctggcattatgcacccgcacccaggcccaggccgctgcacacaggccctgcatgcagaccagccaggtggccagcccagacacacagtcaggttgcagggacacccgatcctgggcaccaactgtgggactctgcccagcaaagcctgaacagtctccagaggctgtaaccaggaatctccaattagggcaacctgggtttgtggggcccaggacggggagcagccctccttgaaagaaaggaacggagaggagggggagcgactgctcactcggctcagcacac

SEQ ID NO: 95214 - DNA, 509 bp, Homo sapiens
actgggagctgctatatttaacaagtttcactacttgttcttatggtcagactgagtttgggaaacacaaatctcaccatctgatatggaaatatcactaagaagacccatgtgttctgaaggcaaagggtgaccactactgagaaacagcagagtccttctacagtcgcttctggataatgcccatcttggcatctatagaactgcatttttatggatgcattaatttcatttttctatcatctttgtagtcagttaacgtggattagtttagagtgatgccaacctcattgttctgtgcctgtgctaaaaattggataaaagaccatctaatttttgtccattccctttcctcctccctttcttatcatctcacttttctttcttacctttcactccactttcattcttctgtgaccgtattctagatggaatatagtaggggcaaaagtaatagaaatattttcatgtgcacagggcattttagggaagtgcatgttttgtgatat

SEQ ID NO: 95215 - DNA, 196 bp, Homo sapiens
  misc_feature (21)..(21): n is a, c, g, or t
  misc_feature (23)..(23): n is a, c, g, or t
  misc_feature (173)..(173): n is a, c, g, or t
tgctgtgatctagaggatccntnggaggcaggacactgtgggaggcaggacactgcagaaatggcgcgggaggctccttccagcactactggatgaaatgaggctccttaggtggaaagcagttttgttttctgaagcttttgccggccagtgtcctgtgcctttcccagggntacctgacgcttcgaatttcgta

SEQ ID NO: 95216 - DNA, 258 bp, Homo sapiens
gttttaaatgtagcaactcattaaatccttccataacactgtgacgattataccactttacagatgaggaaactgaggtgcagagaggttaagtaaccagcccaaggtctcacagctactgcccatgctgtgggaagtcagtgaaggcgaagacttaggaattcactccgaactttaggtttgctgctggattgtggcagtgcatttatcacatgggagttgatggctgtttcaagagccattttttttttttttttt

SEQ ID NO: 95217 - DNA, 227 bp, Homo sapiens
aaatatggaatgaagacaattgtatattatttttacagccaaatagtagatgagtagtttaaatggaaattagctattgaaattttgatttgtaatgttgattagtattttaatcagaattttgactaactgaaaaatgtgtttaaaaacaaaagattttgttattaatgaggattatttggaggtttttctggtttcaaagcataccacaaaacatggtctttttc

SEQ ID NO: 95218 - DNA, 846 bp, Homo sapiens
agcgggtcggaaccccgcgatgtcccccgcgctgttcgtcccctcttcgtctccctcttcgatgttccgggtcccagaaaccaggttatcacagtggcccggatcatagggaaattgcgaaatcatccagttgggatcaccgagcctgcagggtccccttcctgggcgagcctcctggccccgtgctatcggaggcctggacacccccgccagggacccagcgacccagcaagtccccaccccctctaagggcgacctgggcctcggggtgagaggtcccctacactaaaaaggctgccgcccttcaatcctagaccccgagattcctttcactcgggaaatctcgtaatggcatccattgtcattttgatctttatgccgaatttctagctcctgcgtctccattgccggtcctaaaagtcgccgtttcactaagcttcggaacctgactccgagaaatctatacgttcgtcccaagatctcagccagaaagagaaatccgcgcggcggcctcttctagctcgggtgctgggaggccccgtcctgatcctctgtcgccctggccgatctccctcagggccacggggaagaggaacctgagcagctctgaggggcgagtctctgacggtggggctccccctcgtcctgccaggaccctgccccaaggagaagaccccttaggacgttaccagatttaaacaatgttttctcctgctcttcagagcacctgggataaggttcctgatgggtcttgggagcaaactaacatgtcgctccaggcgctcaagaccatccctctgattttcatattttggggctgagagcgtttaagaaggactgaaaaac

SEQ ID NO: 95219 - DNA, 392 bp, Homo sapiens
catatgcggtgtggccctctgccctcatgctgttcattttgtcataccagcaaccaagaggagcccaggcttcggagctggacaagtttaaatccagctgtgtgaccatagcacatttccaagcctctcttttctcatctcagaaatgggcatgaatctgacctttgcagtgttgttgcagaatgaatcgcagtgggcaaaacatgcctgatcaagagtggagcccctggggccaggaggaggcgtgtgtacatcatggggcgttcctttctcttgctgtgtaaatagaccctggaactcaataaattagattgattggaccagaaggggaaggtcttgaagacccaggctaaggattagggactcagtctccctgaaaacagggtatgctt

SEQ ID NO: 95220 - DNA, 488 bp, Homo sapiens
tcggaaggactcctctctgacagtagtgacataatattcttcactgtggcttcttccattgtgacccagaccaatctacttaaggtccgcaaatactgctcacgttctcccatgaagtccatcatgtggggagtgttttccttgtaggattacgctgctctcaagtgcatacatgatgatctttttgtccaagcatcagaggtgatcccagcatcttcacagtaccagcctttccccaagatcctcgccagagaaaagtgttacccagatcatactgccactggttccagcatttggaggcaaacatgaagctccatcctctccaattctggggcaaccgtgtggagatgatcaaaatgcttcaccttcaaaactttcaaaggaagagttaatacagagtatggatcgtgtagatcgagaaattgcaaaagtagaacagcagatccttaaactgaaaaagaaacaagtaaaagtctttgcctaatata

SEQ ID NO: 95221 - DNA, 1337 bp, Homo sapiens
  misc_feature (1231)..(1231): n is a, c, g, or t
  misc_feature (1299)..(1299): n is a, c, g, or t
  misc_feature (1336)..(1336): n is a, c, g, or t
tcctttcagaaccggcgatttcttttatttagacaacacctttttgcttttcttccacatcttcacactccttcaggatcaaaaacctaagccacatgactggatgagccgtcacttggccttcattcgggtagtgatggtcctcactgtagtggatgttttgcctccagatatgcttgaatcactgcattttgggaataacttcaaatgcaagtccttgatctaaataaacagagtgacgaggggcctatgtatctataccacctgtctcctgagtatacaccaggccagcataatcagcctcagcaacttctggttggaaagctttaaacataaatttacaaataacattgtcagtgtcctcttttttcttttttgttccctcaatttgtctttcagtagtgacataatattcttcactgtggcttcttccattgtgacccagaccaatctacttaaggtccgcaaatactgctcacgttctcccatgaagtccatcatgtggggagtgttttccttgtaggattacgctgctctcaagtgcatacatgatgatctttttgtccaagcatcagaggtgatcccagcatcttcacagtaccagcctttccccaagatcctcgccagagaaaagtgttacccagatcatactgccactggtgagttgctttgttgtcatgtactgggtggaccttatcatctcatcctcttcatccctgttatggacgtataacccagtcatcctgagcatctagaaccttgtagcctgtgtctatgccactctcgttccattggtacaaatccgctctgataaaagaatagttaatattctccaaaaaatggaattaaagtgctataattttttaatgtgttggtgatgaaaaatatttctaaaaattagtctcattctatagttaaattgttcaagtagccccagatttagcttactgagtttaaataaaatgcgtggaattacacttttattatatttttatgcttctgaaactgaggcatctaaggactatgtagtttcttcagttcaatgttcaccatagattgacatttcagatatcaagtcttttgcacttttatttttatgttaactttgtacaagaaaatgtttctctctttttgaagtacattcttaaaaaatttgttttggtatcaatctctcaatgtttttacttttgaaaatatttacttactctgtttatgaatgatactttagctnaatattcaattctagcttttaagccatgcttgctcattgtacctccctgactaaaaaaaattatgtcnatttggattttaaatttaatctagaattcattttaang

SEQ ID NO: 95222 - DNA, 326 bp, Homo sapiens
ggatcaacattatcatggcaaccctgaggaggctgtgagagtctctggggtccttgccggcctgcagaaaatcaagctttgagcgggaagcttcgaggagacacagtgtcacaattacaaggttccagcatttggaggcaaacatgaagctccatcctctccaattctggggcaaccgtgtggagatgatcaaaatgcttcaccttcaaaactttcaaaggaagagttaatacagagtatggatcgtgtagatcgagaaattgcaaaagtagaacagcagatccttaaactgaaaaagaaacaagtaaaagtctttgcctaatata

SEQ ID NO: 95223 - DNA, 864 bp, Homo sapiens
tcctttcagaaccggcgatttcttttatttagacaacacctttttgcttttcttccacatcttcacactccttcaggatcaaaaacctaagccacatgactggatgagccgtcacttggccttcattcgggtagtgatggtcctcactgtagtggatgttttgcctccagatatgcttgaatcactgcattttgggaataacttcaaatgcaagtccttgatctaaataaacagagtgacgaggggcctatgtatctataccacctgtctcctgagtatacaccaggccagcataatcagcctcagcaacttctggttggaaagctttaaacataaatttacaaataacattgtcagtgtcctcttttttcttttttgttccctcaatttgtctttcagtagtgacataatattcttcactgtggcttcttccattgtgacccagaccaatctacttaaggtccgcaaatactgctcacgttctcccatgaagtccatcatgtggggagtgttttccttgtaggattacgctgctctcaagtgcatacatgatgatctttttgtccaagcatcagaggtgatcccagcatcttcacagtaccagcctttccccaagatcctcgccagagaaaagtgttacccagatcatactgccactggttccagcatttggaggcaaacatgaagctccatcctctccaattctggggcaaccgtgtggagatgatcaaaatgcttcaccttcaaaactttcaaaggaagagttaatacagagtatggatcgtgtagatcgagaaattgcaaaagtagaacagcagatccttaaactgaaaaagaaacaagtaaaagtctttgcctaatata

SEQ ID NO: 95224 - DNA, 1018 bp, Homo sapiens
  misc_feature (912)..(912): n is a, c, g, or t
  misc_feature (980)..(980): n is a, c, g, or t
  misc_feature (1017)..(1017): n is a, c, g, or t
tcctttcagaaccggcgatttcttttatttaggtagccctatacatacattaagcatattttcccatttctatgatatagtagtgacataatattcttcactgtggcttcttccattgtgacccagaccaatctacttaaggtccgcaaatactgctcacgttctcccatgaagtccatcatgtggggagtgttttccttgtaggattacgctgctctcaagtgcatacatgatgatctttttgtccaagcatcagaggtgatcccagcatcttcacagtaccagcctttccccaagatcctcgccagagaaaagtgttacccagatcatactgccactggtgagttgctttgttgtcatgtactgggtggaccttatcatctcatcctcttcatccctgttatggacgtataacccagtcatcctgagcatctagaaccttgtagcctgtgtctatgccactctcgttccattggtacaaatccgctctgataaaagaatagttaatattctccaaaaaatggaattaaagtgctataattttttaatgtgttggtgatgaaaaatatttctaaaaattagtctcattctatagttaaattgttcaagtagccccagatttagcttactgagtttaaataaaatgcgtggaattacacttttattatatttttatgcttctgaaactgaggcatctaaggactatgtagtttcttcagttcaatgttcaccatagattgacatttcagatatcaagtcttttgcacttttatttttatgttaactttgtacaagaaaatgtttctctctttttgaagtacattcttaaaaaatttgttttggtatcaatctctcaatgtttttacttttgaaaatatttacttactctgtttatgaatgatactttagctnaatattcaattctagcttttaagccatgcttgctcattgtacctccctgactaaaaaaaattatgtcnatttggattttaaatttaatctagaattcattttaang

SEQ ID NO: 95225 - DNA, 211 bp, Homo sapiens
gaaatcatgccattgcaatgcagactgggcaacaagagtgaaactcatctccaaaaaaaagaaaaaagaaaaaagaaaaaacccagaagaaacatggggctgtcttaacaactcatatttccaacttaggtggatcaatataaatatgttactagctaaggagatgcctagagatctaatagttgtaaagccttcttggacttaaggtggg

SEQ ID NO: 95226 - DNA, 1604 bp, Homo sapiens
  misc_feature (578)..(578): n is a, c, g, or t
  misc_feature (675)..(675): n is a, c, g, or t
  misc_feature (679)..(679): n is a, c, g, or t
  misc_feature (702)..(702): n is a, c, g, or t
  misc_feature (711)..(711): n is a, c, g, or t
  misc_feature (771)..(771): n is a, c, g, or t
attatagtatgtgtagtgaaatggtgggattttatttttattttttattttttagagacagcgtctcattctgtcacccagggtggaatgcagtggtgcactgatagctccgtgcttgaagagccttgaattcttgggctctagcaatcctctcgcctcagcctcctgggtagctaggactgcaggcacaggccaccattcccagctaatttaaaaaattattttttttgtagacacagggatctctctgtgttgcttaggctagtctcaaagtccttggctcaaaggatcctcccacctcagcctcccaaagtattgggattacctggccaataatggaattttagaactggcaggaacgtcagagataatccaatgtgagctcttaatgatacagattaatgaagtatcaaaagatgagaggtatctaaaattcacaaaacttgttagtaacagaacgagtattagaaccagctatctaactcttagtccagtggtgtcctgtatcatacggtttcttagaaaatagatgtttccaggccaggtgcggtggctcacgcttgtaatctgagcacttngagaggccgaggtgggtgggtcacttgaggtcaggagttcgagaccagcctggccaacatggtgaaactctgtctctactaaaaatactgaaaattngccnggcgtggtggcgggcgcctgtantcccagctnctcaggaggctgaggcaggagaatcgcttgaacccgggaggcggaggttggagtgagccnagatctcgccattgcactccagcctgagcaacaagagcgagactccatctcaagaaaatagatgtttccacaaatgtaaagtctatatgtatttatatttcaacagataattttaagaaaattaaaatggatgagggctgttccaaagaaaatattagtaatctaaagtgtatgctgaatttttttttttttttttttttgagatgggagtctcgctctgtcacccaggctggaatgcagtggtgcaatctcggctcgctgcaagctccatctcccgggttcacacaattctcccgcctcagcctcccgagtggctgggactacaggcgcccaccaccacccccggccaatcttttgtatttttagtagggacggggtttcaccgtgttcgccaggatggtcttgatctcctgacctcgtgatctgcccgcctcggcctcccaaagtgctgggattacaggcgtgagccactgcacctggcctgaatttgttatttactatagtccaacacaagaattaagatggtatatatacagtttaaaatgggacttttttactcttctgactttttgttttaaatatatagtgaaaactgttaaaagtttctcttcagatatgtggtaggtatttgagaggccttattattggctttggttgacatgctggttttggaatcttacctcctagcctccaaatgtccacagaatctgacaattcagaaaagctttatactgagaaactatacataggcaacaggcatatgccacgccagttcatgcttctgagttagacactctatggtaggggaggttggcaatccatttttgtttttt

SEQ ID NO: 95227 - DNA, 515 bp, Homo sapiens
cgccgctgttgccgggcaacgcggtgagcctaccccgcgtgtgatgttttcagagacgggttgttttagagactgctcttcttgtggtcttattactgtttttaccctccttaccctaacaacacgctaaggggctatcggagagagtagagaagttttgttaggcattgggcagcttgggtcggggcagcaggttggcagtgtggtacttgagcaagtgtcagtgcatcttccattctggttgctcctggtggctccacagcactgctctatctagcaggctgtgaaagagtgaccgcaagctgctacagagtttgtcctgtcctgcgcttgacaacactgctgttaccattaatctcgtcgtacggagaccatgtcgcggcctggtcttattgggaattgtcttaaatatttggaattttaccctcatagcaaaaaagtcagggggaggggataccctttcagttattcaggattttaccaaacgtcttccaagtacagtctcagtggcaagc

SEQ ID NO: 95228 - DNA, 224 bp, Homo sapiens
tacctcttaggatccaagcattgtgccaggtggctggaaacagaggggcagaccgaagttaaccctcctctgtggatcttgggcttcctgtcttgagtctggttcatcagtcatagttcttcttgcctcaaggttattttgtttctagagcttcattaccctttcttaccacctgaccttgtccagtccacacccataactttccttaatttcaaatatcagtg

SEQ ID NO: 95229 - DNA, 579 bp, Homo sapiens
atgtgtggaggcagaggatatgggtgacattttaacaatcttgagtcttccaatctgggaatacaggatgttttttctttcattcagatctttaatttctttgaataatttttttgtagtttccagagtataggttttatacttcttttgttaaatttattattaagtatctcattactttttatactattataaatataattgttttaattttgtttttggatcgttcaatacaagtatataaaaggtgtattgatttttgtatattgagttagtattctgcaactttgctgaactcatttattagttgtaatgtattttcagtgtattccttagaattttctatatacaagatcaagacatctacaaatagagttttattcttcctttccaatctggatgccttttatttctttttcttgccttactatcctggctagaacttctagcacaatgttaaattggagtggtgagagcagacatgagtattttattcctcatcttaggggtaaagcatctatctttcacctttaagtatgatactagccatggttgtttttttttttttttttttccccc

SEQ ID NO: 95230 - DNA, 426 bp, Homo sapiens
ggcgtgatggacaggggagtatgcctggaagccctttctacactggatggctctcagtaacttacagagaaatgtgactgcaaaccctattgaagcaaagttagttcatctactcagcttatctttagcccacactggctgtatccacgccagtgccacctgatgcaaagtctgatggaaggacagtttaagtggaaaggcacaaggttagatctacagtcaaaacagctgacttttgcccattacaaaaggggtttgtgtacggctttgtgaacactttgttagggtcccttgcaggcaagtgggggccttgatgcttaagcgtcattagcttcacaggaaattcatctctgtttacttgtaacaaaatctcaggacaaagcagaaaaagaaaaacccagcactgacctcaggaccgcagacttc

SEQ ID NO: 95231 - DNA, 339 bp, Homo sapiens
gtgaggttgtacatcatcccatatatggtctcagattacagagtagagttttagaatccagtttcattccccattgtcttttgctccgcatattcagatggaaaaaccaaggatacaggtaagtgttatgaaaacaaaaacacagattccctggaggtcaggttagaaagagtgaacccacccaagtaaccactctccttccagaaagtgctgagagcatgcttcctcgcctgccctggtctcctgtcagcacccacatttgaccttcaaccttcatttctgccttaaagagcatcaagaaactgtagcagcttggaacatgcctgccaactgagtcct

SEQ ID NO: 95232 - DNA, 346 bp, Homo sapiens
ctctactggtggacaattaggcaatttcctgctttgggctattacagatagtgctgtaatgaacttcttttgaaatacatctttgtacacatttgcaagtatttctgtaaacacttaaatgtgacatgattatgtaaaagacatttacatttaaaatattgataactactttctagttatgctttcctcttcaaaagtatcctttttttctatatcctcacaaacactggatgttgtagtcttttttttgtttgtttttttgagtcttattatgtcacccaggcttgagtgcaatggcatgattttagctcactgcaacctctgcctcccaggttcaagcaattct

SEQ ID NO: 95233 - DNA, 359 bp, Homo sapiens
gggcaacatttgcaagaccccatcagtacagaaaataaaagaattagctgggtgtgatggcatgttcctgtagtcctagctacctaggaggctgaggcagaagtattgctgtagcccagaaatttaaggttgcagtgagctctgatcacattactatactccagcctgagagacagagcaagaccctctctttgaaaaataagattaagtaaagtaaaatgacaaacactaagctttagtgctcttcttcctgttctgtcctatcgccccaccaactagtaagtctggggaaaaattgcaaggataataatttgaattctctctacttctgtggtttgtaatatagatatgtaagttat

SEQ ID NO: 95234 - DNA, 648 bp, Homo sapiens
aaaaacataaccacttggaaggatccacaaaggaggtagaaatagacaagggttttcaaaggctgtgactcttcacagaaagggatacgaagggctttccaggaaggagcagtaccttgatctctttgcaacacaatttcaaattatccattagaatgacttattttatagatgtctactgtccttgacattatagtgatttcatttagcttctgatcgtttccaaattctaaaacttcctatgctatttagatgaccctaaaagtagacaaccctaaaagtgtaatagtgtcaagtcaaatatttgggaggtaggggtgtgtgtgtgcacgcgcatgcacacacgcatgtgaatttaaccactccaagagtattactgactcggcttttgcatgtactgttctatcttcttgtaacattcttccttcaggtcttcatatacatgtgtcctttgtaaccactcaattctgctgtcacccccggagctttccctgactgcctgtcacccagttgctccctgtcacacttccccatgtttttttcatagcttttgtcagcttctgaaattatttatttgacttctgccttttcccaagtgaagtataagctcctcaagggcagggtcttacctgtcttgttcactgccta

SEQ ID NO: 95235 - DNA, 692 bp, Homo sapiens
agtccgcattccccgcacccacccacgtcttcccgggagtcgtatcccgagcatggaggttactgagaccgttatttcttcatggcctgcctagcttaagcagtagctggaaaagatgtctcgggctgttcgtcttccagtcccctgtcctgttcaacttggtaccttaagaaatgactccctggaagctcagcttcatgagtatgtcaaacaagggaactatgtgaaagtgaagaaaattcttaagaaaggaatttatgttgatgcagttaactccttgggccaaacagcactttttgttgcggcgttattgggccttaggaaattcgttgatgttctggtggattatggatcagatccaaatcaccgctgctttgatgggagcacccctgtccatgcagcagcattttcgggcaatcagtggatccttagcaaactgctggatgcaggaggtgacctgcgactccacgatgagaggggtcaaaacccgaagacttgggctttgacagcaggaaaggagcgtagcacccagatagtggagttcatgcagcgctgtgcctcacacatgcaggccatcatccagggcttctcttacgacctcctgaagacgatagactccccgcagcggcttgtctacagcccgtcctggtgtgggggcctcgtgcaggggtgagtactgccttgagcagagt

SEQ ID NO: 95236 - DNA, 813 bp, Homo sapiens
agtccgcattccccgcacccacccacgtcttcccgggagtcgtatcccgagcatggaggttactgagaccgttatttcttcatggcctgcctagcttaagcagtagctggaaaagatgtctcgggctgttcgtcttccagtcccctgtcctgttcaacttggtaccttaagaaatgactccctggaagctcagcttcatgagtatgtcaaacaagggaactatgtgaaagtgaagaaaattcttaagaaagctctggagttgccacaaacagcgttgagatcagaggaagagtggagaagcaaggaggagaattaacagagcattgctgcatcctgcagtgcggaggagggaagaaattggaatcggcctgggaatttatgttgatgcagttaactccttgggccaaacagcactttttgttgcggcgttattgggccttaggaaattcgttgatgttctggtggattatggatcagatccaaatcaccgctgctttgatgggagcacccctgtccatgcagcagcattttcgggcaatcagtggatccttagcaaactgctggatgcaggaggtgacctgcgactccacgatgagaggggtcaaaacccgaagacttgggctttgacagcaggaaaggagcgtagcacccagatagtggagttcatgcagcgctgtgcctcacacatgcaggccatcatccagggcttctcttacgacctcctgaagacgatagactccccgcagcggcttgtctacagcccgtcctggtgtgggggcctcgtgcaggggtgagtactgccttgagcagagt

SEQ ID NO: 95237 - DNA, 123 bp, Homo sapiens
gttaggattgtaggcattagccaccacactcagtctagtacactgtttataaaattttccctgtacactgaggctgtcacaccctctcagctaatgaagtgtagtaggacaggccatactgtg

SEQ ID NO: 95238 - DNA, 383 bp, Homo sapiens
tgatttcacccctgaccaatcagcactcctggctcactggcttcccccacccaccaaattgtccttaaaaactctatgggtagactgatttgagtaataataaaactccggtctcctgcactgcatgaattactctttctctattgcaattccgcttgtcctgagaaatcggctctaagaaattggcaggcaaagtgaacccattgggcggttacaatcccagcattctgggaggctgaggtgggcagacagcttggggccaggagttcgagaccagccaggccaaagtggtgaaaccctgtctctactaaaaatacaaaaattaggcaggtgaggaggtatgggcctgtaatcccagctatgcaggaggctaaggcaggaaa

SEQ ID NO: 95239 - DNA, 345 bp, Homo sapiens
tcacgcccaggcatccacttggccggacaactttcttcctccaggttccagacagcctgctttgcgggcctgttcgccccataaaaggacctagacgtccagctaaactcctgctgcatgctttttttcttccttaggaaggatggggtgcgatggagagaggagccttcttcctgctttattcctgcatctgattattgggctgatgtgtgctaaagctcccgcaccgggaaaactgccgaggttttagggctcactagccctttctttggtgggcgctccctctcctccgcccctcgagatgggttgcgggaagcgggctgtggagctgaggagttggtagta

SEQ ID NO: 95240 - DNA, 748 bp, Homo sapiens
aagagcaaccccaagacacataattgtcagattcaccaaggttgaaatgatggaaaaaatattaagggcagcgagagagaagggtcgggttacccaccaaagggaagcccatcagactaacagcagatctctcagcagaaaccctacaatccagaagagagtggaggccaatataaagcattcttaaagaaaagaattttcttttttttttaaaggctaaaatatttaattatgtttttaaagcacatgaattctttacatttcaataaaatatttccaaactatattatcccagaaaacaaaacatgattgcattttcaacccagaatttcatatccagccgaactaagcttcataagtgaaggagaaataaaatactttacagacaagcaaatgctaagagatttcatcaccaccaggcctaccttacaagagctcctgaaggaagcactaaacatagaaatgaagaaccgataccagccactgcaaaaacataccaaatttgtaaagaccatcgacactatgaagaaactgaatcaactaatgggcaaaataaccagctagcatcataatgacaggatcagattcagacataacaatattacccttaaatgtaaacagactaagtgccccaattaaaagacacagactggcaaattggatgaagagtcaagacccatgggtatgctgtattcaggaggcccagctcatgttcaaggacacacataggttcaaaataaagggataa

SEQ ID NO: 95241 - DNA, 188 bp, Homo sapiens
ctctacaggaggtaagaagacgacagaaggggaagctgagagggagctgcccatcggagtgcccagccaggactgagtcactagcccttgccctctaggttaaggggaacagagggcctccctttgcccttccccatttagggtggctgtggcaagtgagagtgtgtgtgtgcatgtgtgtgtaaact

SEQ ID NO: 95242 - DNA, 291 bp, Homo sapiens
tcttaccaatctgacattcactatcaaccacttcttgacacatgtcatagaaaagtgacatctctttcccttcaaccaatatatcctccaacaacatcaacctcaacaggtagctagcattgtcttctgttgaaatttagagctggaagaaaggatttcacaatctctctgtggagacccaggaatccgttaccttctgggattttagagagtgtggagagagatgagcaggcagtgagccggggaccaactccgataagaatatgaagtcaggaagtgagagaggaaacg

SEQ ID NO: 95243 - DNA, 412 bp, Homo sapiens
tatgattacacttcagttaaaaataaaacaaaacccacacttagaaacaggggctgaatattaatattccaaaatattaacacaattatctttgactggttggttttggaagattaaacttttttatactttccaataagcatgcattatatgtaatggaaaaataggaaaaggtagaaacctatacctgagtatatgcctttactacaattgataatctgattctctgtatctattcttaacaatggtgaatttttatcatcacatatactgtcttcctacactttctctcacctcctcccaactccagctgtaggctacagccagactaggggactcacaatgccttaaactcccgtctgtgtgactttggctccagcctgcaattccatctgctctctcactatcaagc

SEQ ID NO: 95244 - DNA, 1576 bp, Homo sapiens
ctgctcactctccccacccaccctttcgcatgcccagactggatccttccacagaatcaggacttcttcctctacttgggcaacagcagtaataacatctggggaccccgtctcagccgaagctctccctcctagccaagccatcttgaacgtccctcttgcttttggtgccactcgcggctttgctgctcctggaaatcctggtcccgttacctctcaaaggtttccctagtctttcccatcctcctcgagactttttacctacttaaagccatacggttctctcttttctcgcttttatccccgggtacccgctaggacccagccccggcccctggacgaccctcgggcagccaccttcaagcctccagccgccagactgcagcgcgacagaggcggctgctggacggagggagggctacgggaggaggtggtgcggctgctgcagtgcccgcggcgcacactcccccgcactcctcggccggccacacccttttccggactgtgggctgcgcttgttccgttggggcagagacccttatttctgcggcggccgcgtctcctgtgctgaggcggatgccttctctctagtcttgcagaggcgaagccggttacccggcccctcccagcagaggtgccagtctagggggagaatggcagcagagaggaatcaaaattgacactagacagacacagccaagcttcccaggccctggactggaaaggggaggagaaagagggccaaatggctctaggggacctgtagcctaggcagcaagtgtttgtctcctcctcatcatcatggaaaccaatcttcctacccccaatacaaagcgcaggtgtcctttcccttaaaaggagtcacacagagaaagatagaggaaaacacacacacacaccccaaaaaacccacaaagccaggcctaattaggtcttctggcccctccctgactcaaggaaggacttgcttccctcttcaccttcctgctctagaagccccgtctgaggggagttgagaaggctggaaaaggggactttttttttttcttttttgagacggagtctcgctctgttgccaagctggagtgcagtggcccgaacttggcacactgcaacctctgcctcttcaagcgattctcctgcctcagcctcctgggtagctgggattacagtcacgcgccaccacgcccggctaattttgtatttttagtagagacagggtttcaccatgctggtcaggctggtgtcgaactcctgacctcgtgatccgccgcctcggcctcccaaagtgctgggattacagatgtgagccaccgcggccagcctggaaccaggactttttaaatcccaggattccctcaaactccaatttgactggacctccccctccagaaagaatgcgcccttctcctcctcccgctcctctctctctcagcagctgtcatttcaccacgtccctgagctatccacagggcaacagcgtgacctctaccttgtcagctccccttattagagagacatcagcccccaaactctgtgaggaatgaacctttggggcatcctcgcccctcgccca

SEQ ID NO: 95245 - DNA, 937 bp, Homo sapiens
gatcgacatgtccataatgttaatgaagcgcatagcagtcactagtaaattaggagttatacattgcttctatagcatcagaaattgtatatcaggccaggtgcaaaagctcactcctgaaatccaagcactttgggaggctgaggtgggcggattgcttgaggtcaggagttcaagaacagcctggccaacatgatgaaaccccaggtctctactaaaaatacaaaaattggtcaggcatggtggtgcatgcctgtaattccagctactcgggaggctgaggcaggagaattgcttgaacccgggaggcagaggttgcagtgagccaagattgtgccactgcactccagcctgggcgacagagccagactgtctgaggaagaaattgtatatcaggctgggcacagtggctcatacccgtaatcccagcactttgggaggcccaggctgggtatcacttgagcccaggagttggagaccagcctgggcaacaaagtgagacccctctctctacaaaaaataaattagccaggcatggtggcacgtgcctgtaatctcagctacttgggaagctgaaggaggatcgtctgagcccaggagtttgaggctgcaatgagctacaatcacacccctgcactccggcctgggcgacagagtgataacctgtctaaaaaaataaaaataaattgtataatcatattgcaattttctttgcattactgatgaggaaaaatctcaaagtaattgtaaaaaatcctggatatcacatagttgagaaacaaagttattttaaacttacaggactctgtagttcacagttgaacactgtggcttcctgaaatatcaaagaataatgtacattaataagccagctactatcggcatcttgtaaaaattaaaaaattaaacataaataaaagttcaaactatgtgttga

SEQ ID NO: 95246 - DNA, 433 bp, Homo sapiens
gatgatagctcactgcagcctcgatctcccaagctcaagtgatcctcccacctcagctacttgggaagctgaaggaggatcgtctgagcccaggagtttgaggctgcaatgagctacaatcacacccctgcactccggcctgggcgacagagtgataacctgtctaaaaaaataaaaataaattgtataatcatattgcaattttctttgcattactgatgaggaaaaatctcaaagtaattgtaaaaaatcctggatatcacatagttgagaaacaaagttattttaaacttacaggactctgtagttcacagttgaacactgtggcttcctgaaatatcaaagaataatgtacattaataagccagctactatcggcatcttgtaaaaattaaaaaattaaacataaataaaagttcaaactatgtgttga

SEQ ID NO: 95247 - DNA, 400 bp, Homo sapiens
cttgtctgtcccgtttcgaccatattttatttttgagaaggtcttgctctgtcgccagactggattgaggctgcaatgagctacaatcacacccctgcactccggcctgggcgacagagtgataacctgtctaaaaaaataaaaataaattgtataatcatattgcaattttctttgcattactgatgaggaaaaatctcaaagtaattgtaaaaaatcctggatatcacatagttgagaaacaaagttattttaaacttacaggactctgtagttcacagttgaacactgtggcttcctgaaatatcaaagaataatgtacattaataagccagctactatcggcatcttgtaaaaattaaaaaattaaacataaataaaagttcaaactatgtgttga

SEQ ID NO: 95248 - DNA, 370 bp, Homo sapiens
ccctagagaacagggttcttgctttgtcgcccagttgaggctgcaatgagctacaatcacacccctgcactccggcctgggcgacagagtgataacctgtctaaaaaaataaaaataaattgtataatcatattgcaattttctttgcattactgatgaggaaaaatctcaaagtaattgtaaaaaatcctggatatcacatagttgagaaacaaagttattttaaacttacaggactctgtagttcacagttgaacactgtggcttcctgaaatatcaaagaataatgtacattaataagccagctactatcggcatcttgtaaaaattaaaaaattaaacataaataaaagttcaaactatgtgttga

SEQ ID NO: 95249 - DNA, 1307 bp, Homo sapiens
ttggggggaaatgatttaaagcatatttacatatatatgttactggtttcttgttataaacagagaattagaaaattctaaatgttttctgaacgatatttcaaaacccagaatattgcatgaatcaatattaatgaagtttgcatttgacagtaatcattctgtcttgtctatttctagatggttgtacttatgtacataaggatttatgtaatgtaatagcatttaaaattaagaaacacattttaaactaaaatagatctatgtttgtgagcatatcttgccttctatttccattttatactctttagacattctagggaacttttcaaaagactatatcaagttggatttactactttttcatggtggttttatataggctgttaaaaaaaaaaggttgaaaaatagaataaacatatcagtttcatctaatgacattgtgtacctttctgtattttttatgactttgtatagccttctgacatagtcctttatctcattggtgagaatccatgtgacatttctattctttttcatctactttgtgaatattccagatttattaagaatagtcaaagcatgttatgacacaacatgctttattagaaggatatttaaaaccatgttatgacacaacatcttatttttaaaactggactatagggctgggtgcagtggctcatgcctgtaatctcaacactttgggaggccaaggccagaggattgcttgaggccaggagtttgaggccagtttgggcaacatagcaggaccccatctctaccaaaaaaaaaaaaaaaaaattagctgggtgtgatgttgcctgtagtctgagctactagagaggccgaggtgagaggatcacatatacccgggagtttgaggctgcattgaactatgttctcaccactgcactcagcctggagaatagagtgagaccctacctctaaaaattttaaataaataagtaaaaaaataccgagctattgtgcaggctcagttatgctgactacaacttatgttactatgttttacattatatagtctaaagttacttatagtccaagtaagccatatggtagtttcttctgtaattaaagtataatttggtgctattgaacattgctgtactctgttctgtagaaaattatatttgaaacaatataaaaccgggtgtggtggcacacgcctgtaatcccagtactttgggaggccaagccaaggaggatctcttgaggctggcctcaagaggattttgagatgagcctgggcaacatagcaagacccaatctctacacaaaatgta

SEQ ID NO: 95250 - DNA, 168 bp, Homo sapiens
tcttagcttcgtggcagatgtgataagcatgcctttgtgtctttctctaagtcactgacttttcagtaacatctaaatcataaaacataggtctggccaggtgaagtgcttgtgcctgtaatcccaaggggccaaggcgggaggattgctttagtccaggagttggag

SEQ ID NO: 95251 - DNA, 565 bp, Homo sapiens
cggtaccgtacgcccacaggactcagcctgggcgacagagcaagatcgtctcaaaaaaaaaaacccttgcttacaagacactgggaggtcaggatttaaacaatggctgcctggtcctccttccttggcaccctacaaataaatgccttctcttctatagctgtaagaagccttgatgtagatacctggatttactgtgccaggcgagcagaccccagttcagttaaccctccaagggtgttgtgagtggacaaggcaaacacagaattgggccaggtggattgtaatgattttgtaatgattctcattgtggtgtgagtattcacacctcctgaaatggccgggaaatggatttttttagtcacttggtgacccagggtcacaggctttctttgtgtctggctgggtttccactaaaatgcttatgataccaaagctcaccttcaactaatttttagttaccttcaagatgtggagtgaatgtactatttgaagcctggcattgttgccctgtgtcagaccttctctcagggcgcaggtcttgtcaaggtccacatccctcggc

SEQ ID NO: 95252 - DNA, 311 bp, Homo sapiens
cctcctgggttcaagcgattctcctgtctcgccctcccaagtagctgggactacaggcgcgtgccaccacaccctgctgatttttttttttattttttagtagagatggggtttcaccatgttagccaggatggtctcgatctcctgaccttgtgatgtgcctgcctcggcctcccaaagtgctgggattacaggcgtgagccactgcacccggcacagctgggcagtcttttactggggcaatgtgtcttctgttggacgcatcttggagcagcacagctgagcaacgcatcctcgtgtctgtcatgaag

SEQ ID NO: 95253 - DNA, 468 bp, Homo sapiens
ggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtatagctcacaccgcatccatcaatccacccaccacagcaagtgtctgcgatgtctgtagtgtctgcgatgtctgtagtatctgcaatgtccatgc

SEQ ID NO: 95254 - DNA, 500 bp, Homo sapiens
cacggtggctcacgcctgtaatcccagcactttgggaggccgaggagggcagatagtgaggtcaggagatcgagaccatcctggctaacatagtgaaaccccatctctactaaaaatacgaaaaattagctgggcgtggtggcgggcacctgtagtcccagctacttgggaggctgaggcaggagaatggcgtgaacctgggaggcagagcttgcaaagtgagctgagatcgcaccactgcactccagcctgggcaacagagcaagactccgtctcaaataaataaataaataaactaataactaaatgttgtaacacaaaagaggataaatgcttaaggtgatggatatcctgtttaccctgatgtgattattacaaattgcatgtctgtaccaaaatatctcatgtacccgataaatatatatacctactatataccgacaaagttaaaaatagaaactggaagacaaaaaataaataaaaatcaaataaagcttctc

SEQ ID NO: 95255 - DNA, 518 bp, Homo sapiens
  misc_feature (3)..(3): n is a, c, g, or t
  misc_feature (17)..(17): n is a, c, g, or t
  misc_feature (36)..(36): n is a, c, g, or t
  misc_feature (40)..(40): n is a, c, g, or t
  misc_feature (65)..(65): n is a, c, g, or t
  misc_feature (88)..(88): n is a, c, g, or t
  misc_feature (98)..(98): n is a, c, g, or t
  misc_feature (104)..(104): n is a, c, g, or t
  misc_feature (139)..(139): n is a, c, g, or t
  misc_feature (174)..(174): n is a, c, g, or t
ggnaaaacttaaacagnaagcagacccaactgtgtnatgnatccaattacaaaaaagttatctgnattttatttcttatatatttggncacaaacagncagagnactgtaaagtctactacacatgttggaactgctgnacaggtaaaagtaacccagttagataaatctaggnctttccactccatatattagctgaggcaggagaattgcttgaatctgggagacggaggttgccgtgagccaagatcacgtcatgcactccagcctgggcaacagagcaagactccgtctcaaataaataaataaataaactaataactaaatgttgtaacacaaaagaggataaatgcttaaggtgatggatatcctgtttaccctgatgtgattattacaaattgcatgtctgtaccaaaatatctcatgtacccgataaatatatatacctactatataccgacaaagttaaaaatagaaactggaagacaaaaaataaataaaaatcaaataaagcttctc

SEQ ID NO: 95256 - DNA, 918 bp, Homo sapiens
  misc_feature (730)..(730): n is a, c, g, or t
  misc_feature (751)..(751): n is a, c, g, or t
  misc_feature (754)..(754): n is a, c, g, or t
  misc_feature (791)..(791): n is a, c, g, or t
  misc_feature (829)..(829): n is a, c, g, or t
  misc_feature (835)..(835): n is a, c, g, or t
  misc_feature (847)..(847): n is a, c, g, or t
  misc_feature (863)..(863): n is a, c, g, or t
  misc_feature (878)..(878): n is a, c, g, or t
  misc_feature (882)..(882): n is a, c, g, or t
agcggattaacatcacttccccatggcgaggaactccatgtgaggctctgggggaacctgactatgtgcagtcgtttacagcctgggtctcctggagcctatgaaatgagaagcagtcattagcacagcaagcggccctcatccttccttctcaataataacactgtcaccagaggatggaaaattaccctgacgtctctgtatctccaaattgcacttcagagacagactgcgtaaggcaaacagaccctgagtgaaaacctcctggctagacttccaagccaaggcctaataaataaccctgaaatatacaaagtgatggcagctttgctctgtggctcgtggcttctgccctgggaaggaccatgaatttcagcgtctgacagatggggtcagaaagtggagtctgcctggtgggttgaggatctgcaaattaaccccatggtggtggtttcagaacaagtgtgcctgctcacgcaaagactaacctctaagaaaggagcaggcccggaggtgaggccccctgggcgtgaaagaatcaaccccagtccacaaagtccggagatgagacatcctgcctggaggagggagccctgtgcatcgcaggatcaaagaagccaaacaggatctttagtggtgaccgaaaatgctcatgaggagaaaggctgcatggcattaagtgaaccccattgaaagggcccagtgaacagagcccctggacattgccggnaggaaaggagaaagccagcanagnacacaacgtatcaggctttcatgtgtcattgggtganagggagtcacatgggccaaggaggggaagcaggtgtcntcagancagttccaaagncctctaggcacagtancaggcatgcttctgncctnctctcctttaaatgtaagtaccccaagtccttctca

SEQ ID NO: 95257 - DNA, 117 bp, Homo sapiens
attggagagagcggctgcagggggtggtggagatgatgccaggtttcagtgggtgagaagtggatagaagtgaaggaggagaaatgacgacattaaaatctaggtacaacatgttgg

SEQ ID NO: 95258 - DNA, 1241 bp, Homo sapiens
gatcagaggtaaagctccgtactttattccacaggacagatcctatgtagatggcagaccatagatagccttaaggctcttggctgctttcatgtcctactgctgccataacaaagtactgcatactgggttggttagaacaacagaaacgtgtcctcttacagttttggaagccagaagcctgagatcaaggtgctggcagggtcatggtctctctgagggcaccagggaggatctatccccatgtctctaaggcttctggggttccctggctgggcagcaccactgcagtcctcacacagtcactccccagggcctcttctctgtgtccagccatattggactaggacccacaccctatgtgagaatgaccacatcgtaccttaattacatcacaatgaccttatttccagataagggcaatctgaggtactgggggttaaggcttcaacctgtgaatttgcgggacaccattcagcccagagcactgactggtgctagttatatttgtgtgtctggctgtaccctgtgatcacctggttgatgtcatgttcctgaacttttgtgagtgcaagagaagagaaggtatgtggactggccccgtcgccactctatggaataagccacacctcacagccgggaggagacgcaggtctgtggcatggatgaggagttccggacatctcagcgtatctgggagggaatgtgcctttgggtggttaagtctgtgacatctgctgaatcagagtagaacctgttggctgaggaaggcttgacttctgccatgctgcaggtggtactccagctcaaatacaaacgctcacagccgatgcctgtgctttccacgcaccatgttttgttctgggcctagtggaagtgagtgagcctgagaggtgagagtttgaccatgcaactctgtagggagggaggtgtcctcatagtctcacgttgcaccaggtgctgtgttcttcgtggagtttagtcctcttatggagaactcctgatctcattgccggataagcacaccaaggcctaaagcagtttgagtaatttactccaagcatcttagccaagtaccaggtgtcgaccatcagtctggggccctgagagctactgccagccacagtgctataaactctccccaccaaaaccgcaataaaaatttcagaaggacgagttaacaatggcagagaggggacaggatgtctggggtgggtctggcgagggtgaagcaaaaggcc

SEQ ID NO: 95259 - DNA, 974 bp, Homo sapiens
gatcagaggtaaagctccgtactttattccacaggacagatcctatgtagatggcagaccatagatagccttaaggctcttggctgctttcatgtcctactgctgccataacaaagtactgcatactgggttggttagaacaacagaaacgtgtcctcttacagttttggaagccagaagcctgagatcaaggtgctggcagggtcatggtctctctgagggcaccagggaggatctatccccatgtctctaaggcttctggggttccctggctgggcagcaccactgcagtcctcacacagtcactccccagggcctcttctctgtgtccagccatattggactaggacccacaccctatgtgagaatgaccacatcgtaccttaattacatcacaatgaccttatttccagataagggcaatctgaggtactgggggttaaggcttcaacctgtgaatttgcgggacaccattcagcccagagcactgactggtgctagttatatttgtgtgtctggctgtaccctgtgatcacctggttgatgtcatgttcctgaacttttgtgagtgcaagagaagagaagaatagcagtatgaggtgggccatggcccaagaggtatccagcaggaagtggtggcggggaagaaatttgaaacgcctcccgtgcctagagcctctggtggattctggggaaggaagaggacggggtgtgcctcacgcagatctctggagaaacgttgaggagctgaacgtggtggcagcctggtgtggactaaacagagtcggttagaaaagtgttctgatgcagtcacagctttcaaggcctcagcttgcataattacaaggggcaggagctgaaatttcatctgtgcgacatcagctcaaaaggagccgagactggaagaaaccgggagctatgatttgcactttgataacttaagtgaaataaatcgatgattccaaatggaaaaa

SEQ ID NO: 95260 - DNA, 436 bp, Homo sapiens
aatccataaggaaaaaataactaaaattacctcgcataaatttatcaatgtttaataagaaccattttgggtatttcaaacaggatgcaggaaatgtgttgcaaaggtgttgaaagacctggaaaaacaaaatagaatatatggttatacaaaatcgatgatttatgtgcttttgggatgccactgtcatgcctttgctgctactgccatcactgccagagtcacagccagaagcactggtagaggccaggagaaagtagcttcttccttcctctggcttccagtctcttattagtgcctctcactggcagacccaacaggaggacagctggaaagggagtctgggaagtgtaattgcaggcttccagtcctgggcattagaaagaacatggctgaagagcaaatgcaggacagtagacactgttcagcacaatcc

SEQ ID NO: 95261 - DNA, 410 bp, Homo sapiens
aaatgctacagaagatgttttccatcactagtgatatatttaagtgagttatccatataatattgggttcctttgtaaccaacacacacttgggtgaagggctgagttaatagttcattttgtggccatgaaacactttttctatgtgaagctgatgtgccgatcgatgacttcagtttctgattttgaccttgtcactagttcctagccaagtgataatactgacactagggccatatctctttagactctaaagtttggagaccctattagttttcttggaagatatatagttctgccagcaaacttggacacttcctcataaatatggtcatctagaagctgccaaaatctaataagattgatcagtttcatgctaatgggtaaatcagtccatttagagaattctt

SEQ ID NO: 95262 - DNA, 409 bp, Homo sapiens
ccttattccttttttgttcacatacttccttaaaaaatttctgaaagctgtgtatgtgggaagaggatgtgactctaaagggatagcacgaggggcatgtatctactctgtgtcctgtacaagcaggtggtgagtccataaatctgtgcatgtattaaaattcatagaactgtacacaaaaagaaaatagctatctactctgttgcacatgctttgcaagagcatctaagagctttgggtgacatctaaaacctttttcactacaagttttaaaaagtgctaattctatcatttttgttgtgttataaatacagtcagtccttcacatctccaggttctgcatcttggttggattcagccaagcacagattgagaatatttgagggacaaaaaacaataaaaaatatac

SEQ ID NO: 95263 - DNA, 228 bp, Homo sapiens
aggctgagatgatgagaaacctttttcctttcttctgtggtgcttcactccacctgggagctcactgcctagcatctaacatgaggagccccggcacttttcattttctagtcctcacaaaagtgctacaaataaatattattttgtgcccattttatagatcagaaaacctaagtctcagttaagttcacctgctcacaatgaaaattagtgacccatgaagccaga

SEQ ID NO: 95264 - DNA, 181 bp, Homo sapiens
tctcaaggcaaagagaaagaatgtaagttcttttgttgtttttgagattggttctccctctgttgcccagtctgatctcaaacacctgacctcaagagatcctcccacctccagcccccaaagtgttgcgattgtaggcgtgctggcctactttctgttctggttttctttcttttctttt

SEQ ID NO: 95265 - DNA, 345 bp, Homo sapiens
aagaaaacagggctggacatggtggttcatgcctataattccaacactgtgggaagctgagaagggagggtaacttgagcccaagagttgaagaccagaccagatgacatagtgagaccccatccctacaaaaaattaaagttggctgggcatggtggcacacgcctatattctgaactactcaggagacttatgtgagaggattatttggaacgaggaagtcaagactgcggtgagctgtgattgcaccactgcactccacctgggagacagaatgaaactctgtctcaaaataaaaataaagaaaaaaaatgacacctgagatattaactgtgatcatcagtg

SEQ ID NO: 95266 - DNA, 707 bp, Homo sapiens
ctgctttgaacgtgaagacaaaagaacccggtttctgttcatacttttatatcctctcttatgcagtctatagcctgggcttggaacttagagccttaacagactttaagacagtaccacgtctgaacctagagttatattgtattctttctattagcagagagctttctgattcctaagaatttccttactctacaagaaatgggatttctgctttgcaaagttcccttcagtggaatgaagttattgttgcccagagcttccctggtacaactctatggacttgggcatgattctccctaaaaatccgtggaagccgtgatcagagcccttggaaaattgctctggtgagccaagtgggcagtggcagtagagcagttttcagtagtggtcccacggtggcaagttggctgtgaagcagttgaggatgacatgaatgatggctcttcaagctaagactgagtagttgtaatggaaaacaaggtcagtcacctggctagttgatgatggtgggagcctttttttttttttttaaaggagaagaggagccatttattaatccccactttgggcatgattcattggctcattgtcagcgcctagctcagcttggctttaagtaggtgatggccaaactgatatgatcgttgtatattcactggcttcaagaaaccaccagtgggaaatcttatttatggagatgatgg

SEQ ID NO: 95267 - DNA, 421 bp, Homo sapiens
acattttaggaagggtataaattaggcatggccacaggcaggaagacctgagggatctcatacagtcagggataagagtctaaacgacaaggtagccatgaacattcaaagaaagaagactgaagagactttagagggcagtccccatgggacctgagtgaaggggtttgggagattcacagctttctgctgtgaagtcaaggatatcacaaactatcggaataaaagaaacagtcctatggctgggggtaggtggatgaatgtggttccattttgaacaagaggagaaaattcaggtaattcatttggattgattaagcaaaagaatttgaagctgaacattatagaagcaacaacaattcttatgatattggggtataggaaacaggcccaagaaagcacaatatttcctgtttctctt

SEQ ID NO: 95268 - DNA, 253 bp, Homo sapiens
tactaaaaataaaaaattagccaggtgtggttgcaggcacctgtagttacagctactcaggaggctgaggttactgtgagccgagattgcaccactgtactccagcgtgggagacagagtgagattccgtgccctcccccccaaaatcttattcttttcactatgaattttaaggaaataaattaaaactccatatatcaatgcttaattctcttcttcccatcctcatgcctcaccccacaacttgattttg

SEQ ID NO: 95269 - DNA, 206 bp, Homo sapiens
ctatacaatggcagtttaatgtcaatagctattacctagaacttttatactattcaccagagaactttccaagttatgtgaactggaatgaaatttctagaacaaatatctgtaacttgcatatttggaataattaaagatgaccatttaaagtagcctttatttaggccagtccatatatacacattttatatttaatcaatgat

SEQ ID NO: 95270 - DNA, 189 bp, Homo sapiens
aaaggtggagttaccatcatgagagaatataaagtacaaagattctaagactagaaaactttattatgggccgggcatagtggctcatgcctgtaatcccagcactatgggaggctgaggcaggaggatcacttgaggccaaaaactcaaaactagcccaggcaacatagtaaaataccatctctagta

SEQ ID NO: 95271 - DNA, 613 bp, Homo sapiens
gtgtaacaagagactaaaaaaagcaatatggttcctccaagcagatagtggtggctgggggtagaagtgaaccagagacagttagtttatatacctctgaagagaacatctcctgtgatcccattattgcattttttcctaagtctgaaatatttaccctggtttctatgatttaatggaaagaaaaaacgctgaaatgcataaaggttttcatttctgatagaaatttggtgattatctagtattgaaatttggctattttttgacatgtgcttgtgtgtgtgtatgtgtgtgtgtgtagagggagagaggagatggggggatctcatgctgatgaataattctgaatttttacttgaaagatatttaaagtaaaggttcttgaggaggtgatttgtgtctttaatcttgctcaaatgtaaaataaagtgtaattctaaacatctttaaatgttcctaatttcagatctcactatcctcattaacttaaaatcaaggaacaaatataggcttggcattttctatatattttttctgtatctgctaaactattttaattcataaattctatagcataaaataaaatggaaataccatttgttaagcagggtaa

SEQ ID NO: 95272 - DNA, 446 bp, Homo sapiens
ctttcctgctactgctggggcattggcagcgctaatcatcactcacaaacaggctgcttcgcattggaacttggttgtaaaatataactaatgagaacttttccaggagtttaagctgcataatatcttatcctctttatataatacacctgtatatttttagggattaggcaactttgatgcctgaaaaagtattatcagaacacatttcaaaacaaaattatacaactgtgcattgtttccatagacttccttagcacactcctctgagctcagtggggcctaactgcttcataaaacaacctgaaaatagaatacatggcctctctcttcctcactaggctagtgttgatcagggaggacaagtggagtgctcaagaagtcaaacatggaaaagaggatgacagaaaccagtttgatgaactgggagagacagaacagagaca

SEQ ID NO: 95273 - DNA, 141 bp, Homo sapiens
ggtagtatggctaatctcaggttaaacaacacgctaataaaagtaaactaggcagcctccattttttttttcctcttttttcttttttttgatatggagtctcagtctgtcacccaagacggagtgcaacggcacgatctt

SEQ ID NO: 95274 - DNA, 374 bp, Homo sapiens
ccagggaaaggctgaaaaaaacccaaagattagcacacagactaaaacctcttagtcccttaagcaatgtttgtattcttgggaacatgtgggaaaactgcgtaagtggtgtccttggagtttgctttaaaagtaagatcttttgaaaaatgtttattcatgttctttgcccactttttgatgggatttttttcttactgatttgtttgagttccttgtagattctggatattagtcctttgccagatgcatagtttgcaaacatacttgggtgacgggtgcactaaatctcagaattcaccactatagaattcatccgtgtaaccaaaaaccacttgtacctcaaaagctactggaataaaataaaataaatg

SEQ ID NO: 95275 - DNA, 908 bp, Homo sapiens
agcggaggttatgcacatatattggtaggagctatatgggaaatctctctactttcagctcaattttgctgtgaacctaaaattgctcttaaaaaataaagtgtgtaatcaaaaaatactccttgttaactaacatgatccatatcttacagatgggaaactgccccttcttttacaggaggatacaatatgttagctgtagagccagtactgtaaccttgaccttcatttcaaggccaggtttctctaagctttactaggctactcaaaactcataacctgtaccatgatggaatttgatattgtttttggactgatctgtaaataaatacatttgtaatttagatttccatttagacagttcgttattcatgatagacttactaaagaatctctctttttaatgctagtgttcctgaataacactatttataacaacagaagaaaaaatactactactaatagatgcatctgtcgattttgtaccatatgtgaggtagtatgctaagcatccattgtttatggttctagtaataaccctcaaaggtgggtattatattatatttttggaaaacaccaaaaatgaagcttagagagattaagatatacatcaaaagaacacagaactgtgatctgaaatgaggtctcttggtcttcaaagttcatattttttctaaagggcaggtgtagaattcttacattgaagatgtcctttaagattctggagcaacttggaagaaatgaaaaagggaagagaaacatagagattaagactgggccaggtgtggtggctcaagcctgtaatcccaacactttgggaggtcaaggtgggcagatcacttgaggtcaggagatcgagagcagtctgaccaacatggtgaaacgccatctctactaaaaatacaaaa

SEQ ID NO: 95276 - DNA, 332 bp, Homo sapiens
ggtccactctgcgcggcagcaccgcaccccggagccgcagctcttcctcccgcttgcccgacagccctggtgccaagccctgtctgagccccaccaggaggaagcgcgtgctggctgctctccatctgctctgggactctggcctgctgcttcctctgcctgccactccccaaccccgtttcctcctctgaaaactggagctacacctgccccaacagggcagaattaccttaaatggcacaagacaattgtacagcagacccacctcttctccaaagttttcagggcccaaacccagacacctccttgcaggactcatggctaccgtgggc

SEQ ID NO: 95277 - DNA, 635 bp, Homo sapiens
aatgtctctggacattgccaaatgtctcctgaggttgggggagtgagaatcactgccccacagttacatcctggcagagttaagcaatgaaacaaaatcactggccattaataatactatatgattttcaattaagagcttatttacacaccaagtaccttagaaacctgatctcatcccatcctcatcaaaaccttatggtgtgtacaagctggaatgatgcctattttataggttagggcactgaggcacaaagagtttagtggatgcctagctgcacagtagtgaccgatagagcaggcatttgaagcctgccctgccatcttagtcagtgcaccgagatatgaagagcatttttaaagtgtgctaggctctttcattttcattacatgtccactgatatggtttgactctgtgtccccaccgaaatctcatgtcgaaatgcaatccccaccaggcctctcctccaacactgagaatcataattcaataagagatttgggtggggacacagagccaacttatatcaaaggaagaggaagaaataaaaggcatcaaaattggaaaggaagaagtgaaattatctctgttcagactacttgatcttgtatgtagaaaacctgaagattccacca

SEQ ID NO: 95278 - DNA, 762 bp, Homo sapiens
atttggaacaactcccatgtccttcctggtactaagtcaaaaactatgttcttgaagaatccaaatggcaggtcagggtacaagcaggactttttggttttttctttcctcatcagcctcactctcttcttttcatatctgcctcaagcggtcctaaggaattctctgattgatcgaagtcaagagagtgacttggaaattatgctgtaaggagtgatcaatattagcaaaagaaaggcttgtcttgtagaggtatcactcagaaacctctaatgagcctaaagctccttccataaaagcacaggacctcaaaggatgaagcagcctcttcagtatgtaccctagacacagaaagaatccagaagtagaagacagaagggatcaaagtacacggagagatacgaggccaaggagggactctcagctgcccaggcgcggtgatcttataataggcagacaaattccttggtactcctcttttcaagaggtagtaccctccccttgagtgcaggctgtacttagtggcttacttttgaaaaacaaaacacaacataaatactggtgtgtgatttctgaggctcaactgtaagaggcattgtggcttcctctttgcattttctctcattgatgaggacaacacaaggacactcagcagcccaatggacaggtccacatggtgaggaactgaggcttcctgacaacagcccacaccaatgtgccagcaacataaaggaactgtcttggaagtggatcctgcagccc

SEQ ID NO: 95279 - DNA, 689 bp, Homo sapiens
  misc_feature (629)..(629): n is a, c, g, or t
  misc_feature (633)..(633): n is a, c, g, or t
  misc_feature (638)..(638): n is a, c, g, or t
agcggggcatccaatcaacactttaaatataaaacttctaccttttatactatttcagtgataaaactaaaactacctctcagaatagcattttatgtttgtattattaaactcagcttttagtattatacatgtagattgaggcatgtaacataagaaatatgtaaataacttacaacatgctttggaaggacgtttgtatgtgtgtctttggttgagagagtggagcaataaaaaaagtgtaaatatagcatgctgaagacctgcatggataaaagatttcgcttctgtccctgatcgtatctttattcaattcagttctccacattgtgctatattttttcaattttgctttatgtttttcttttgtttgtttttaaagttaaaaggaaccttggaggttctccagtctatttttgcataaacagcaagtagtgccagaatcacacatagaacttctacaagttgttagatatgcccaggcttccgttcagtaaatgtggcttggaacccaggtatctggtttgttttgttttttaactttagaagtgattccgatgagcagtctgttgaggactaatacctttattaaaaggtttaataaaatcaaaccttttcatagaacaaanaccnaaaanacaccaccacaaaaaacccccccggggggggagcccgcaaagggggcgacc

SEQ ID NO: 95280 - DNA, 410 bp, Homo sapiens
agcggacagggtgtgcactatcatcgtaacagcagagacggagagcaagatgtgaggaggttaaaagtcagggtcagaagttcaggttgctctgaccctcaaatcaatttcaagcactgtttgtgacattttcctgtgttccctcgcttgatgttagtctttgcaatgaaccaccgaatcagacttcagggctcatgggactttggggtttcagtagggtcaggtcaatttctacctaccagtgtactgtcacctatgaggcaaaccattatctaggcgtttgagaacctcaaagttttgaagctctgaggggaaagagagaggatgaagcgctggggcccctgtgtctttggggcctgacatagctcaacctgtggcttcagggggaccgtgtgcagccaggtcacagt

SEQ ID NO: 95281 - DNA, 386 bp, Homo sapiens
gccatagtctagacacagtcccaacagtgagagactcaaaatgcctcaggaaaacagaccatgtgctgtcaggtaccaccaagagtcagacgcacagaaatagtgcatgtgtgagctgaggattctgtgccttgcacatggggtggagcatggagacccaggagcacatgaagcactgaccaagctgagggcctacagtgtaccttgcacatggggtggagcacagagccccaggagcgcatgacgcactgaccgagctgagggcctactgtgtgccttgcatgtggggtggagcacagagccccaggagcgcatgaggcactgaccaagctgagggcctactgtgtgccttgcacatggggtggagcacagagacccaggagcac

SEQ ID NO: 95282 - DNA, 735 bp, Homo sapiens
aatttaataaagatagtgctgaaagaattccttaggtaatctataactaggactactcctggtaacagtaatacattccattgttttagtaaccagaaatcttcatgcaatgaaaaatactttaattcatgaagcttacttttttttttttggtgacagagcaagactccatctcaaaaaaaaaaaaacctgcctgagaaagctcaatgctgttctgaaaacatactgttccagccaaaacctgtaaatagtgataggtccttaagccccctcttaaagcagttactttagaaagcttgcaattataaaccatttctctgcccctttgagatgcaaatctaccaccaagagctgtctcctcagctgagtttgaaatgcaaacattcagagagccagctcttgctccagcctctcagttgctgtgggagtgtaagggcctaactttggtggctgtcttgctccaactttcacaactacctcagtcgtaaagatacaagaagtttgtttctactctggataaataccaattagttaaaaaaaaaaaaaaaaaaacctgatgccttagtcatatggaccaaactcccccgtaacacctttcagtgtcttctttagtacaccccaacattttcaacaactcctgatttttgtttcccaaagtggagctcagttcacactggattctgttccctaatgcagtagttattactgaataaaatctgtctttactgcctttta

SEQ ID NO: 95283 - DNA, 294 bp, Homo sapiens
gaagacaggctgtgaggaagggtgtctcaggtggggagcgcaagccagagtaaggggagggtgtactgggccttttgtattaataggaaaaagacacaagttcaaaaagaaagtaaaacttaaaaacaaacatcctcacaaaggttgataaatattggcctggtcgtaggtgccccctggagaaaaatttacttgctactcacttgaacaatccaccgctccagtaaatagccattagtagtatgaggtctggtaatgaacatattacttaaaaccttcaccgtctgtcccact

SEQ ID NO: 95284 - DNA, 570 bp, Homo sapiens
ctttctcctaaggctgacaacaaggcatgtatgttcacattcaccacttattaaacacagtgctaaaagttttagtgcaaaaggcaaataatggaaataaaaagcatacagattaaaaagtaagaaataaaactgtccctatttgcccatgccagaactatgtaaaaaatcccagcaaatctaaaacaacaacaaaaagataaccacaacaaaactcctagaacaagtgagttcagcaaagttgcgtgataaaagataaacataaaaaaatgtattttatgtgctaatgatggacaccaaaattaaaattataattctatgacatgaaaaacttaaatgtatatctagcaaaatacgtataagacttagatgatcaaaactatacaatgctgaggaaaggaatcaaaggtgatctaaataaatgaagagatataccatgttcataaactggaagattcaataaagatgtcagttcttccaaaattgatttacaaatttaatgcaattcttatcaaagtcccaacaagatttttgtagatatagcatgttgtaaaatatatatgaaaaggc

SEQ ID NO: 95285 - DNA, 759 bp, Homo sapiens
agcggccggaccctgagagacacattaagggagcaataacctgttaaagaacaatagatgatagtcacagtctcaatctcatttgcttctcctgggaaggaaacactgagatgttgtaggactaaggacctcaggttgcatttggggcattgttcgaggggtttcccatgacccatgcaaccagcattttagctgcactagacttctcatggtttccagaatatatgtgaaattgtatgttatgttgccttacttctttgcttgaattcttataaatatcaccttttctctttagcttgatagtttcctcccctcaaagtgagcctaatggctttctctcctgtatgaaaccttatacacaattgtatctgatgtttagcatcttataggtatttgttcactaaatactaagccatgcactcagggatcacaaagagactgtaatactataaataatatctaatactccaaatattgatgaaattgaatggaactgaatgtgtgaacactaagccaagccttcaccagttaacaaaaaattatcttttgtgatctgagattcatatattttgtctacttttcattaagaataaagtgagaagcacattaacaatctcaccgttttagtagtaatcattttcaaagggacgttctattgggaaaggaagaatttgtatttaaggcaaggcaaattaatagatattaacttgtttcaaagcccacggtgaatcattgttaaagaatttattaataggccat

SEQ ID NO: 95286 - DNA, 382 bp, Homo sapiens
ccctctcaaaggtaagtattatacccatttcattcacggcaaaattgaagctcagggaaattttaaaatttgcctcagttcatataagcagtcaaaccaggattcaaaccaaggcaatctgactccagtctatccttaaatcccattattctataatatgtcctctaaaataatcattttcatagatcatgattcaccttctaaagtaaattttagttcacacagaagttatttagctattcagtaattaaaaggaacttgatggctttacatcaaattatattttatgaaaatgttgaggaattttatcagtatttgctttcctttcattttactctataacatgactgatgaaactgtgaacagatctccatggaaagtc

SEQ ID NO: 95287 - DNA, 378 bp, Homo sapiens
gtgctcctggacgcgctaatatgctcagtcactgcggctgtgggtgaggggacggacggaggggcttggggctccctcttcgggagctggatgctgaggggtagaaaaaagggggggtttatcataacacaacccccccccccgaacacagccttacactgaaaatagtgacacacagcgtcacacaggacatgatgtcacacacatacacacaacagccctagtggcccagatacactgggaggtgccacacatacctagccttgcagctgccacaggtcagaaccatgcacagacacacaggggcaccacgtcgtgtacacctagtaagatgtcacttacatggcgatccacacacacacagttatgtcatccaag

SEQ ID NO: 95288 - DNA, 675 bp, Homo sapiens
agcgggctgtgtcttccttgcccttttctccacttcataccttgttcatagtagagcctcagtaaatgtttatcgagtgaatatactaatgtaaacagagcgaattaatcggaatcagtagcaaccaagacatcaatgagaatattctgctttttagaaatagcatttattcaataaatatttactttttaatttaagttgtaaataggtaatatatgttcatgattgacaattcaggaactgtaaaagggtatacaggaaaaaatctccctcccagcacacttcagctacctcattgccctcctcatagacaacccaggtttcagtttattgtgtctccacccagtgatagtttaggcctatacacttaactgattcacatgccttcccccttaaccctaatggtagagagctatatacactgtcatgtacctatttccatccaccaatagacattgcgcagtgaatgtgcttctccaccctatgatcttcattccatgtactaccttaattcctcattgccatatatggtaacgtaacacaggtttgagggattaggacatggacatctttgggaagacattcttcttcttatttttttaaacagagtcttgctctgttgcccaggctggagtgcagtggcacaatctcagctcactgcaacctccgcctccc

SEQ ID NO: 95289 - DNA, 167 bp, Homo sapiens
tgttgcccaggctggccttgaactcctgggctcagacaatccttctgcctcggccccgcaaagcgctgggattgcaggcgtgagcctctgcttggcctaggagtgtgaattaagtccccactcagtgcccaggcctgagccccatgttgggaacacaggagtaagtg

SEQ ID NO: 95290 - DNA, 124 bp, Homo sapiens
catgattttccaaggagaaaacgcaaagccagcaggtatttagccttatccaagtgaaggcaattattaaagcacaaacagtccctctcaaagctgtgcattcacattctctttctctctcttt

SEQ ID NO: 95291 - DNA, 447 bp, Homo sapiens
ttctgtctgcctttccggcctgttgacgtggagacgcgcggggccttttcccttctgtctgcctttccggcctgttgacgtggagacgcgcggggccttttcccttctgtctgcctttccggcctgttgacgtggagacgcgcggggcgttttcccttctgtctgcctttccggcctgttgacgtggagacgcgcggggccttttcccttctgtctgcctttccggcctgttgacgtggagacgcgcggggccttttcccttctgtctgcctttccggcctgttgacgtggagacgcgcggggccttttcccttctgtctgcctttccggcctgttgacgtggagacgcgcggggccttttcccttctgtctgcctttccggcctgttgacgtggagacgcgcggggccttttcccttctgtctgcctttccggcctgttgacgtgg

SEQ ID NO: 95292 - DNA, 193 bp, Homo sapiens
tccagactcatggatccatccagtcatctatctttccactcattcatcttcccatacatttttccacgcatccatgcattttcccatctatccttctatctttcatcatccatcccgtcatcctccacctttccaccgatccttccatctttccatccatctttccttttttttttttttttttggagacgga

SEQ ID NO: 95293 - DNA, 826 bp, Homo sapiens
caatacttagagcacagggtttgttgcaagggtaaaacaaggctcaggtctcagcgtggtgcctgtcacctggtgtgcttcccagtacaggctggcattgtaggatgggcaaagccgacagtagctcttagccatcatgtgggagccaaattaaaattggcctgtggcatatggtgacagtattgttctgaatccacaattggaattcatggtctgacgaatacttttctctcttatttataaattcatttaattgcaaagtttctaaaagtacacacatcaaatcacatttagttatccacttaacaaatcatctcagtatagtgttaaatttatatgaagttgtgattgtcctaggaaagctaggggtaatggtccctttccatctgggccattttggggccactactagcatttgggcaactatctcttaccttttcttccctttcctctccctcaacccaacgcccagtttctgattttgttgcagagagctattttaattagccatgttaaatgttaattgttttggcagacaaaagaaacttgaataagcttttccttccaaaactcaagaactttgctttctaagagttaacattggaaagaatgtttctggcctggaaaatttaggtagcaacctgaaaaggaattcatgtcctacaggaattggaagttgggtagagagctcaatttcttttgagagagattaaaatatatacttctgtctgaaatagtaataaaaatctattttttcatctttttgctaacagcctcaaaatatgaatgattaaattcaaaatagatttagcactaaaaaaaaaaa

SEQ ID NO: 95294 - DNA, 267 bp, Homo sapiens
agaatcaaaaacttgtatgtatgggagtaactgagattattaacaaaaaaatatataactggtttccagactgactagtagtcagaatcatcagtgagactttgaaagtgtggatccaaggactttgacacagactttgaatttaggatatttagggattcattagattccacatttttaacatgctttctagatgtttcacctgcaccagttgggttccattttgtatacttatgtttgggaaccatatgtagctttgcttttgta

SEQ ID NO: 95295 - DNA, 712 bp, Homo sapiens
ggcgtcgcggacctttctccaggttttcagcctgtgatttgataaccgccgccgggtggcgtggagcgtcccgagacttcttccttcattgcagcccctcttcttttagttctagactgaagttcgaggaacgcaccacttggctgaaattaggatccagatttcccaaacttccttcggaggaaaaagccctaacgatggaggacagtgaattcctagcttatgtggaactactagatgaagtggaacaaggctcagtgagagcaaaagcatcttctgttagtctacatgcagaaagaacctggatggagaaaatgaaagttgaagacctaaatgtatgtgagcctgcttctcctgcccctgaagcaccagctacctctctgctgaatgacctcaagtacagcccatcagaggaagaggaggtgacatacacagtcattaatcaattccagcagaagtttggtgctgcgatactccatatcaagaagcagaatgtcctgagtgtggcagcagaaggagcgaatgtatgtcgccatggcaaactgtgctggctgcaggtggccacaaattgccgagtttacttatttgacattttccttctgggaagtcgagctttccacaatggacttcagatgatactagaagacaagagaattttgaaggttatccatgattgtcgttggctttctgattgcctctctcatcagtatgg

SEQ ID NO: 95296 - DNA, 404 bp, Homo sapiens
gaggtcctgattgtccttttccctacggtggtaccaatactaagaataatgcccacatctggcaaggactcactgtctaattggagagagagaggaaagcagggagatgaagagaaggggagggaagggaggaaaaaatgaagtaagaaaacattgtgaagcctctactggcatgtttaatcgtttgctatgtttgatgtgaacatcccagatcccagaaagccacagaagggaggacagaaaaaaacatgataaagatgtttgtgggaaagtaaaatcaatccggtgatactgtaagcaaaacatcctgcaatattaggtttaatgctaaataacgttctatgaaatatttatttaaaatctgtcatcttaattgggaaggtatttcagaatgcttcatatgc

SEQ ID NO: 95297 - DNA, 424 bp, Homo sapiens
gtgtgtgtatgtgtgtgtgtatgtgtatattctcactccaactgcattgtaagctccaagggcaacattctgtctcctatttctttttcttcctctaccacatggctggtgcatgattctgcaaaaaaaaaattggcactcagtacatgtggctgactgacagacacatatatttcagcctgcaagtcccacaggactataaattgctgcacgaggtatttgagttagaagagacagaagaagttatatttattaaaagtttgctctagccccgtgctatcatagatgctttctctctaatcctctaaacaatcccatgaggtaggcatcaccacccctacttcacagatggggaagccgtgccatgcccagggtctctgctggcctccagtgatagcacactgcagttctcatggcactcctg

SEQ ID NO: 95298 - DNA, 446 bp, Homo sapiens
ctacccagattactacaacttttaggtaaataatgtatatgccattttttctaaggctatctagccatttttgatatagaaaacaatattgtgtaagataagctgagcatatttttcacttcgtttttgttttgcaaaacaattttattggttttgttaatgccccaatcatcagtactgcttggtataagagccgagtttgaagaattatcatgttgcaaatgtattttgctcagttatttcaaattagtagacagaattgagaagtggaacattttagaaaaatattggttaatcatacttggaatttggttatgtaatatctctttctcttttggggaatacaaaggttcataaactagtgataatcttcactcttggaaccattagatgctatcatgatgttagcacagaagataaatttataatgttgcagtgaggtaagg

SEQ ID NO: 95299 - DNA, 336 bp, Homo sapiens
accatgtgggacactggtgggaagccccttagaaagtgcaggaagggaacacgtatagaatttgagttttttgtctgaaggggttgtttttttctttggtcattatggtgacttaggatttgcaagatggaactaatgcgtgacttaacatatattatttggattgctaatatttcagttaccaagttccaagtacctttcaaatgaaagcttttgctagtaataagatttacagaggtaatataagcaaacactaccctttaggttggtttgccaaactccctatcttcttaaatatgacatgttaatattctggatttaaaggacattaccaaa

SEQ ID NO: 95300 - DNA, 475 bp, Homo sapiens
gtggcgcgatctcagctcactgcagcctctgcctcccgggttcaagtgattctcctgcctcagcctcccaagtagctgggattacaggcatgcgccaccacacctggctaattttgtatttttagtagagatggggtttctccatgttggtcaagctggtttcaaactcccaacctcaggtgatccgcctgcctcagcctcccaaaatgctgggattacaggcatgaaccaccgtgcctggccccggccaattttttcattgttaaaaccctctcaggccctgccaatagatgacagtggtgtgcgtgtggggagaaggtggcctgccccaggtatctctacttagtggtggagtgatgcttcaaggactgaaagtgtagacccttagccagattactgcctgcctggagtcacctgatgaaatgctgaacctgttcggctgtcttgtccatctgtctctcccgcctgtaaaatg

SEQ ID NO: 95301 - DNA, 707 bp, Homo sapiens
tgcgtgtcttttcttctcccttgtcccctgcacctggcagaacctctgctcaatggaagataaagcgataagatggggatgtggccagtgctagtaaaagaccccttttaatcgctcacatttttggcacttgctatgtgctagacactggattaagcagctaacctgcattattttgcttaactcggtcagtgtttcatacagcagatagtagcgctattctcatttgatagacgcagaaagtgagcctcagagaggttagataagtggcccaggctcctccgtgagtaggtaatggccggggttcatcccaggtctgactgaagagtccatattctttacatctttgcctcactgcctcttcatgtaagctctggacctgccatcataagacaaatgggaagaggtgtcctaccttcctaaaggcattttccaaagtgatttctgaagatatctgatatgggcaactttccagaattagttcagttgttaaaggtttcacggatgaataaatggtgtgggggatgggggttgagaagaggtcagaaggagagacagcgtggagaatgatttccaaggctggatcttttctttatttgattctagtaaattttaacgaggcccttaataaaatcccagtgcttagcagagcctccacatttacaagttgccagacctggggcggaagaagggaagttggaatcctg

SEQ ID NO: 95302 - DNA, 435 bp, Homo sapiens
ctaaaatatccttcccactaaccaaagcaagttgaattaatgttcatttaactaccaaattactgcttcatccattaaaagttaacatattaaatgtgcttatgaaataatattttggcagtcgcattagaacacatatgaatgactattgttctcagaagaccaatcaataataacctgtgacaatcacacacgtcgataaacttttttctgtataagagccagatagtaggccaggtgcagtggctcatgcctgtaatcccggcactttgggaggcccaggcgggcagatatgttaggtcaaaagttcgagaccagcctgaccaacatggggaaatcccgtctctactaaaaatacaaaattagctgggtgtggtggcacgtgcctgtaaccccagctactcaggaggctgaggcaggagaattgcttgaacc

SEQ ID NO: 95303 - DNA, 344 bp, Homo sapiens
agcaatgaaacaatgcctacgtacagttttatttcatggcaacaacatactggtccttgggtcagatgtgtgaaactatttctcaaagaaaccgcatacataattgaggccctccgaagggttcccagttgaagttgccaggctacattcatttcaaaagcagagccatttgttatcatatttaaattaactctctgcacactgaacttgaattttagagtcctgcttacttataattcttaaaatagttgagaaaggggaaaacatgtgtctggaaaatggaaataaggtagtccccacaagggacagcagtggttctcatgcaggcctgaggtgaaacagcc

SEQ ID NO: 95304 - DNA, 158 bp, Homo sapiens
atcttggacaggctggtcttgaactcctgacttcgtggtccacccgcctcggcctcccaaagtgctgggattacaggcgtaagccactatacctggcccaaaatatttttaaaaatataaatagtacagcacacaacaatgtcaattttacatctggc

SEQ ID NO: 95305 - DNA, 317 bp, Homo sapiens
ccctcatttattttttttcattcattcattcattcattcattcattcattcatgatgttttggctgaatgcctggtatgtgtggtaaggagagaaaggaaaaaagcaagtcataattgcttcattcagaaactatggaacccggattcgaatggggagacaactcttggatacttgtagagttaagaataaaagtttaggattcagggccagaataataacagtaacagttaattcgacaggaatttctcaaaaggggtactcagggtgaggaggcactttcagggagtaaggtataacttaggttcatcctggaat

SEQ ID NO: 95306 - DNA, 637 bp, Homo sapiens
agctcaggctttagcgagcctggagggaagggaaggctgaggtctcctctgcctccgcagccacacggcccggcgcggggcgggccggcagtaaacctaagaaggctttattcatttcctggaaacgtttcctggaagcctggcatgtgctaacgatacaacattgaacaatacaaaggtccctgacacggagcttacgttgcgtccaccaggtagacaggacacatacaagatatgaagcatagtacatgtttaatctggatgagaagaggagaaaaataaaacaaggagggagaggcgacctgtcaggggccagggtggggtgagtggaagaaacggtgtccctgacaaggtgcctggtggcctcacccggaggaaagcacggtgcagaggaaacggttcagtctggtgcttgaagccccaggacccccgagagagccggacctggacgagcatgaagtcccgcaggaggaaggcggcccagagccttggaaaatccatctgtgctgagcctgggctgggctgcttcactggggcctccgggggcaggatcagccctggaaagggcacttttaaaccacgtgtgcagatgcccaccaagggaacaaggtcagaaggagccatggctccagaaggg

SEQ ID NO: 95307 - DNA, 556 bp, Homo sapiens
tccaaggagcctcagccaggatggcagttggtccccaggagcagaaatgaaatgtgctcccacccctggggaaactcaggtgtggaggccgtgggccaggcaagatccaggaaccacactgggcttgggaaacttggtgatttctaagaagactcaatgtcctttatttcctctctctgcagccttttgatatttaatcaagttaggggtgctaggaaggtggcagagcaaagcgtatgacctttggagggccttaaaaggccaggtactagatccctgtgtaatccccgggaagctacttcacctctctgagcctcagttgttcatgtattaaatgatgttattaatgtccgccacagggctaccggtaggatgaaataaaagtgtatctaatgtgttgagtacagtgcctgattcataataactggttaataaatggcaactgctatcattatgattaatttcaaatgctagtcaatctcagttgtccttaaaggaacaaaggaggttttgtggtccattctttggtggggtttgaagctggggggcaggtgca

SEQ ID NO: 95308 - DNA, 729 bp, Homo sapiens
cgcgcacgcgcaccggcccgcgcccagcctccgctaggggaccccctccgtggcttcccaccgggttgttccaggcctcagcttcgccgaaaggcctcaccacctccgacctccgcctgccccggggatgctcccagccctgctgcggcagaacgcgacgtgctaaccggaatccctaggccgcctgtctcctacccatacttggaggccccgctcagacggtcctgaaaacgtctgaaaggcggttcctgccagagtccctgctacctgttacctccacccctatttagtcctagtggacagcttcgctcaccttccctgggatgacacttctggcggctgagatgagcgagcctctctgggctctgccgccgggcgtgggctgacctgcctacagctggggcctgataaggcagcagcaaaagggtggaggggaggcagtgttgaagctggggcaagtaattttccccaatttacagggaaaaaccgaaattcagaaaagtttaatgtcagccaggggctggaacccagacctctggcagctgtcactttcacaatgcccttgggctgactaggctgcagaggggtttcaccccaaccccagggcacctcaagtggccccaccaaaccttcctaacacctgaccactaagtagggaggcctctcagggggctagctgtgctaggcccttgcaactgacctgtgggacctgaggcctggcccctcatg

SEQ ID NO: 95309 - DNA, 586 bp, Homo sapiens
ggccggctcttgaggatccccccgcggcgtgttcatgcacagaatacatgcaatggaaactgcatgtgcgaaggccttgagctgggaggaacatgacttcaggaactgaaaagtggccaaggtagccagacattgactgtgtgttgggagggtcttaaatgactccctcttgcctttagggtcaagtctaaccaactcatctctcaccacacttcccctctccgctccagccacactcaagtgaaggtcaggctccaactcctagtaaaagtgggggactgaccctgcaaggaagaaatacttcagaaaggctcgaagggtagggtggctttgggctttgggcctgactagggagcgaataacgaggttgagtttaaccgtctctcaacagaaggaaggaaaggatgcgtctacgccacaggcgtactccagtgcaaacagccaagttcatccattcatacacttcactcaagacatcctcatcctggtgtgacgggtggataatgagaaattacttaatggatacaatgtacattatttcagtgatggatacactaaaatcccagacttcaccatatgcaatata

SEQ ID NO: 95310 - DNA, 159 bp, Homo sapiens
ttagcataatggcgtcattaacacatacaatatataactcatacaaagcagctttgcagagtgccacaactgaggcataaacagagaggctgaaggcaaggaagagattaattatgacttgggcactcctagaaagtgtacaggaaagaggtcaagcag

SEQ ID NO: 95311 - DNA, 421 bp, Homo sapiens
gttaaaatgagagagcttctgattcataggagttataaaaataatatagtaattacaaagttcactttcgtgactcactttgctctaaattctggcactctacagggaaaccttctctgagttaaaatcccacttgctgtttctagtttgaaagtgtcaatgggtccacaattttgaggttgaatcattctgcaacacgagggcttgagggggaagcttggggacctgaagaatgacagttttcagtgtttgtatatgtctctttaaaaaagtaggaaataaattggctgatttgtcatgattacatcatgtgtaatacttgatcacagagtaccttgttttggatttgtatttatttttctccctcctgctcctatctaattgccctctccagaatgaaggcttccactgccttttggct

SEQ ID NO: 95312 - DNA, 812 bp, Homo sapiens
agcggggaatccccggccgtggagaacggaaagtggcctcgaccgtgctgccgagtgagaccgcgaggctggtgcctcgcacaggcggccccgcgcttcctccccaccctgtgggaggagagagtgtgtgcccggtttccccgttccacctcccctggtccgacgagcgataggggcaggtgggcgggggcggctggtcgcctggaagggagtcgccgccacgcaccggccgcccgccgctctccgggccctggcgcggggctgcggcctccgggtaaaatagaactgcacgggaaacccatagaagttgagcactcggtcccaaaaaggcaaaggattcggaaacttcagatacgaaatatcccggcctcatttacagtgggagataacctttggttgaattgagactgaacaggacttaccctcttaaaagaaatgcgtgttcaatttttccatgtgactcagcactagagatgttcacccaaaatgacggtgctggatagtttactagtccagtatggagtggtggagagctgtgagcaagtgaacactgactcggaaactgcagttgtaaatgtaacctattccagtaaggaccaagctagacaagcactagacaacctgaatggatttcagttagagaatttcaccttgaaagtagcctatatccctgatgaccatggccgccagcaaaaccccttgcagcagacccgaggtcgccgggggcttggggcaaaggggctcctcaaggcaggggtctcaaggatccgtatacgagcagacacccatgtgatctgcctctgagcctgccg

SEQ ID NO: 95313 - DNA, 359 bp, Homo sapiens
caaatttgagaaccactgctaaaagctcaagcttcagattgaccagcttttccatctcacctatcgcctaaagaccaaattggataaatgtgttcattacgacagatgggtactatttaaagatgagtaaacacaatatacttaggctcgtcagactgagagttttaatcatcactgaggaaaaacatagatatctaatactgactggagtattagtcaaggcttatttcacacacaattttatcagaaaccaaagtagtttaaaacagctctccccttattagtaatgcattggagggtttactttaccatgtaccttgctgagcactgtaccttgttaatctcatttacttgtaatg

SEQ ID NO: 95314 - DNA, 296 bp, Homo sapiens
tttaatcttaacatgattcagggtttaaagccaggtacactggtgcacacttatagtcccagcctgggcaacatagcaagattctgtctctaaaaaaataattaaaataaaaatactatatttagtgcatcattaaataaaaataaagatatgtaagtggttgtagtggcaaatgattatatttctgtatattcataatttattcctatgatataaattgaataatttaatgaatgcattttctctaatggtatattcaaaattaggtcatctcattagcaactgctaaagaaaac

SEQ ID NO: 95315 - DNA, 314 bp, Homo sapiens
ggagaaaacctagataatcttggattcagtgatactctttagatgccacaccaaaggcacagtctatgaaataaacaattgataacctgggcttcattaaaatttaaaacttctgctctgtgaaagacaatgtcaagagaataagagaatgagaagacaagccagagactgaaagaaatgcatcaaaagatacatctgatagaggcctgttatccaaaatatatcaagaataatgtacaaagtactcaacaataagaatgtctttgctttaatctgattttaaaaatgggccaaagaccttaacaaacacttca

SEQ ID NO: 95316 - DNA, 148 bp, Homo sapiens
agaggttaaggctgcagtgagccctgattgtgccactgcactccagcgtgggtgacagagcaaggcccatatccatgttcagactgattgaatcagtctttcatgggtagagcctggcatcattatttgggtaaaactcctttgaagt

SEQ ID NO: 95317 - DNA, 1176 bp, Homo sapiens
ccaggaggtatttgaacctcctcattatgagttatgcactctcagagggacaggagctacagctgactttgcagatgtggcagatgactttgaaaattaccataaactgcggaggtcatcttccaaatgcattcatgaccatcactgtggatcacagctgtccagcactaaaggcagccgcagtaacctcagcacaagagatgcttctatcttgacagagatgcccacacagccaggaaaacccctcatcccacccatgaacagaagaaatatccttgtcatgaaacacaactactcgcaagatgctgcagatgcctgtgacatagatgaaatcgaagaggtgccgaccaccagtcacaggctgtccagacacgataaagccgtccagcggttctgcctcattgggtctctaagcaaacatgaatctgaatacaacacaactagggtctagaaagaaaattcaaggtaagcagatgcccttggttccttttcctactttgtcgtattctgttttgttgcaactgtcttgtagttttttagggaatgtgctatttatccattatttcttgagatatgtgtttcatgacatttcacaattagaaatacgatgggttcagtgtttataggagagatgattctcgggatacatacctttaaaacaaatcttagtattcttaacatcaagaattgtactaaaatgtaatttagaaggacgtcaaattaataatctaaactttacatgttttaaggtaaagttttaatgaactatctccaaagaaatactcgaaaaaaaccaaggtttttaaactaagaaaatagaatattcagtctcagtatagctgaagttaatatttaaaactggtaactactttctttatgtaatttggcaacaattgtactcaaaattcgtacactaaatatttttggtactgacacaatttatagactcttatttttgcatgaatatgtagctcatctcatcaaaattaaatgcagcatgttaagtcaaattttatactataaaatttgaatgcaaaaggtttcattaatcccagttgtctacgtgtacatcgattttgtcatcagatatcacaatggctttactttttgctcttgattgtttatatctatattagcctaatttgtctccaattgaatctgcttgacagctaatct

SEQ ID NO: 95318 - DNA, 952 bp, Homo sapiens
ccaggaggtatttgaacctcctcattatgagttatgcactctcagagggacaggagctacagctgactttgcagatgtggcagatgactttgaaaattaccataaactgcggaggtcatcttccaaatgcattcatgaccatcactgtggatcacagctgtccagcactaaaggcagccgcagtaacctcagcacaagagatgcttctatcttgacagagatgcccacacagccaggaaaacccctcatcccacccatgaacagaagaaatatccttgtcatgaaacacaactactcgcaagatgctgcagatgcctgtgacatagatgaaatcgaagaggtgccgaccaccagtcacaggctgtccagacacgataaagccgtccagcggttctgcctcattgggtctctaagcaaacatgaatctgaatacaacacaactagggtctagaaagaaaattcaagagaagaactatttatacaaacatggggactgtgaaaagaaaattctatagtgaattgtgaaaagtggacatatttctaaattcattccactgcctttatccaaacttaagaattacagacatttgttattccttcggcaagacatccccgctgcacactgatatgttcatttcgtaatttggttgctggccaccaagtgctccttagtttttaaatacattttgagattaactggaaacttgaagaagaaattagttcccgattaagactatcccaactttatttttattgtcagtttcacttttgtttctatgttgttttatgtctttgttatataattgtacattgtgtgatatgtgaaaaaaaaacacgaattggatgaaccttgtgttacatgtacattgttttcattatatagacagttgagaatagtgcgttcctgaatgatttgaacatgctacagtgaaaagtgacagtgtggaccatg

SEQ ID NO: 95319 - DNA, 528 bp, Homo sapiens
agaagcacactgcaacatagtgaggcctgtctctacaaaaagtttaaaaaattatttgggcatagtggcacacgcctgtagtcccagctacttgggaagctgaggtgggaggattgcttgagcctggaagctggagcctgcagtgaactatcattgtgccactgtactccagcctaggcaacaaaatgaaatcctgtctaaaaataaatacatatgtgtgtgtaaggttgcagctgggcacaatgctttatgcgtgtaatcctagcacttttggaggcccagatgggcagattgctatagcccagtagttcaagatcagccctggcaacatactgagactctctaccaaaaaaaaaaaaattagctgagcatggtgatgcatgcctatagtcctagctactcaggagcctgaggtgggaggatcacttgaacttggaaggtcaatgctgccgcggtgagccgtgagctgtgagccatgagccatggttgtgccactccagcctgggtgacagagcaagaccctgcctc

SEQ ID NO: 95320 - DNA, 341 bp, Homo sapiens
cccagcgcaggcccagtggccggtgaggggagacgtggctctgggacgggggcctccacctgggtggggggatgctccagcttccagacccttggggagggggcactgcccaaactaagctggcactggggctgtgcatttgaaggtgatggtggttctaggtctgaggaggacaccctcctaacagcctcatccccaagctccgggctgtgttgtggcaatgggagggaggaagtctgaggagaccctggtgactgaacggaggagggagtgagttagacgctctcaagggctctgccacctcccggagccagcggcctgttactacatttaaaaaagcc

SEQ ID NO: 95321 - DNA, 450 bp, Homo sapiens
ggcacgaggggctgtgttttctttttgatgtcctttgcagtggatcacagctacctgctgagacagacaaggggagtggttcctgtgatgggatcagtcagatgcctgcctggccgcatcccctgaggggacttgggctcctcttagcattggcaggccggtataaacttccggctcagatcgagctatgcctgatgctgccttaagccttatgaggtcgccaaggaaccgcagaaactcctggagggcagagctgtgtctgccatcttcatcattgcattaccaccacccagcacagtgcctggcacaaaagagttgctcaataaataaatccggatgaatggataaatacatggataggcactttgaactacagatgagtttaaatactttgtgtttttcttagtcaaacatgtgcaattaagcatgtgataaatgatatgatgacca

SEQ ID NO: 95322 - DNA, 259 bp, Homo sapiens
gtcattcatgagggcctccacagcagctgtgcaaattagttgggaaagagatgcaaaggcacacagaggcctccagactccggaacagcgtaaaccacagtatctgacgacacagccaggaaacatgctcccctggaagggtaaataagaacccccacacagcatgtgaacagccacctgtagggacacgccatgtggccctccagtttcatcaggttatgaatgcagtgtgggttatgagaagcaccacacagaaatg

SEQ ID NO: 95323 - DNA, 464 bp, Homo sapiens
ccacggtggtgaaggcggtcatcctcttgtagcctagggttccttggccaaattgctagttgccgatgacctcggggctcggcttgcgagcaacactgggctggaatctgtctccaggaaacccaggcccttttattgttgctgtgtcccccagagggcagggccaagctgaggccattctgtcatgctcaggaaggtagaagatggcccaaagggaagcacacctgcagtaggagggggggcagcggtgggcagggcacagcttccctgcaggttagaccccctcgcaggccagctgcctgcccctgcaggaaccgtgggtctcgggagaggctgccatccctgcacatgacaggtaggcacattgccgggttctggacatgcccccagagcagcctctgcccaccccttcctgggtccctgactccgtccccctccgtgtgcccctccccagatcacgcgct

SEQ ID NO: 95324 - DNA, 605 bp, Homo sapiens
aggcagtgtgaagaaattaagagcagcaattggaccaaagtgtttgtagtgcactaaggttctacctaaggaatcgaaacacaactaaaatgcaattcttctaaatttttcgataacaaaccacaaaccacgactgggtgattctcattcataaatcaccatatgttcaaactgtttaatttttaacagtgcctcagtttaatttttttgtttacctatatattgtaaaggacattacaaaggatatagctgaacagccagatgaggatgatagagcaagatgtggagtagggggatacagagcctccctgctctctctgggtgtcccaccatcccagcctcgccatgtgttcagcaacccagaagctcccttttttttttttttttttttttgagacggagtctggctgtgtcgcccaggccggagtgcagtggcgtgatctcggctcactgcaagctccgcctcccgggttcacgccattctcctgctgcagcctcccgagtagctgggagtataggcgcacgccaccacacccggctagttttttgtatttttagtagagacggggtttcaccatgttagccaggatggtctcgatcttccg

SEQ ID NO: 95325 - DNA, 983 bp, Homo sapiens
acttggctatgtggcagatgctggccttgatgggagtccacagaaaatggggcctcactgactgcttgtccaggtatctcagtgggagggaatgggagtgggaaatggagtactcaaggccacaagacaggccgccatagaactttggccttggggaatgaaccaaagctagtttggagagtagggtgattggggtgatcacttttccctttaaaggtggcatgctgcaagaagaaaggctttgaagagtgatgggtagtcactaaccatggcactatgctatcttctaaccaacgttatggggtcctggaatgatcctaggtctgcactagaagaggtagacccagaggaccttgtctaacataccccttgcttcttgacttcttcccatacctgcgttctttccggcctcaattactgcctgagatgttacacccttccagcataaatgatgaaccgcttcatggtgcctgtagaggcctcttgcagagcaccctgcagtggtatggtttgtgtatgcctcactgcactgtagagaaatgaagagcatgaggggaaaaatgagtagggcctggacttttagctagttttgaacactgcagttgctatgacttggggttgttagcagccaaaagaggagctttcatgagagggcacagaatacataacttgtctgtttctttactatgacccatgagggttttagtaaaccaaaatgccaagtctaagataaactgccattccttggagtgagggttccatttacagcctgaatcacgacttttattttcctaatgccttctcttgcatcctcttagctgaaggttcctttaactggagtcttcacttagctgaggggactgaagaattgattctttacccttttacgtgggaaaaattaaagcaacatgttcgttcaggctgacaggacaaataagaggcagtagagggatagccagagcaggctagatcagaaaatatct

SEQ ID NO: 95326 - DNA, 245 bp, Homo sapiens
ctatgttgtccaggctggaactcctgggctcaagcaatcttcctgcccctgcctctgcctccctaagtgctgggattacaggcatgagccaccgtgcccagcagaattgctgttgattgagatggggagggctgtgagtggctcaggattgtggggcagggcatagatcaggagtattgttgagctgtaggcgctcatcagacctttaagtggagatgtagagtaagcaatagaatttaagtcta

SEQ ID NO: 95327 - DNA, 323 bp, Homo sapiens
tctctgtttggggcagagtatggcgtgagacgtattgagatggagcttgaggttaattaaagatgaagcatttgggtaaacagtccaggcacctgaccgtgtgcccagatctgtgccaggcactgagccaagaaggtaaattaatgcagcttgtaattactgagcacatgcaatgccaggctctgtattagagctgaatctaaccactctccttggcccagaggaactcattatcaagatgggacaagcagtgcaatgctagattacgtcgtcctggcccctaacttcaggaagattcagccttagtctttcccagatccctc

SEQ ID NO: 95328 - DNA, 526 bp, Homo sapiens
cggccctggtgggaggagactggatcacgggggcagtttcccccatgctgttctcgtgatagtgagtgggctcccaggagatctgatggctttgtgtttgacagttcctccttcacatgttctctctcctgtcgccttgtgaagaaggtgcctgcttcccttttcaccatgattgtaagtttcctgaggtctccccagccatgcggaactgtgagtcaattaaagctcttttctttgtaaattacccagtctcagggaagttctttatggcagtgtgagaacggactaacacagatgcgatttcagacaaaaccaaaactgcatataaatctaacatcacaggactgttactttaattccatttccaaattggaaactcttcatgggcttatagtaaactgtaaggaggggatcatttccaggcacctcctggatgctctgcgattagctggattaaccctaaactccatggtggggcccattataaacgcctccctgctctacaggatctaacgcacaccggaca

SEQ ID NO: 95329 - DNA, 721 bp, Homo sapiens
ggaattatatagcaataaggattattatgctacttagttcttaaataaaatatcttttgcatgttttatatctatatactcatttcccttatatacatgaatattttatacgtacatattctagaagatgtcatcagcccaaacttaacaaatcatgcttttgttttgtcagttcctgtaatgcagtgttttttctttttcattatcatcgccagtggggactctttagacagtttttttctaattactccctttcatgaaattttaatgtcacatatgtactgtatactattatagtatatcttttgaaggccacaaaccactgtaatgtctaagattttctgccccacaagagctcatttgtgtccctttggagatatcttccccattgaaaatgtatgctagagtactttctctcaattctacgccagtgaaataaatcaggtcgactctactggcttaagttattggttgtcccagacaagtaagaaagttataatccccaccttttttttctactttatgtagtcctgcttcaaattatttttatacagaaaggaattcaccctcttttcttcctagattaacaaaattaagaagtttgtcattttgtttcattttatttttaattgagaggcccgtaggagtgatgcactgattaaaacttgctttccattagccaggtaggattttgatgcccacttgctttcccagatgttga

SEQ ID NO: 95330 - DNA, 197 bp, Homo sapiens
atctgcccacctcggcctcacaaagtgctgggattacaggcgtgagccactgcacccagccgagtcacttgtttttcttgtgtgtttgttctaagtttctccatcacagtgtaagctccttgggaatgtggactctgtccacattgctagtcattgtgtctgcaggttctagagcagcacatagtgactattcctat

SEQ ID NO: 95331 - DNA, 358 bp, Homo sapiens
cttcaagtacttattattaaggaggcacagaaactacacacattctatgacttttctagccctgtttcctgaaggtaactaaaatttctacccttgaaaatactggttcttaatgagtataaatgcttttctcaaaactatggaagatcatactaatccttttattatagttaaagcattcagtgggacttggagtccacattcagtagtatcttgtttgaatgagaaattgtaaaataaaggcctttcctcacatgccaacttacggtcagggtggatttctttttggagaccgggtcttactctgtcacccaagcttaagtgcagtggcacaatcacaactcactgcagcatcaga

SEQ ID NO: 95332 - DNA, 413 bp, Homo sapiens
gtttgtcagagggttttttttttatacctgtcttggtgtatctgagagtaacatatctatgtctgggtgtgtttcagagacagagattgaaattcatcatctccatagccctcatctagatcaatatttcatgtttttaaatgataggcatttcaagaaaagaagataccaattttgaggagtatagtagacaaagggcatgactcactgcttgttcatgtaaatcttctacctttatcacaggacagaatatgctcagagcaccaggattctccttttccctccttaccaccctccatgtgcatggttggtgtgatggtcattttgatgtatccacttggctaagcagtctccagttattctatcaaactctaagtgttactgtgaagtattttatagatgtgattaaagga

SEQ ID NO: 95333 - DNA, 290 bp, Homo sapiens
aaaaaaacctccataaaaaaactccagacctagacagttttaggggaagttttactaagccttaaaacaacaggtatttctcttatctaactatattgtttcaaatagtagaaaaagaaaaacgctctatagtatataggtctggtacaatttggtatacaatctagacaagaacagtatgaggaaagaaaaatataactgaacctcaatatgaagataaatgtgacaactgcttataaaatattagcaaattgaatatatatatatatatatatatatattcaatctaa

SEQ ID NO: 95334 - DNA, 357 bp, Homo sapiens
gtgatgtaccccagcactagggaatgatgtgagtaagacctaatccctgctctcagggagcttatagcctatggcagcagcaacactagtaaaaatttactactttgataggtgcacatcttcctttggtcagcaattttctcaaaaccactgtaacattttactaaaatgctaagctttgattgtttttcaactacttcttgagagtttctgcatgtatgataagggcaagacattacactgaggtattgatgctgatgagcagcaaggctcactggctggtgaagggatactgattagcacaccaatgtgctgctcttgaacacacacctccacaaaattacaaattatcttcca

SEQ ID NO: 95335 - DNA, 940 bp, Homo sapiens
tcagtttcccctggcgtaaaacaaggctgcagatcttctatgtctggcattctccaacaagcaatacagggtgatggaaagagagctggagacaagagggacttggggctgaatccccgttccatctataccagcatcacactctattgggcgagtcacatctctgagcctctgtttcctcatctgtaaagaggggatattgtgaagtcacaggattattgtggttaataaatggtggggaggggggaggagtttacagttatagcccaataactggctcatcacttcacaggtagtcaaatgttcattacacttcggaaacttgcagcatgatttgcaaatattctgggtggggcgggggctgtctttccttttttatagggtccaaatgaagaatttctagtttttaattctgagaaagcccaatttatgtacttttttgttgcttgtgcttttggtgttatatttaagaaggctttgccgaaaccaaggtcatgaagatttactcatattttcttcaaagaggtttatagttgtacttcttacttctaggtctatgatccattctgaattgatttttacatgtggtgtgaagaagaggtcaaacttcattcttttacatgtgaatattcagtcgttccagcactgtttgttgaagaggctattctttccccattgaagagtcctggcactgttgaaaatcaattggccataatgtgaggattagtgtctagacactaaattccattcagttgatttatgtctgtccttatgacagtactacacaatcttgattgttgtagctctgtagtaagttctgaaattgggactcacagtgtgagtcctccaactttgctcttctttctcaagattgacaatttccatatgaattttaacatcagcttgtcaatgtttacaaaaaaaaaaggcctgctggaat

SEQ ID NO: 95336 - DNA, 476 bp, Homo sapiens
agcctcggcttcaccactgggcacacgtggagatgctcctcgtcttattccctctcgagctgctcttaatgcccagatagaccgaatttgcccccagaacaggagttccccatgccttcctcttccagggagatttcagtgagagcagcaagtcgaagcctgatgcagtttccaggtgtatagggcagaaagggatcgtctccccagcatggctttttgacagatagaaggcatcggtgtgacagagaaggaggctggatcctgggctacccatcaagctgcgggttactcagggaggaccgggggctgacagcccttagactaccctgactcatgcctggagtcagacataggagctcccttccccccaggccacctctgctgggatgtgcttgcccctccccaccccacctcagtttccccactgcacagtggacaccaagccgaagtcatagggtgtgggagcagtgagtctg

SEQ ID NO: 95337 - DNA, 314 bp, Homo sapiens
gagatggtgtcttgctctgttgcccaggctggagtgcagtggagcgatcttggctcactgcaacctccgcctcctgggttcaagcaattctcctgcctcagcctcctgagtagctgggattacaggcccgcaccaccatgcccggctactttttgtatttttagtagagatggggtttcaccatgttggtcagtctggtctcaaactcctgacctcatgatctgcccgccttaacctcccaaagtgagtaaaaatatttttagatatacaaaacccaaaagaacttatcaccagcagaaccacactgtaaaaaa

SEQ ID NO: 95338 - DNA, 712 bp, Homo sapiens
agcgatctagtaactttcagttaatcacccacagctggaaataggctcgctttcctctgaactgtaacacttggcttctaacagacttttatgccttatccccaccatgttcaccgtagaaaaatgagcaatgcagagaaacaagaaaggtagggataaaaaagagaaaaaaaagactcattatctcacccccagagacaaccaccatgaatgttcaagaatatgcctttcttgatgtttcctcttttcatatacatcatcgtcttccttgtcataattaaaagaagaaaagtagaaaatgctatcattattttctcaggtgccagatactatgttaagattttacaaccattatattctttaatcttcacaactactgtatgagtattttatttttatcttcatttgatagaaaaagaaacccagaggccactcgaggtggctcacacttgtaatcctggcactttgggaggctgaggtgagtgtatcatttgaggtcagaaattcgagaccagcctgaccaacatgatgaaaccccatctctacgaaaaatacaaaaaaattagccgtgcatggtggcacatgcctataatcctagctacttgggaggctgaggccagagaatcgcttgaacctgggaggcagaggttgcagtgagccaagatcgcgccactgcactccagcctaggcaacagagtgagactccgtcttc

SEQ ID NO: 95339 - DNA, 701 bp, Homo sapiens
  misc_feature (518)..(518): n is a, c, g, or t
tttttaaaaacgctgttggaaatctcgcgatggagggaggaggaggtatacccctagaaacacttaaagaagaaagtcagtcaagacatgttctacctgcaagttttgaagtcaacagtttgcagaaaagcaactgggggttcttacttactgggcttgtgggtggcaccctggtggctgtgtacgctgtagccacgccgtttgtaacgccagcccttcgaaaagtctgtttgccatttgtacctgcaactacgaagcagattgaaaatgttgtgaaaatgttgcgatgccgaagaggatcccttgtggacatcggtagtggggacggacgcattgtcatagcggctgcgaagaaagggttcacagcagttggttatgaattaaacccatggctagtttggtattccagataccgcgcttggcgagaaggtgtgcatggatctgccaaattttatatttcagatttgtggaagacatatgtaaagtgtgtcggtcagaaggaacacctgagaaaccgntttatcatccttgggtatgtactggcagtattaaagttatccatcatgaatggtaagtatacttttagaaaagtatgtaagtctgagctttagtttcgtcatgtatacagtaacagggatcatttcaaggacctttctcttggaatatttttaaaagttttggtttttcctggcacggctggc

SEQ ID NO: 95340 - DNA, 3371 bp, Homo sapiens
tttttaaaaacgctgttggaaatctcgcgatggagggaggaggaggtatacccctagaaacacttaaagaagaaagtcagtcaagacatgttctacctgcaagttttgaagtcaacagtttgcagaaaagcaactgggggttcttacttactgggcttgtgggtggcaccctggtggctgtgtacgctgtagccacgccgtttgtaacgccagcccttcgaaaagtctgtttgccatttgtacctgcaactacgaagcagattgaaaatgttgtgaaaatgttgcgatgccgaagaggatcccttgtggacatcggtagtggggacggacgcattgtcatagcggctgcgaagaaagggttcacagcagttggttatgaattaaacccatggctagtttggtattccagataccgcgcttggcgagaaggtgtgcatggatctgccaaattttatatttcagatttgtggaaggttactttttcgcagtactcgaacgttgttattttcggtgtgcctcagatgatgctgcagttggagaagaaacttgaacgtgaacttgaggatgatgcacgagttattgcttgccggttccctttcccacattggactccagaccacgtcacgggggaggggatagacacagtgtgggcatatgatgcaagcacttttagaggccgtgaaaagaggccctgtacatcgatgcatttccagctgcccattcaagcataaactttactgggagtgtttttctgaaatattgtagtcttccctgatcttgtagagacttacagctgtgtccttagcaaaggagcataattgtctttggtttggaatgagaaattactattactttccttaactgttggagaaaacaaacgaagaaaaacaggtagatttaaaatctgcttttgatgctattttcttaaaaattgtacttactgcctttccatgcacctggatgcatgaaaagatgaataagtgatggtcatggttatgggtaggaaaataagatgccaatagctcttcacattataaacaatatggcttaatgcctcgataaggagaaatgatttttaaagacagtatatattaccaactgtttgtagtatcctataactttgttcatacttaagttgtatctctttcctttttgtacttcatggcaaaattaattttctaaaggattcagagaggcgtttatattttataacatttattagaaataatttgttccaccactagattactgtattttatggaatctaagctgtatatgtgtacatttgtatacatgtatgtgtaaatgtaagcctgacgtgggttcagattccagttttgtcatcagcaagaggcctcggacccatgacttactgcctctgagccttggctttctgtgtatctctgccactgggataatggtacacataacagtggagtggggaccaatttctaaaactcatggcacctagtctttggtccataaatggtgtttgttattttagacactgagaaaaatcttattcacagaagttgcagattatttctgctagtcacttttttatttcttgagagctgccactcatttaatatttctcatttatgagaagagacttgactgatttagataaaagacgaattaaggaaaacctttgaacgtgagtagacaagcttcatatatctgtaaagtgaatattgaatggtagcttgagtcattcgtacttatcacagaaaagaattgaactcccagtcatacacctgtaactgaaataccaaactgtcttaatggagatgtaatgaagtaagatggtcacatctttaactaaacttataaaaattggtcagtttgatcattttcatttaaatgagaaacatctggggacacattcattcattcaacaaatatgtattcagtatctactgtagaagaagctctgagattctgcggtaaatagacatgcaaagcccctggcctcatggaattcctattctggaaaggagagacaaacaaataagcaagggaatcttagtgtgtgtggagttctctgaagtaaacagtgtgatggtgtagagagcacctgtgtgagtctgagatgaggggatgtgatgttgtggacttcagccaggtttttggcagctagtgtctgtccctttttcagtagctccagtcttcttatgaagaatgagttctttctgtggtgtgtgactttagtgggagggcagctcttgctctatgcctctcagttgccttccactgtaaccagtcctgtaactggtctgggcacactcggagggggatccatggtagctccttgccatgaagatgtgggtagaggagggttctgtggggcctcggaggtgttcaacattttctagaagtgttccttacggtagagtgccaactgtacatctagaagaaaggacagaattagcagattgattcaggccagaatcatccgtgagtgctatttcaagtgtagggactctctgatgagtaacaggatttacatcatcccaaagcatctccccacaaactactcattataaaagcaaaaatagcaactgcacaatggagacaccggatcccaccttcactgtgtggttactgccatcatcaagagcagaagggcctcctgggtgtctgtggagccctggtaagttcacagcttcacaggtggggtgttgccaaagaccacacaccgcactgctcatgagcacacatcagaggacccaccgccagggccactcggtccgataactgaagaatgttattgtcacgaaaaccaaagaaagactgagcaactgttttccgtctaaggagaccaaaggaatgttatggctaaatgcaaaaatggtcctggactggatcatacccttgggaaatgttatacagaacattattggggcaatgacagaatcacagtgttatttggaattattatattggaatacaatgttaaatttcctgaatataactgtgctgggattatgtatgaaaatatttttcttagaaaatacacactgaagtattaaggaagtaaagtagcatattgtatgcaaccttttctgcaatggtttaggaaaaaaatgttcaaagagaggaagagaacaaatgtgacaaaatgttgaaaatcggtaaacctgtaggccagctgcagtggctcacgcctgtagtcccaacactttgagaggctgaggtgggcagatggcttgagctcatgagttcaggaccagcccgggcaacatggtaaaaccccatctctacaaaattaggaggttgaggtgggaggatgatttgagtctaggaggcggaggttgcattgagccaagatcacaccaatgcagttcagcctgggcgataagtcttgtctc

SEQ ID NO: 95341 - DNA, 3347 bp, Homo sapiens
tcgcgatggagggaggaggaggtatacccctagaaacacttaaagaagaaagtcagtcaagacatgttctacctgcaagttttgaagtcaacagtttgcagaaaagcaactgggggttcttacttactgggcttgtgggtggcaccctggtggctgtgtacgctgtagccacgccgtttgtaacgccagcccttcgaaaagtctgtttgccatttgtacctgcaactacgaagcagattgaaaatgttgtgaaaatgttgcgatgccgaagaggatcccttgtggacatcggtagtggggacggacgcattgtcatagcggctgcgaagaaagggttcacagcagttggttatgaattaaacccatggctagtttggtattccagataccgcgcttggcgagaaggtgtgcatggatctgccaaattttatatttcagatttgtggaaggttactttttcgcagtactcgaacgttgttattttcggtgtgcctcagatgatgctgcagttggagaagaaacttgaacgtgaacttgaggatgatgcacgagttattgcttgccggttccctttcccacattggactccagaccacgtcacgggggaggggatagacacagtgtgggcatatgatgcaagcacttttagaggccgtgaaaagaggccctgtacatcgatgcatttccagctgcccattcaagcataaactttactgggagtgtttttctgaaatattgtagtcttccctgatcttgtagagacttacagctgtgtccttagcaaaggagcataattgtctttggtttggaatgagaaattactattactttccttaactgttggagaaaacaaacgaagaaaaacaggtagatttaaaatctgcttttgatgctattttcttaaaaattgtacttactgcctttccatgcacctggatgcatgaaaagatgaataagtgatggtcatggttatgggtaggaaaataagatgccaatagctcttcacattataaacaatatggcttaatgcctcgataaggagaaatgatttttaaagacagtatatattaccaactgtttgtagtatcctataactttgttcatacttaagttgtatctctttcctttttgtacttcatggcaaaattaattttctaaaggattcagagaggcgtttatattttataacatttattagaaataatttgttccaccactagattactgtattttatggaatctaagctgtatatgtgtacatttgtatacatgtatgtgtaaatgtaagcctgacgtgggttcagattccagttttgtcatcagcaagaggcctcggacccatgacttactgcctctgagccttggctttctgtgtatctctgccactgggataatggtacacataacagtggagtggggaccaatttctaaaactcatggcacctagtctttggtccataaatggtgtttgttattttagacactgagaaaaatcttattcacagaagttgcagattatttctgctagtcacttttttatttcttgagagctgccactcatttaatatttctcatttatgagaagagacttgactgatttagataaaagacgaattaaggaaaacctttgaacgtgagtagacaagcttcatatatctgtaaagtgaatattgaatggtagcttgagtcattcgtacttatcacagaaaagaattgaactcccagtcatacacctgtaactgaaataccaaactgtcttaatggagatgtaatgaagtaagatggtcacatctttaactaaacttataaaaattggtcagtttgatcattttcatttaaatgagaaacatctggggacacattcattcattcaacaaatatgtattcagtatctactgtagaagaagctctgagattctgcggtaaatagacatgcaaagcccctggcctcatggaattcctattctggaaaggagagacaaacaaataagcaagggaatcttagtgtgtgtggagttctctgaagtaaacagtgtgatggtgtagagagcacctgtgtgagtctgagatgaggggatgtgatgttgtggacttcagccaggtttttggcagctagtgtctgtccctttttcagtagctccagtcttcttatgaagaatgagttctttctgtggtgtgtgactttagtgggagggcagctcttgctctatgcctctcagttgccttccactgtaaccagtcctgtaactggtctgggcacactcggagggggatccatggtagctccttgccatgaagatgtgggtagaggagggttctgtggggcctcggaggtgttcaacattttctagaagtgttccttacggtagagtgccaactgtacatctagaagaaaggacagaattagcagattgattcaggccagaatcatccgtgagtgctatttcaagtgtagggactctctgatgagtaacaggatttacatcatcccaaagcatctccccacaaactactcattataaaagcaaaaatagcaactgcacaatggagacaccggatcccaccttcactgtgtggttactgccatcatcaagagcagaagggcctcctgggtgtctgtggagccctggtaagttcacagcttcacaggtggggtgttgccaaagaccacacaccgcactgctcatgagcacacatcagaggacccaccgccagggccactcggtccgataactgaagaatgttattgtcacgaaaaccaaagaaagactgagcaactgttttccgtctaaggagaccaaaggaatgttatggctaaatgcaaaaatggtcctggactggatcatacccttgggaaatgttatacagaacattattggggcaatgacagaatcacagtgttatttggaattattatattggaatacaatgttaaatttcctgaatataactgtgctgggattatgtatgaaaatatttttcttagaaaatacacactgaagtattaaggaagtaaagtagcatattgtatgcaaccttttctgcaatggtttaggaaaaaaatgttcaaagagaggaagagaacaaatgtgacaaaatgttgaaaatcggtaaacctgtaggccagctgcagtggctcacgcctgtagtcccaacactttgagaggctgaggtgggcagatggcttgagctcatgagttcaggaccagcccgggcaacatggtaaaaccccatctctacaaaattaggaggttgaggtgggaggatgatttgagtctaggaggcggaggttgcattgagccaagatcacaccaatgcagttcagcctgggcgataagtcttgtctc

SEQ ID NO: 95342 - DNA, 3574 bp, Homo sapiens
tttttaaaaacgctgttggaaatctcgcgatggagggaggaggaggtatacccctagaaacacttaaagaagaaagtcagtcaagacatgttctacctgcaagttttgaagtcaacagtttgcagaaaagcaactgggggttcttacttactgggcttgtgggtggcaccctggtggctgtgtacgctgtagccacgccgtttgtaacgccagcccttcgaaaagtctgtttgccatttgtacctgcaactacgaagcagattgaaaatgttgtgaaaatgttgcgatgccgaagaggatcccttgtggacatcggtagtggggacggacgcattgttatttttattgcatattattacttgttcacaaaaccatcctcccagacactttcatttcactgctgctgtgctagcccactgatggagagatgcagtggattttcagcaatgttttgttcgacctccccgggggttggctgacctagaatcaattatggaggtgttccaagtgaacctgaatgtctattctgatacttgaggtcatagcggctgcgaagaaagggttcacagcagttggttatgaattaaacccatggctagtttggtattccagataccgcgcttggcgagaaggtgtgcatggatctgccaaattttatatttcagatttgtggaaggttactttttcgcagtactcgaacgttgttattttcggtgtgcctcagatgatgctgcagttggagaagaaacttgaacgtgaacttgaggatgatgcacgagttattgcttgccggttccctttcccacattggactccagaccacgtcacgggggaggggatagacacagtgtgggcatatgatgcaagcacttttagaggccgtgaaaagaggccctgtacatcgatgcatttccagctgcccattcaagcataaactttactgggagtgtttttctgaaatattgtagtcttccctgatcttgtagagacttacagctgtgtccttagcaaaggagcataattgtctttggtttggaatgagaaattactattactttccttaactgttggagaaaacaaacgaagaaaaacaggtagatttaaaatctgcttttgatgctattttcttaaaaattgtacttactgcctttccatgcacctggatgcatgaaaagatgaataagtgatggtcatggttatgggtaggaaaataagatgccaatagctcttcacattataaacaatatggcttaatgcctcgataaggagaaatgatttttaaagacagtatatattaccaactgtttgtagtatcctataactttgttcatacttaagttgtatctctttcctttttgtacttcatggcaaaattaattttctaaaggattcagagaggcgtttatattttataacatttattagaaataatttgttccaccactagattactgtattttatggaatctaagctgtatatgtgtacatttgtatacatgtatgtgtaaatgtaagcctgacgtgggttcagattccagttttgtcatcagcaagaggcctcggacccatgacttactgcctctgagccttggctttctgtgtatctctgccactgggataatggtacacataacagtggagtggggaccaatttctaaaactcatggcacctagtctttggtccataaatggtgtttgttattttagacactgagaaaaatcttattcacagaagttgcagattatttctgctagtcacttttttatttcttgagagctgccactcatttaatatttctcatttatgagaagagacttgactgatttagataaaagacgaattaaggaaaacctttgaacgtgagtagacaagcttcatatatctgtaaagtgaatattgaatggtagcttgagtcattcgtacttatcacagaaaagaattgaactcccagtcatacacctgtaactgaaataccaaactgtcttaatggagatgtaatgaagtaagatggtcacatctttaactaaacttataaaaattggtcagtttgatcattttcatttaaatgagaaacatctggggacacattcattcattcaacaaatatgtattcagtatctactgtagaagaagctctgagattctgcggtaaatagacatgcaaagcccctggcctcatggaattcctattctggaaaggagagacaaacaaataagcaagggaatcttagtgtgtgtggagttctctgaagtaaacagtgtgatggtgtagagagcacctgtgtgagtctgagatgaggggatgtgatgttgtggacttcagccaggtttttggcagctagtgtctgtccctttttcagtagctccagtcttcttatgaagaatgagttctttctgtggtgtgtgactttagtgggagggcagctcttgctctatgcctctcagttgccttccactgtaaccagtcctgtaactggtctgggcacactcggagggggatccatggtagctccttgccatgaagatgtgggtagaggagggttctgtggggcctcggaggtgttcaacattttctagaagtgttccttacggtagagtgccaactgtacatctagaagaaaggacagaattagcagattgattcaggccagaatcatccgtgagtgctatttcaagtgtagggactctctgatgagtaacaggatttacatcatcccaaagcatctccccacaaactactcattataaaagcaaaaatagcaactgcacaatggagacaccggatcccaccttcactgtgtggttactgccatcatcaagagcagaagggcctcctgggtgtctgtggagccctggtaagttcacagcttcacaggtggggtgttgccaaagaccacacaccgcactgctcatgagcacacatcagaggacccaccgccagggccactcggtccgataactgaagaatgttattgtcacgaaaaccaaagaaagactgagcaactgttttccgtctaaggagaccaaaggaatgttatggctaaatgcaaaaatggtcctggactggatcatacccttgggaaatgttatacagaacattattggggcaatgacagaatcacagtgttatttggaattattatattggaatacaatgttaaatttcctgaatataactgtgctgggattatgtatgaaaatatttttcttagaaaatacacactgaagtattaaggaagtaaagtagcatattgtatgcaaccttttctgcaatggtttaggaaaaaaatgttcaaagagaggaagagaacaaatgtgacaaaatgttgaaaatcggtaaacctgtaggccagctgcagtggctcacgcctgtagtcccaacactttgagaggctgaggtgggcagatggcttgagctcatgagttcaggaccagcccgggcaacatggtaaaaccccatctctacaaaattaggaggttgaggtgggaggatgatttgagtctaggaggcggaggttgcattgagccaagatcacaccaatgcagttcagcctgggcgataagtcttgtctc

SEQ ID NO: 95343 - DNA, 1004 bp, Homo sapiens
tttttaaaaacgctgttggaaatctcgcgatggagggaggaggaggtatacccctagaaacacttaaagaagaaagtcagtcaagacatgttctacctgcaagttttgaagtcaacagtttgcagaaaagcaactgggggttcttacttactgggcttgtgggtggcaccctggtggctgtgtacgctgtagccacgccgtttgtaacgccagcccttcgaaaagtctgtttgccatttgtacctgcaactacgaagcagattgaaaatgttgtgaaaatgttgcgatgccgaagaggatcccttgtggacatcggtagtggggacggacgcattgtcatagcggctgcgaagaaagggttcacagcagttggttatgaattaaacccatggctagtttggtattccagataccgcgcttggcgagaaggtgtgcatggatctgccaaattttatatttcagatttgtggaaggtatgtaaggcagagaatggccctagagaaatccaagggaaaattttattattcaaaattagtatgactgagaactgaaaaatgtattaaaagaaaaataattaaaatccaagtgaatattctggcataatgaaatatgtaaaattgatacgttttacaaatagtctcctttagagagaagcttaaagtttttatatgataggtcttgtgaattccaagaatttatttactaaattaaaatgttgtcatttctgtttcttacaaaataatgagatttttcatctcatttggaaatcctataaattattattgataaatattagacttttccatttgtgtgcctgtgtgagtgtgtgtatgcatattcgtatatttagagagacacagagatggttgctggagaatcgtgctatcacggttatttcttatcctcataaagtataagatacttccaaatttatttgtactctaaaaactctaaaaatgccctgtaattttgctttaggaatgttccataaaatgctttttctt

SEQ ID NO: 95344 - DNA, 507 bp, Homo sapiens
ccagagtgctctttttaacaagtagtaatttttgctcaggtattttcagggactcttaaaaacaggaaattttgggatcatttcctctgactcactgctcactaaaataatagctgttactctccacagatgctgcagttggagaagaaacttgaacgtgaacttgaggatgatgcacgagttattgcttgccggttccctttcccacattggactccagaccacgtcacgggggaggggatagacacagtgtgggcatatgatgcaagcacttttagaggccgtgaaaagaggccctgtacatcgatgcatttccagctgcccattcaagcataaactttactgggagtgtttttctgaaatattgtagtcttccctgatcttgtagagacttacagctgtgtccttagcaaaggagcataattgtctttggtttggaatgagaaattactattactttccttaactgttggagaaaacaaacgaagaaaaacaggtagatttaaa

SEQ ID NO: 95345 - DNA, 661 bp, Homo sapiens
gacaaacaaataagcaagggaatcttagtgtgtgtggagttctctgaagtaaacagtgtgatggtgtagagagcacctgtgtgagtctgagatgaggggatgtgatgttgtggacttcagccaggtttttggcagctagtgtctgtccctttttcagtagctccagtcttcttatgaagaatgagttctttctgtggtgtgtgactttagtgggagggcagctcttgctctatgcctctcagttgccttccactgtaaccagtcctgtaactggtctgggcacactcggagggggatccatggtagctccttgccatgaagatgtgggtagaggagggttctgtggggcctcggaggtgttcaacattttctagaagtgttcctggtgggtttatagaggcattgatatggtttggctgtgtccctacccaaatctcatcttgaattcccacgtgttgtgggaaggacctggtgggaggtgattgaattatgggggcaggtctttcctgtgctgttctcatgatagtgagtaagtttaatgagatctgatggttattttaggggggagttttcctgcacagctctttttgcctactaccattcacgtaagatattccagccacatggaactgtaagtccaattaaagctctttcttttgta

SEQ ID NO: 95346 - DNA, 1839 bp, Homo sapiens
tttttaaaaacgctgttggaaatctcgcgatggagggaggaggaggtatacccctagaaacacttaaagaagaaagtcagtcaagacatgttctacctgcaagttttgaagtcaacagtttgcagaaaagcaactgggggttcttacttactgggcttgtgggtggcaccctggtggctgtgtacgctgtagccacgccgtttgtaacgccagcccttcgaaaagtctgtttgccatttgtacctgcaactacgaagcagattgaaaatgttgtgaaaatgttgcgatgccgaagaggatcccttgtggacatcggtagtggggacggacgcattgtcatagcggctgcgaagaaagggttcacagcagttggttatgaattaaacccatggctagtttggtattccagataccgcgcttggcgagaaggtgtgcatggatctgccaaattttatatttcagatttgtggaaggttactttttcgcagtactcgaacgttgttattttcggtgtgcctcagatgatgctgcagttggagaagaaacttgaacgtgaacttgaggatgatgcacgagttattgcttgccggttccctttcccacattggactccagaccacgtcacgggggaggggatagacacagtgtgggcatatgatgcaagcacttttagaggccgtgaaaagaggccctgtacatcgatgcatttccagctgcccattcaagcataaactttactgggagtgtttttctgaaatattgtagtcttccctgatcttgtagagacttacagctgtgtccttagcaaaggagcataattgtctttggtttggaatgagaaattactattactttccttaactgttggagaaaacaaacgaagaaaaacaggtagatttaaaatctgcttttgatgctattttcttaaaaattgtacttactgcctttccatgcacctggatgcatgaaaagatgaataagtgatggtcatggttatgggtaggaaaataagatgccaatagctcttcacattataaacaatatggcttaatgcctcgataaggagaaatgatttttaaagacagtatatattaccaactgtttgtagtatcctataactttgttcatacttaagttgtatctctttcctttttgtacttcatggcaaaattaattttctaaaggattcagagaggcgtttatattttataacatttattagaaataatttgttccaccactagattactgtattttatggaatctaagctgtatatgtgtacatttgtatacatgtatgtgtaaatgtaagcctgacgtgggttcagattccagttttgtcatcagcaagaggcctcggacccatgacttactgcctctgagccttggctttctgtgtatctctgccactgggataatggtacacataacagtggagtggggaccaatttctaaaactcatggcacctagtctttggtccataaatggtgtttgttattttagacactgagaaaaatcttattcacagaagttgcagattatttctgctagtcacttttttatttcttgagagctgccactcatttaatatttctcatttatgagaagagacttgactgatttagataaaagacgaattaaggaaaacctttgaacgtgagtagacaagcttcatatatctgtaaagtgaatattgaatggtagcttgagtcattcgtacttatcacagaaaagaattgaactcccagtcatacacctgtaactgaaataccaaactgtcttaatggagatgtaatgaagtaagatggtcacatctttaactaaacttataaaaattg

SEQ ID NO: 95347 - DNA, 3296 bp, Homo sapiens
tcgcgatggagggaggaggaggtatacccctagaaacacttaaagaagaaagtcagtcaagacatgttctacctgcaagttttgaagtcaacagtttgcagaaaagcaactgggggttcttacttactgggcttgtgggtggcaccctggtggctgtgtacgctgtagccacgccgtttgtaacgccagcccttcgaaaagtctgtttgccatttgtacctgcaactacgaagcagattgaaaatgttgtgaaaatgttgcgatgccgaagaggatcccttgtggacatcggtagtggggacggacgcattgtcatagcggctgcgaagaaagggttcacagcagttggttatgaattaaacccatggctagtttggtattccagataccgcgcttggcgagaaggtgtgcatggatctgccaaattttatatttcagatttgtggaagatgctgcagttggagaagaaacttgaacgtgaacttgaggatgatgcacgagttattgcttgccggttccctttcccacattggactccagaccacgtcacgggggaggggatagacacagtgtgggcatatgatgcaagcacttttagaggccgtgaaaagaggccctgtacatcgatgcatttccagctgcccattcaagcataaactttactgggagtgtttttctgaaatattgtagtcttccctgatcttgtagagacttacagctgtgtccttagcaaaggagcataattgtctttggtttggaatgagaaattactattactttccttaactgttggagaaaacaaacgaagaaaaacaggtagatttaaaatctgcttttgatgctattttcttaaaaattgtacttactgcctttccatgcacctggatgcatgaaaagatgaataagtgatggtcatggttatgggtaggaaaataagatgccaatagctcttcacattataaacaatatggcttaatgcctcgataaggagaaatgatttttaaagacagtatatattaccaactgtttgtagtatcctataactttgttcatacttaagttgtatctctttcctttttgtacttcatggcaaaattaattttctaaaggattcagagaggcgtttatattttataacatttattagaaataatttgttccaccactagattactgtattttatggaatctaagctgtatatgtgtacatttgtatacatgtatgtgtaaatgtaagcctgacgtgggttcagattccagttttgtcatcagcaagaggcctcggacccatgacttactgcctctgagccttggctttctgtgtatctctgccactgggataatggtacacataacagtggagtggggaccaatttctaaaactcatggcacctagtctttggtccataaatggtgtttgttattttagacactgagaaaaatcttattcacagaagttgcagattatttctgctagtcacttttttatttcttgagagctgccactcatttaatatttctcatttatgagaagagacttgactgatttagataaaagacgaattaaggaaaacctttgaacgtgagtagacaagcttcatatatctgtaaagtgaatattgaatggtagcttgagtcattcgtacttatcacagaaaagaattgaactcccagtcatacacctgtaactgaaataccaaactgtcttaatggagatgtaatgaagtaagatggtcacatctttaactaaacttataaaaattggtcagtttgatcattttcatttaaatgagaaacatctggggacacattcattcattcaacaaatatgtattcagtatctactgtagaagaagctctgagattctgcggtaaatagacatgcaaagcccctggcctcatggaattcctattctggaaaggagagacaaacaaataagcaagggaatcttagtgtgtgtggagttctctgaagtaaacagtgtgatggtgtagagagcacctgtgtgagtctgagatgaggggatgtgatgttgtggacttcagccaggtttttggcagctagtgtctgtccctttttcagtagctccagtcttcttatgaagaatgagttctttctgtggtgtgtgactttagtgggagggcagctcttgctctatgcctctcagttgccttccactgtaaccagtcctgtaactggtctgggcacactcggagggggatccatggtagctccttgccatgaagatgtgggtagaggagggttctgtggggcctcggaggtgttcaacattttctagaagtgttccttacggtagagtgccaactgtacatctagaagaaaggacagaattagcagattgattcaggccagaatcatccgtgagtgctatttcaagtgtagggactctctgatgagtaacaggatttacatcatcccaaagcatctccccacaaactactcattataaaagcaaaaatagcaactgcacaatggagacaccggatcccaccttcactgtgtggttactgccatcatcaagagcagaagggcctcctgggtgtctgtggagccctggtaagttcacagcttcacaggtggggtgttgccaaagaccacacaccgcactgctcatgagcacacatcagaggacccaccgccagggccactcggtccgataactgaagaatgttattgtcacgaaaaccaaagaaagactgagcaactgttttccgtctaaggagaccaaaggaatgttatggctaaatgcaaaaatggtcctggactggatcatacccttgggaaatgttatacagaacattattggggcaatgacagaatcacagtgttatttggaattattatattggaatacaatgttaaatttcctgaatataactgtgctgggattatgtatgaaaatatttttcttagaaaatacacactgaagtattaaggaagtaaagtagcatattgtatgcaaccttttctgcaatggtttaggaaaaaaatgttcaaagagaggaagagaacaaatgtgacaaaatgttgaaaatcggtaaacctgtaggccagctgcagtggctcacgcctgtagtcccaacactttgagaggctgaggtgggcagatggcttgagctcatgagttcaggaccagcccgggcaacatggtaaaaccccatctctacaaaattaggaggttgaggtgggaggatgatttgagtctaggaggcggaggttgcattgagccaagatcacaccaatgcagttcagcctgggcgataagtcttgtctc

SEQ ID NO: 95348 - DNA, 2265 bp, Homo sapiens
agcatcctggccgctgagcgcagcggccttggccgggctcagctcgcgtcctgccgcagtccctccgccgctagtcggagcgagcgcgagtgaggagacccccgccgggccactggcacttgcttctgcggcgagtcccacccacgaccgcagcccagcaactcgcaaacgcaacctgaagcctgggctgcgcagtgtgggagggcttcgcgatcttgggggacccattccgaacttgcagaggaccgtagctctcctggcctggagagtgtgaacaggattgtggactcttccaagattcacaatgatatggtgaatccaaagactggaaccaaaaagatttactcagtgctttagttttaacaacagtaaattgtctaccaacacccatcatggctaaaagtgcggaggtcaaactggcaatatttgggagagcaggcgtgggcaagtcagctcttgtagtgagatttctgaccaaacggttcatctgggaatatgatcccaccctcgaatcaacctaccgacaccaagcaaccatcgatgatgaagttgtttccatggagatactagacactgctggtcaggaagataccattcagagggaggggcacatgcgatggggggaaggctttgtgctggtctacgacattactgaccgaggaagttttgaggaagtgctgccacttaagaacatcctagatgagatcaaaaagcccaagaatgtgactctcatcttggttggaaacaaagctgacttggaccactccaggcaggttagcacagaagaaggagagaagctggccacagaattggcttgtgctttttacgagtgctctgcctgcactggagaagggaacatcacagagatattctatgaattgtgtcgagaggtgcgtcgccggaggatggtgcagggcaagacgaggcgacgcagctccaccacgcatgtcaagcaagccattaacaagatgctcaccaaaatcagtagttaggcagcccagctgaggtggaccaactaattggaaacactcttccccttctgttcccctttcaaaaataaaactctggcctctaataggttgggaagttttagcgtgttttatgcaatttcagtgctaacaatttcttcctttcctgcttgaataagatacactctaatggcatttgaacatgtaatcaccagagattctgaaatgactggtttatgttaagctatttttaggcatcttcaccttgctttaagtaggttgaagtttttgcaaaggcatttaaaaattcaatttcttgtcagatactacaaataattttcttaaaagtctaagatagcagaaaatacagtaaaaacacaggagaagaagctgagctattggaacaggaaatagaaggaactctagtttctgtttgaagtgaggattttctgaattatctaatatcatctaggttttctttaaaattttattttgttcttcagttcaagcatcttctcactaatgtttttcactataacagagaattcatttcaatttgagttggttctctcaatgatctattgatcattacaccctaactctccttccttggctcaaacaatattttccctataacaaaggcaataggacacaaaattcacatcctgctgggccttttttcatcaagtcagggtgatataaaaacattggaagtcttttcaccaaaccctgactttattgaatgctagtagaagatgtagaattagagacatctgatttgtttatcaccttagcagaaaaaccacagtccaaaagacaagcaaattaagaatggagcttaaccatgcctccattgggaagtctagactttgagccaggtacagtaagaaaaattagcctctgattcattaagtttgccacatgacttattttgatattttggatacattaactcacttaggagaattcagaaaagaatgggtgattaaagttcattacagctgaataaatgtgtctaaaacagactcttgtattctgaaagtacagtctacaactgataaaaccttatgattcttttctcccccattatgcccctatatatatcaagatttgggtactttattttagtagaaaatatatatcttttacatatgtatgtatttataaatgcatagatatatgtataaaaatttgtaagcgttagcggcattaattcaccaatgcatttggacaacttgatgtaactgactttattttatgtgactataataaaaagcataattttctcattctgtca

SEQ ID NO: 95349 - DNA, 1862 bp, Homo sapiens
taattagttataataataatgacacattataataaaaaaaaagaagagaggctaatcaacctaccgacaccaagcaaccatcgatgatgaagttgtttccatggagatactagacactgctggtcaggaagataccattcagagggaggggcacatgcgatggggggaaggctttgtgctggtctacgacattactgaccgaggaagttttgaggaagtgctgccacttaagaacatcctagatgagatcaaaaagcccaagaatgtgactctcatcttggttggaaacaaagctgacttggaccactccaggcaggttagcacagaagaaggagagaagctggccacagaattggcttgtgctttttacgagtgctctgcctgcactggagaagggaacatcacagagatattctatgaattgtgtcgagaggtgcgtcgccggaggatggtgcagggcaagacgaggcgacgcagctccaccacgcatgtcaagcaagccattaacaagatgctcaccaaaatcagtagttaggcagcccagctgaggtggaccaactaattggaaacactcttccccttctgttcccctttcaaaaataaaacaaaatattgcattctttgtttggattctgagaaatgtctgggcttcccattgtttctggcctctaataggttgggaagttttagcgtgttttatgcaatttcagtgctaacaatttcttcctttcctgcttgaataagatacactctaatggcatttgaacatgtaatcaccagagattctgaaatgactggtttatgttaagctatttttaggcatcttcaccttgctttaagtaggttgaagtttttgcaaaggcatttaaaaattcaatttcttgtcagatactacaaataattttcttaaaagtctaagatagcagaaaatacagtaaaaacacaggagaagaagctgagctattggaacaggaaatagaaggaactctagtttctgtttgaagtgaggattttctgaattatctaatatcatctaggttttctttaaaattttattttgttcttcagttcaagcatcttctcactaatgtttttcactataacagagaattcatttcaatttgagttggttctctcaatgatctattgatcattacaccctaactctccttccttggctcaaacaatattttccctataacaaaggcaataggacacaaaattcacatcctgctgggccttttttcatcaagtcagggtgatataaaaacattggaagtcttttcaccaaaccctgactttattgaatgctagtagaagatgtagaattagagacatctgatttgtttatcaccttagcagaaaaaccacagtccaaaagacaagcaaattaagaatggagcttaaccatgcctccattgggaagtctagactttgagccaggtacagtaagaaaaattagcctctgattcattaagtttgccacatgacttattttgatattttggatacattaactcacttaggagaattcagaaaagaatgggtgattaaagttcattacagctgaataaatgtgtctaaaacagactcttgtattctgaaagtacagtctacaactgataaaaccttatgattcttttctcccccattatgcccctatatatatcaagatttgggtactttattttagtagaaaatatatatcttttacatatgtatgtatttataaatgcatagatatatgtataaaaatttgtaagcgttagcggcattaattcaccaatgcatttggacaacttgatgtaactgactttattttatgtgactataataaaaagcataattttctcattctgtca

SEQ ID NO: 95350 - DNA, 809 bp, Homo sapiens
gggtttcactgtgtttttagtagagacggggtttcactgtgttagccaggatggtctcgatctcctgacctcgtgatccgcccgcctcggcctcccaaagtgctgggattacaggcgtcagccaccgcgcccggcctataatttttttttttaactccttcactgttgttggcagaatttagtttcttcctgttacaaggattgaggtcgccatttccttgctggtagtcacctgaggactgttcccagattctagagactgcctgcataccttggcttatcaccttccactgcctgcataccttggcttatgccctttctcctgcatcttccaagccagcaatggaagaggtaaccatccatcacggttttcccagaacaggctgatttgcgtcttctgtcctggcataaggatcccttcactctcggaagtgttccggattgtggactcttccaagattcacaatgatatggtgaatccaaagactggaaccaaaaagatttactcagtgctttagttttaacaacagtaaattgtctaccaacacccatcatggctaaaagtgcggaggtcaaactggcaatatttgggagagcaggcgtgggcaagtcagctcttgtagtgagatttctgaccaaacggttcatctgggaatatgatcccaccctcgaatcaacctaccgacaccaagcaaccatcgatgatgaagttgtttccatggagatactagacactgctggtcaggtgaataaagagttcagctaaaatatttttctggatcaaataaaactgagaaatctatgctatg

SEQ ID NO: 95351 - DNA, 384 bp, Homo sapiens
ttttgtttgttttgtttttaaccttgtgactaaagcaacaaatctaattgttgactaatgcacaataaacccattcaaatattacaatggttttttggccataatatgaaattggaaaattacttgaataaacataaaaaaatttatttgttttatatatcaaggaaatataaagcatttatagggttgtgtggagcatttcgctttccttaaaaagataggtgtgctaagcaaattaacaaattattttttgaaatgttgctcttttcttccacagctcttgtagtgagatttctgaccaaacggttcatctgggaatatgatcccaccctcggtaggtcaaattttgtttccttctcctcttcaataaaaatttatggcccc

SEQ ID NO: 95352 - DNA, 2319 bp, Homo sapiens
agcatcctggccgctgagcgcagcggccttggccgggctcagctcgcgtcctgccgcagtccctccgccgctagtcggagcgagcgcgagtgaggagacccccgccgggccactggcacttgcttctgcggcgagtcccacccacgaccgcagcccagcaactcgcaaacgcaacctgaagcctgggctgcgcagtgtgggagggcttcgcgatcttgggggacccattccgaacttgcagaggaccgtagctctcctggcctggagagtgtgaacaggattgtggactcttccaagattcacaatgatatggtgaatccaaagactggaaccaaaaagatttactcagtgctttagttttaacaacagtaaattgtctaccaacacccatcatggctaaaagtgcggaggtcaaactggcaatatttgggagagcaggcgtgggcaagtcagctcttgtagtgagatttctgaccaaacggttcatctgggaatatgatcccaccctcgaatcaacctaccgacaccaagcaaccatcgatgatgaagttgtttccatggagatactagacactgctggtcaggaagataccattcagagggaggggcacatgcgatggggggaaggctttgtgctggtctacgacattactgaccgaggaagttttgaggaagtgctgccacttaagaacatcctagatgagatcaaaaagcccaagaatgtgactctcatcttggttggaaacaaagctgacttggaccactccaggcaggttagcacagaagaaggagagaagctggccacagaattggcttgtgctttttacgagtgctctgcctgcactggagaagggaacatcacagagatattctatgaattgtgtcgagaggtgcgtcgccggaggatggtgcagggcaagacgaggcgacgcagctccaccacgcatgtcaagcaagccattaacaagatgctcaccaaaatcagtagttaggcagcccagctgaggtggaccaactaattggaaacactcttccccttctgttcccctttcaaaaataaaacaaaatattgcattctttgtttggattctgagaaatgtctgggcttcccattgtttctggcctctaataggttgggaagttttagcgtgttttatgcaatttcagtgctaacaatttcttcctttcctgcttgaataagatacactctaatggcatttgaacatgtaatcaccagagattctgaaatgactggtttatgttaagctatttttaggcatcttcaccttgctttaagtaggttgaagtttttgcaaaggcatttaaaaattcaatttcttgtcagatactacaaataattttcttaaaagtctaagatagcagaaaatacagtaaaaacacaggagaagaagctgagctattggaacaggaaatagaaggaactctagtttctgtttgaagtgaggattttctgaattatctaatatcatctaggttttctttaaaattttattttgttcttcagttcaagcatcttctcactaatgtttttcactataacagagaattcatttcaatttgagttggttctctcaatgatctattgatcattacaccctaactctccttccttggctcaaacaatattttccctataacaaaggcaataggacacaaaattcacatcctgctgggccttttttcatcaagtcagggtgatataaaaacattggaagtcttttcaccaaaccctgactttattgaatgctagtagaagatgtagaattagagacatctgatttgtttatcaccttagcagaaaaaccacagtccaaaagacaagcaaattaagaatggagcttaaccatgcctccattgggaagtctagactttgagccaggtacagtaagaaaaattagcctctgattcattaagtttgccacatgacttattttgatattttggatacattaactcacttaggagaattcagaaaagaatgggtgattaaagttcattacagctgaataaatgtgtctaaaacagactcttgtattctgaaagtacagtctacaactgataaaaccttatgattcttttctcccccattatgcccctatatatatcaagatttgggtactttattttagtagaaaatatatatcttttacatatgtatgtatttataaatgcatagatatatgtataaaaatttgtaagcgttagcggcattaattcaccaatgcatttggacaacttgatgtaactgactttattttatgtgactataataaaaagcataattttctcattctgtca

SEQ ID NO: 95353 - DNA, 2067 bp, Homo sapiens
gaattcccaaatttcttttgtttaaggattgtggactcttccaagattcacaatgatatggtgaatccaaagactggaaccaaaaagatttactcagtgctttagttttaacaacagtaaattgtctaccaacacccatcatggctaaaagtgcggaggtcaaactggcaatatttgggagagcaggcgtgggcaagtcagctcttgtagtgagatttctgaccaaacggttcatctgggaatatgatcccaccctcgaatcaacctaccgacaccaagcaaccatcgatgatgaagttgtttccatggagatactagacactgctggtcaggaagataccattcagagggaggggcacatgcgatggggggaaggctttgtgctggtctacgacattactgaccgaggaagttttgaggaagtgctgccacttaagaacatcctagatgagatcaaaaagcccaagaatgtgactctcatcttggttggaaacaaagctgacttggaccactccaggcaggttagcacagaagaaggagagaagctggccacagaattggcttgtgctttttacgagtgctctgcctgcactggagaagggaacatcacagagatattctatgaattgtgtcgagaggtgcgtcgccggaggatggtgcagggcaagacgaggcgacgcagctccaccacgcatgtcaagcaagccattaacaagatgctcaccaaaatcagtagttaggcagcccagctgaggtggaccaactaattggaaacactcttccccttctgttcccctttcaaaaataaaacaaaatattgcattctttgtttggattctgagaaatgtctgggcttcccattgtttctggcctctaataggttgggaagttttagcgtgttttatgcaatttcagtgctaacaatttcttcctttcctgcttgaataagatacactctaatggcatttgaacatgtaatcaccagagattctgaaatgactggtttatgttaagctatttttaggcatcttcaccttgctttaagtaggttgaagtttttgcaaaggcatttaaaaattcaatttcttgtcagatactacaaataattttcttaaaagtctaagatagcagaaaatacagtaaaaacacaggagaagaagctgagctattggaacaggaaatagaaggaactctagtttctgtttgaagtgaggattttctgaattatctaatatcatctaggttttctttaaaattttattttgttcttcagttcaagcatcttctcactaatgtttttcactataacagagaattcatttcaatttgagttggttctctcaatgatctattgatcattacaccctaactctccttccttggctcaaacaatattttccctataacaaaggcaataggacacaaaattcacatcctgctgggccttttttcatcaagtcagggtgatataaaaacattggaagtcttttcaccaaaccctgactttattgaatgctagtagaagatgtagaattagagacatctgatttgtttatcaccttagcagaaaaaccacagtccaaaagacaagcaaattaagaatggagcttaaccatgcctccattgggaagtctagactttgagccaggtacagtaagaaaaattagcctctgattcattaagtttgccacatgacttattttgatattttggatacattaactcacttaggagaattcagaaaagaatgggtgattaaagttcattacagctgaataaatgtgtctaaaacagactcttgtattctgaaagtacagtctacaactgataaaaccttatgattcttttctcccccattatgcccctatatatatcaagatttgggtactttattttagtagaaaatatatatcttttacatatgtatgtatttataaatgcatagatatatgtataaaaatttgtaagcgttagcggcattaattcaccaatgcatttggacaacttgatgtaactgactttattttatgtgactataataaaaagcataattttctcattctgtca

SEQ ID NO: 95354 - DNA, 2480 bp, Homo sapiens
gggtttcactgtgtttttagtagagacggggtttcactgtgttagccaggatggtctcgatctcctgacctcgtgatccgcccgcctcggcctcccaaagtgctgggattacaggcgtcagccaccgcgcccggcctataatttttttttttaactccttcactgttgttggcagaatttagtttcttcctgttacaaggattgaggtcgccatttccttgctggtagtcacctgaggactgttcccagattctagagactgcctgcataccttggcttatcaccttccactgcctgcataccttggcttatgccctttctcctgcatcttccaagccagcaatggaagaggtaaccatccatcacggttttcccagaacaggctgatttgcgtcttctgtcctggcataaggatcccttcactctcggaagtgttccggattgtggactcttccaagattcacaatgatatggtgaatccaaagactggaaccaaaaagatttactcagtgctttagttttaacaacagtaaattgtctaccaacacccatcatggctaaaagtgcggaggtcaaactggcaatatttgggagagcaggcgtgggcaagtcagctcttgtagtgagatttctgaccaaacggttcatctgggaatatgatcccaccctcgaatcaacctaccgacaccaagcaaccatcgatgatgaagttgtttccatggagatactagacactgctggtcaggaagataccattcagagggaggggcacatgcgatggggggaaggctttgtgctggtctacgacattactgaccgaggaagttttgaggaagtgctgccacttaagaacatcctagatgagatcaaaaagcccaagaatgtgactctcatcttggttggaaacaaagctgacttggaccactccaggcaggttagcacagaagaaggagagaagctggccacagaattggcttgtgctttttacgagtgctctgcctgcactggagaagggaacatcacagagatattctatgaattgtgtcgagaggtgcgtcgccggaggatggtgcagggcaagacgaggcgacgcagctccaccacgcatgtcaagcaagccattaacaagatgctcaccaaaatcagtagttaggcagcccagctgaggtggaccaactaattggaaacactcttccccttctgttcccctttcaaaaataaaacaaaatattgcattctttgtttggattctgagaaatgtctgggcttcccattgtttctggcctctaataggttgggaagttttagcgtgttttatgcaatttcagtgctaacaatttcttcctttcctgcttgaataagatacactctaatggcatttgaacatgtaatcaccagagattctgaaatgactggtttatgttaagctatttttaggcatcttcaccttgctttaagtaggttgaagtttttgcaaaggcatttaaaaattcaatttcttgtcagatactacaaataattttcttaaaagtctaagatagcagaaaatacagtaaaaacacaggagaagaagctgagctattggaacaggaaatagaaggaactctagtttctgtttgaagtgaggattttctgaattatctaatatcatctaggttttctttaaaattttattttgttcttcagttcaagcatcttctcactaatgtttttcactataacagagaattcatttcaatttgagttggttctctcaatgatctattgatcattacaccctaactctccttccttggctcaaacaatattttccctataacaaaggcaataggacacaaaattcacatcctgctgggccttttttcatcaagtcagggtgatataaaaacattggaagtcttttcaccaaaccctgactttattgaatgctagtagaagatgtagaattagagacatctgatttgtttatcaccttagcagaaaaaccacagtccaaaagacaagcaaattaagaatggagcttaaccatgcctccattgggaagtctagactttgagccaggtacagtaagaaaaattagcctctgattcattaagtttgccacatgacttattttgatattttggatacattaactcacttaggagaattcagaaaagaatgggtgattaaagttcattacagctgaataaatgtgtctaaaacagactcttgtattctgaaagtacagtctacaactgataaaaccttatgattcttttctcccccattatgcccctatatatatcaagatttgggtactttattttagtagaaaatatatatcttttacatatgtatgtatttataaatgcatagatatatgtataaaaatttgtaagcgttagcggcattaattcaccaatgcatttggacaacttgatgtaactgactttattttatgtgactataataaaaagcataattttctcattctgtca

SEQ ID NO: 95355 - DNA, 598 bp, Homo sapiens
ggcacgagctgaatagctgggattacaggtggccgccactatccccagctaatttttttgtatttttagaagagatggcgtttcaccgtgttggccagctggtcttgaactcctgacctcaagtgatagccctcctcggcctccccaagtgctaggattacaggcatgagccaccacccctggcttcattcttcaggaaaccatctagttcaatttagcttcaaagaatgtctttccctttttggtacagtgggatcttacctctggttgcatctaaaaagcaattctgaatttaagaatctttaaactcttgggactggttaagtggtttgagtctcaaagggacctaagtcatggagtgtctggaggtgctcagggtggcatcttggaaaagtaaatggaatggaaattcaagagcccacagcaatcccagataactcagaaatctcaaagagaagctgctttcaggtcttttttgagacagtcgctctgttgcccaggctgaggcaggagaatcgcttgaacccgggaggcgaagatttcagtgagccgagatcgcaccattgtacttcagcctgggctagaaaagtgaaattcc

SEQ ID NO: 95356 - DNA, 462 bp, Homo sapiens
tctgtaatggtggcagcatgcagagacctgaatgaagggggagtgggccatgtgaacgtttgcagaacggcagtccatgcaggaggaactgcaggtgcaaaggccctggggcaggaacaggggcatgcatagcacagtggagccccagcgaggccagtgtagcagcaagcaagcagcaagcaagcagggagagccgaaggaatgaggccagtgggagggcagaccctgtggagccttgggcatggccaggcaggctcactgtatcctagaggcaatgggaacttgctggaggatttttagccgatcagattcattgtgaaaagatcaacttggctgcaatggcaagagagaggcaggcaccgtgtccggggagaaatgctgatgactgggcccaggtcgtagaagtagagatgggcaaggtggacagagaaaaggttttaaagtagcaataatagtacttgc

SEQ ID NO: 95357 - DNA, 1384 bp, Homo sapiens
ttgaaggaaaaatatcaaatgctttgaattttttttctcttttttcaaaccctctgcagaggtaggaaggtatgaatttcttttttatgtcaagatgcaaaaacaaatcatgatgcttttgttgggagaatttttgtattcagtattttgtatgtacctttttttttttaaattggaaagcacaattcggtttaacatttagctttgcttgactccagtgtaagatgaagatgaccttgtcacagctcccctgacctgaagcagagcccttcccatcactgacagtgttgggggttgagagccccccagcagagcccttcccatcactgacagtgtgtcggcagctgagagctcccccagcagagcccttcccatcactgaacagtgttggcggctgagagccccccagcagagcccttcccatcactgacagtgttgggggctgagagccccccagcagagcccttcccatcactgaacagtgttggcggctgagagccccccagcagagcccttcccatcactgacagtgttgggggctgagagcccccctagcagagcccttcccatcactgacagtgtctggggctgagagccccccctagcagagcccttcccatcactgacagtgttgggggctgagagccccccagcagagcccttcccatcactgacagtgtctggggctgagagccccccagcagagcccttcccatcactgacagtgtctggggctgagagccccccctagcagagcccttcccatcactgacagtgtcgggttgagagccacccccagcagagcccttgccacgtacagagattttctgtcagcagtttcccagtatttcagactcataatctgtgtttagcactccagtgttctcttgtaatagccaggtctggaaacgacccatggaaagaggggcctttgtattctgctagaacacagagcatagtagtagatcacttttctgaagagctttttaaaatacagctaatcaaggagtttgcgatttctcttactttctacagctcagcagtgactaatgatgtgtgactatgcgaatgagtttgatgaattcgtaaaaactaagcgcttaaatggttatagaaatgaaaacatggatatttagaagcctttctatatacacagtgcagttgagatggtttacagcaaatttcgttttatttctgaaaatgttgtaaacatgtaattagtgaaagattttgtaaaacattgtcctgtatttttgtctgtaaatatattgcataagttctaagtataaatatgtcagtatcatgtatgttattttaaattgcctgtacgccactttacacattgacattcaaataaaagccaacacttcagtggcgtgtaata

SEQ ID NO: 95358 - DNA, 1930 bp, Homo sapiens
ttgaaggaaaaatatcaaatgctttgaattttttttctcttttttcaaaccctctgcagaggtaggaaggtatgaatttcttttttatgtcaagatgcaaaaacaaatcatgatgcttttgttgggagaatttttgtattcagtattttgtatgtacctttttttttttaaattggaaagcacaattcggtttaacatttagctttgcttgactccagtgtaagatgaagatgaccttgtcacagctcccctgacctgaagcagagcccttcccatcactgacagtgttgggggttgagagccccccagcagagcccttcccatcactgacagtgtgtcggcagctgagagctcccccagcagagcccttcccatcactgaacagtgttggcggctgagagccccccagcagagcccttcccatcactgacagtgttgggggctgagagccccccagcagagcccttcccatcactgaacagtgttggcggctgagagccccccagcagagcccttcccatcactgacagtgttgggggctgagagcccccctagcagagcccttcccatcactgacagtgtctggggctgagagccccccctagcagagcccttcccatcactgacagtgttgggggctgagagccccccagcagagcccttcccatcactgacagtgtctggggctgagagccccccagcagagcccttcccatcactgacagtgtctggggctgagagccccccctagcagagcccttcccatcactgacagtgtcgggttgagagccacccccagcagagcccttgccacgtacagagattttctgtcagcagtttcccagtatttcagactcataatctgtgtttagcactccagtgttctcttgtaatagccaggtctggaaacgacccatggaaagaggggcctttgtattctgctagaacacagagcatagtagtagatcacttttctgaagagctttttaaaatacagctaatcaaggagtttgcgatttctcttactttctacagctcagcagtgactaatgatgtgtgactatgcgaatgagtttgatgaattcgtaaaaactaagcgcttaaatggttatagaaatgaaaacatggatatttagaagcctttctatatacacagtgcagttgagatggtttacagcaaatttcgttttatttctgaaaatgttgtaaacatgtaattagtgaaagattttgtaaaacattgtcctgtatttttgtctgtaaatatattgcataagttctaagtataaatatgtcagtatcatgtatgttattttaaattgcctgtacgccactttacacattgacattcaaataaaagccaacacttcagtggcgtgtaataaaagctgattggagcgtgttcatacctgaggtgtggttcccttggcaaaggtgaatcaaggaaagagcatctcatttccagagggaatgtcagtggaaatgggggcttcgggacaaacttttgagatcaaattcattttttaaggaagtacagatatcaagactgagctttatttggagttagatagaaggcttaattcatgaaatgtatgtgacacattaggacaactttgctcttggaaacctttagcatcccaaggcattgttttgactcatcaaggcaagcatgatctggtgggtgcattttttttctaggagaagagggagagtgacagctttcctatttgccaggcacaagttagatattttcacacacctgatttcttttcatcttaacactccataaagtggggattggtggctctagtgtttcacttgtcaaaaatatctccaaactagccttccagagaacctgtgtccccatctttatagtttgtaaagttgtatatcctaacatcctatttctagcttgtatttataatttgta

SEQ ID NO: 95359 - DNA, 1205 bp, Homo sapiens
ttgaaggaaaaatatcaaatgctttgaattttttttctcttttttcaaaccctctgcagaggtaggaaggtatgaatttcttttttatgtcaagatgcaaaaacaaatcatgatgcttttgttgggagaatttttgtattcagtattttgtatgtacctttttttttttaaattggaaagcacaattcggtttaacatttagctttgcttgactccagtgtaagatgaagatgaccttgtcacagctcccctgacctgaagcagagcccttcccatcactgacagtgttgggggttgagagccccccagcagagcccttcccatcactgacagtgtgtcggcagctgagagctcccccagcagagcccttcccatcactgaacagtgttggcggctgagagccccccagcagagcccttcccatcactgacagtgttgggggctgagagccccccagcagagcccttcccatcactgaacagtgttggcggctgagagccccccagcagagcccttcccatcactgacagtgttgggggctgagagcccccctagcagagcccttcccatcactgacagtgtctggggctgagagccccccctagcagagcccttcccatcactgacagtgttgggggctgagagccccccagcagagcccttcccatcactgacagtgtctggggctgagagccccccagcagagcccttcccatcactgacagtgtctggggctgagagccccccctagcagagcccttcccatcactgacagtgtcgggttgagagccacccccagcagagcccttgccacgtacagagattttctgtcagcagtttcccagtatttcagactcataatctgtgtttagcactccagtgttctcttgtaatagccaggtctggaaacgacccatggaaagaggggcctttgtattctgctagaacacagagcatagtagtagatcacttttctgaagagctttttaaaatacagctaatcaaggagtttgcgatttctcttactttctacagctcagcagtgactaatgatgtgtgactatgcgaatgagtttgatgaattcgtaaaaactaagcgcttaaatggttatagaaatgaaaacatggatatttagaagcctttctatatacacagtgcagttgagatggtttacagccaaccgtgacaagtggtacgagctcga

SEQ ID NO: 95360 - DNA, 2980 bp, Homo sapiens
cccagagacccaggccgcggaactggcaggcgtttcagagcgtcagaggctgcggatgagcagacttggaggactccaggccagagactaggctgggcgaagagtcgagcgtgaagggggctccgggccagggtgacaggaggcgtgcttgagaggaagaagttgacgggaaggccagtgcgacggcaaatctcgtgaaccttgggggacgaatgctcaggatgcgggtccccgccctcctcgtcctcctcttctgcttcagagggagagcaggcccgtcgccccatttcctgcaacagccagaggacctggtggtgctgctgggggaggaagcccggctgccgtgtgctctgggcgcctactgggggctagttcagtggactaagagtgggctggccctagggggccaaagggacctaccagggtggtcccggtactggatatcagggaatgcagccaatggccagcatgacctccacattaggcccgtggagctagaggatgaagcatcatatgaatgtcaggctacacaagcaggcctccgctccagaccagcccaactgcacgtgctggtccccccagaagccccccaggtgctgggcggcccctctgtgtctctggttgctggagttcctgcgaacctgacatgtcggagccgtggggatgcccgccctacccctgaattgctgtggttccgagatggggtcctgttggatggagccaccttccatcagaccctgctgaaggaagggacccctgggtcagtggagagcaccttaaccctgacccctttcagccatgatgatggagccacctttgtctgccgggcccggagccaggccctgcccacaggaagagacacagctatcacactgagcctgcagtaccccccagaggtgactctgtctgcttcgccacacactgtgcaggagggagagaaggtcattttcctgtgccaggccacagcccagcctcctgtcacaggctacaggtgggcaaaagggggctctccggtgctcggggcccgcgggccaaggttagaggtcgtggcagacgcctcgttcctgactgagcccgtgtcctgcgaggtcagcaacgccgtgggtagcgccaaccgcagtactgcgctggatgtgctgtttgggccgattctgcaggcaaagccggagcccgtgtccgtggacgtgggggaagacgcttccttcagctgcgcctggcgcgggaacccgcttccacgggtaacctggacccgccgcggtggcgcgcaggtgctgggctctggagccacactgcgtcttccgtcggtggggcccgaggacgcaggcgactatgtgtgcagagctgaggctgggctatcgggcctgcggggcggcgccgcggaggctcggctgactgtgaacgctcccccagtagtgaccgccctgcactctgcgcctgccttcctgaggggccctgctcgcctccagtgtctggttttcgcctctcccgccccagatgccgtggtctggtcttgggatgagggcttcctggaggcggggtcgcagggccggttcctggtggagacattccctgccccagagagccgcgggggactgggtccgggcctgatctctgtgctacacatttcggggacccaggagtctgactttagcaggagctttaactgcagtgcccggaacctgctgggcgagggaggtgcccaggccagcctgggccgtagagacttgctgcccactgtgcggatagtggccggagtggccgctgccaccacaactctccttatggtcatcactggggtggccctctgctgctggcgccacagcaaggcctcagcctctttctccgagcaaaagaacctgatgcgaatccctggcagcagcgacggctccagttcacgaggtcctgaagaagaggagacaggcagccgcgaggaccggggccccattgtgcacactgaccacagtgatctggttctggaggaggaagggactctggagaccaaggacccaaccaacggttactacaaggtccgaggagtcagtgtgagcctgagccttggcgaagcccctggaggaggtctcttcctgccaccaccctccccccttgggcccccagggacccctaccttctatgacttcaacccacacctgggcatggtccccccctgcagactttacagagccagggcaggctatctcaccacaccccaccctcgagctttcaccagctacatcaaacccacatcctttgggcccccagatctggcccccgggactccccccttcccatatgctgccttccccacacctagccacccgcgtctccagactcacgtgtgacatctttccaatggaagagtcctgggatctccaacttgccataatggattgttctgatttctgaggagccaggacaagttggcgaccttactcctccaaaactgaacacaaggggagggaaagatcattacatttgtcaggagcatttgtatacagtcagctcagccaaaggagatgccccaagtgggagcaacatggccacccaatatgcccacctattccccggtgtaaaagagattcaagatggcaggtaggccctttgaggagagatggggacagggcagtgggtgttgggagtttggggccgggatggaagttgtttctagccactgaaagaagatatttcaagatgaccatctgcattgagaggaaaggtagcataggatagatgaagatgaagagcataccaggccccaccctggctctccctgaggggaactttgctcggccaatggaaatgcagccaagatggccatatactccctaggaacccaagatggccaccatcttgattttactttccttaaagactcagaaagacttggacccaaggagtggggatacagtgagaattaccactgttggggcaaaatattgggataaaaatatttatgtttaataataaaaaaaagtcaaagagg

SEQ ID NO: 95361 - DNA, 1513 bp, Homo sapiens
cccagagacccaggccgcggaactggcaggcgtttcagagcgtcagaggctgcggatgagcagacttggaggactccaggccagagactaggctgggcgaagagtcgagcgtgaagggggctccgggccagggtgacaggaggcgtgcttgagaggaagaagttgacgggaaggccagtgcgacggcaaatctcgtgaaccttgggggacgaatgctcaggatgcgggtccccgccctcctcgtcctcctcttctgcttcagagggagagcaggcccgtcgccccatttcctgcaacagccagaggacctggtggtgctgctgggcgagggaggtgcccaggccagcctgggccgtagagcctcagcctctttctccgagcaaaagaacctgatgcgaatccctggcagcagcgacggctccagttcacgaggtcctgaagaagaggagacaggcagccgcgaggaccggggccccattgtgcacactgaccacagtgatctggttctggaggaggaagggactctggagaccaaggacccaaccaacggttactacaaggtccgaggagtcagtgtgagcctgagccttggcgaagcccctggaggaggtctcttcctgccaccaccctccccccttgggcccccagggacccctaccttctatgacttcaacccacacctgggcatggtccccccctgcagactttacagagccagggcaggctatctcaccacaccccaccctcgagctttcaccagctacatcaaacccacatcctttgggcccccagatctggcccccgggactccccccttcccatatgctgccttccccacacctagccacccgcgtctccagactcacgtgtgacatctttccaatggaagagtcctgggatctccaacttgccataatggattgttctgatttctgaggagccaggacaagttggcgaccttactcctccaaaactgaacacaaggggagggaaagatcattacatttgtcaggagcatttgtatacagtcagctcagccaaaggagatgccccaagtgggagcaacatggccacccaatatgcccacctattccccggtgtaaaagagattcaagatggcaggtaggccctttgaggagagatggggacagggcagtgggtgttgggagtttggggccgggatggaagttgtttctagccactgaaagaagatatttcaagatgaccatctgcattgagaggaaaggtagcataggatagatgaagatgaagagcataccaggccccaccctggctctccctgaggggaactttgctcggccaatggaaatgcagccaagatggccatatactccctaggaacccaagatggccaccatcttgattttactttccttaaagactcagaaagacttggacccaaggagtggggatacagtgagaattaccactgttggggcaaaatattgggataaaaatatttatgtttaataataaaaaaaagtcaaagagg

SEQ ID NO: 95362 - DNA, 2725 bp, Homo sapiens
cccagagacccaggccgcggaactggcaggcgtttcagagcgtcagaggctgcggatgagcagacttggaggactccaggccagagactaggctgggcgaagagtcgagcgtgaagggggctccgggccagggtgacaggaggcgtgcttgagaggaagaagttgacgggaaggccagtgcgacggcaaatctcgtgaaccttgggggacgaatgctcaggatgcgggtccccgccctcctcgtcctcctcttctgcttcagagggagagcagggtggtcccggtactggatatcagggaatgcagccaatggccagcatgacctccacattaggcccgtggagctagaggatgaagcatcatatgaatgtcaggctacacaagcaggcctccgctccagaccagcccaactgcacgtgctggtccccccagaagccccccaggtgctgggcggcccctctgtgtctctggttgctggagttcctgcgaacctgacatgtcggagccgtggggatgcccgccctacccctgaattgctgtggttccgagatggggtcctgttggatggagccaccttccatcagaccctgctgaaggaagggacccctgggtcagtggagagcaccttaaccctgacccctttcagccatgatgatggagccacctttgtctgccgggcccggagccaggccctgcccacaggaagagacacagctatcacactgagcctgcagtaccccccagaggtgactctgtctgcttcgccacacactgtgcaggagggagagaaggtcattttcctgtgccaggccacagcccagcctcctgtcacaggctacaggtgggcaaaagggggctctccggtgctcggggcccgcgggccaaggttagaggtcgtggcagacgcctcgttcctgactgagcccgtgtcctgcgaggtcagcaacgccgtgggtagcgccaaccgcagtactgcgctggatgtgctgtttgggccgattctgcaggcaaagccggagcccgtgtccgtggacgtgggggaagacgcttccttcagctgcgcctggcgcgggaacccgcttccacgggtaacctggacccgccgcggtggcgcgcaggtgctgggctctggagccacactgcgtcttccgtcggtggggcccgaggacgcaggcgactatgtgtgcagagctgaggctgggctatcgggcctgcggggcggcgccgcggaggctcggctgactgtgaacgctcccccagtagtgaccgccctgcactctgcgcctgccttcctgaggggccctgctcgcctccagtgtctggttttcgcctctcccgccccagatgccgtggtctggtcttgggatgagggcttcctggaggcggggtcgcagggccggttcctggtggagacattccctgccccagagagccgcgggggactgggtccgggcctgatctctgtgctacacatttcggggacccaggagtctgactttagcaggagctttaactgcagtgcccggaacctgctgggcgagggaggtgcccaggccagcctgggccgtagagcctcagcctctttctccgagcaaaagaacctgatgcgaatccctggcagcagcgacggctccagttcacgaggtcctgaagaagaggagacaggcagccgcgaggaccggggccccattgtgcacactgaccacagtgatctggttctggaggaggaagggactctggagaccaaggacccaaccaacggttactacaaggtccgaggagtcagtgtgagcctgagccttggcgaagcccctggaggaggtctcttcctgccaccaccctccccccttgggcccccagggacccctaccttctatgacttcaacccacacctgggcatggtccccccctgcagactttacagagccagggcaggctatctcaccacaccccaccctcgagctttcaccagctacatcaaacccacatcctttgggcccccagatctggcccccgggactccccccttcccatatgctgccttccccacacctagccacccgcgtctccagactcacgtgtgacatctttccaatggaagagtcctgggatctccaacttgccataatggattgttctgatttctgaggagccaggacaagttggcgaccttactcctccaaaactgaacacaaggggagggaaagatcattacatttgtcaggagcatttgtatacagtcagctcagccaaaggagatgccccaagtgggagcaacatggccacccaatatgcccacctattccccggtgtaaaagagattcaagatggcaggtaggccctttgaggagagatggggacagggcagtgggtgttgggagtttggggccgggatggaagttgtttctagccactgaaagaagatatttcaagatgaccatctgcattgagaggaaaggtagcataggatagatgaagatgaagagcataccaggccccaccctggctctccctgaggggaactttgctcggccaatggaaatgcagccaagatggccatatactccctaggaacccaagatggccaccatcttgattttactttccttaaagactcagaaagacttggacccaaggagtggggatacagtgagaattaccactgttggggcaaaatattgggataaaaatatttatgtttaataataaaaaaaagtcaaagagg

SEQ ID NO: 95363 - DNA, 1640 bp, Homo sapiens
cccagagacccaggccgcggaactggcaggcgtttcagagcgtcagaggctgcggatgagcagacttggaggactccaggccagagactaggctgggcgaagagtcgagcgtgaagggggctccgggccagggtgacaggaggcgtgcttgagaggaagaagttgacgggaaggccagtgcgacggcaaatctcgtgaaccttgggggacgaatgctcaggatgcgggtccccgccctcctcgtcctcctcttctgcttcagagggagagcaggcccgtcgccccatttcctgcaacagccagaggacctggtggtgctgctgggcgagggaggtgcccaggccagcctgggccgtagagcctcagcctctttctccgagcaaaagaacctgatgcgaatccctggcagcagcgacggctccagttcacgaggtcctgaagaagaggagacaggcagccgcgaggaccggggccccattgtgcacactgaccacagtgatctggttctggaggaggaagggactctggagaccaaggacccaaccaacggttactacaaggtccgaggagtcagtgtgagcctgagccttggcgaagcccctggaggaggtctcttcctgccaccaccctccccccttgggcccccagggacccctaccttctatgacttcaacccacacctgggcatggtccccccctgcagactttacagagccagggcaggctatctcaccacaccccaccctcgagctttcaccagctacatcaaacccacatcctttgggcccccagatctggcccccgggactccccccttcccatatgctgccttccccacacctagccacccgcgtctccagactcacgtgtgacatctttccaatggaagagtcctgggatctccaacttgccataatggattgttctgatttctgaggagccaggacaagttggcgaccttactcctccaaaactgaacacaaggggagggaaagatcattacatttgtcaggagcatttgtatacagtcagctcagccaaaggagatgccccaagtgggagcaacatggccacccaatatgcccacctattccccggtgtaaaagagattcaagatggcaggtaggccctttgaggagagatggggacagggcagtgggtgttgggagtttggggccgggatggaagttgtttctagccactgaaagaagatatttcaagatgaccatctgcattgagaggaaaggtagcataggatagatgaagatgaagagcataccaggccccaccctggctctccctgaggggaactttgctcggccaatggaaatgcagccaagatggccatatactccctaggaacccaagatggccaccatcttgattttactttccttaaagactcagaaagacttggacccaaggagtggggatacagtgagaattaccactgttggggcaaaatattgggataaaaatatttatgtttaataataaaaaaaagtcaaagaggcaagtgtgtcttagggagtctactggcattatcactctccaccaaggaaggggtcccttagacctgtcccaaggtccctcctctaccctagcctatgaggtggctgtaggagtaaaactgtgagcca

SEQ ID NO: 95364 - DNA, 713 bp, Homo sapiens
agcactgctccttctctcacgccaactgagtctcttgatctgtacatgcaatcccaggcagctcgcgaacacaaacccggggccagccgcctactgctgctgctgctgctgccgctgccgccgccgccgccgccgctgcctccgccggctctgcgaacccgggacttttcatgcaccacactctccgcctgcttccctccgtgtcctgaaaagtgcgaccgttctcccaaggaatttccacggcaagtcttaggagggaatgattccccagtaatattccctgccctgacccaaagtgctggttggcctccctcccaggaagactgcttcttgcgtaacgccggccacagaaagagactccgatggacttacaccgggcagccttcaagatggagaactcatcctaccttcccaaccctctggcatccccagcactgatggtcctggcatccacggctgaggccagccgtgatgcttccatcccttgtcagcagccacgaccctttggtgtacctgtctcagttgacaaggacgtgcatattcctttcaccaacggttcctatacctttgcctctatgtaccatcggcaaggtggggtgccaggcacttttgccaatcgtgatttccccccttctctactacacctccaccctcaatttgtcccccaaatctagattgcacccaatcagtatgctgaatcatagtggtgtggg

SEQ ID NO: 95365 - DNA, 431 bp, Homo sapiens
tggagatttataatgcacaatagcatggtaaagcctctaagatgagatacatatacttatttaactttttattgttattgttttctgttcttttcttttctcttttaatagagacagagtctcactcactctgtcacccagaatgctcagtgcattcttgaactcctgtcctcaagggatccgcccacctcagccccccaagtagctggaactacaggcgtgtgccaccatgcctggctgttagtgttttcaaaacaatttttcttacaacacttactgtagtatttttcaaattacatgtcttgggtcataaaatcaattgagcaggttaggatcagcatttttcttgatgaaataaaatgtctaatagaagtggtcactgtgcatcctttttattgacggttactagtgtttgatgaaactttggctcc

SEQ ID NO: 95366 - DNA, 165 bp, Homo sapiens
aacaaactaaaaaactcataataagcatgtgaatccttcaccagcaaccaggttctctcatcaaaattgactagaaggatggtgtgacccatggagagaaggaagaacagtgtggtgctgcggcccacctgagagccaggcggggaaggggagcctcctcctcca

SEQ ID NO: 95367 - DNA, 1679 bp, Homo sapiens
taccaggctcactatcattgaaggagaaaccatattcaaaattgttaggctataattgttctgaatcatacattcaaaagtgtatgtgtcttatcaacataaagtattttaaaagattggaacactagaaaactaaataggatggctattgaggacaacaggcatagttttaccattttggtaccttctactgagttaatcttggtataaacatatttactttaaaagtaatgtcaaataaaaacctaaatgaaaaatgaaatagttttctatcaaggaatcatcttactgtatctctgtatcatttatggtgtatgtgttacatacattacaaatgttatttgatgtcatgatttctgaatccaaactggtatttgtcagctaagatttactgcttgagtacagtaataaaaatgaaaatagttttctgaaattttatgtttaaactaatttgttagttttaagatacagacacttgtgatagttatgatactgttttttttcttaaatattgttaaaatttgtattttctattgtatttttatttgcattctggtcaaatcttggtttctgagtttttctctgtattatctgtattaatgttagataacatagctatttttctaatataaaagttattttaagcagtttattcagaggggatattatttacctctgttaccctgtaggtctctaaacttttaagtagacttattttttaaaaagctactatactcccttctttctgaatcaaaaacattcagagataagaattagatggaagtaaagctccctgtggtttgtgctccatcacaattttttttttttttttttttttttttagtagaggcagggtttccccatgttggccaggctagtcttgaactcctgacctcaggtgatccccctgcctcggcctcccaaagtgctgggattgcaggggtgaaccaccacgcccagccttcatcacagttttttatggaaacagaatacaaagcagcaggaagctctaagtgtccagattcaagttttcatgttggtgccttctttaaatttacttttttttttttttctttttttgagacagagtcttactctgtcacccaggctggagtgcagtggcgcgatctctgctcattgcagccttcgtcccctgagttcaaatgattcccagcctcagcctcccaagtaactgggactacaagtgtgcaccactgcgcctggctcatttttgtgtttttagtagaaatggggttttgctgtgttggccaggctggtctcgaactcctggcctcacatgatccacccacctcggcctcccaactaaatttacttttaaaatgggatattcatcacctgagtattgtcaggcttgttactcttatctctgtttacagatcacttataagtcaaaggtattgtgtaagaacaaagtggtattttaaatgacaaaagggctttcatccttagtgcagccttatataattgagcacagtgattctgtctttggtcatctgtaatccacacaggtggatggttttatagattgatgtgtaatttgtgggggttatagaaacgattatattcatatagcaaagtctatatgtattatttgtagttcagagctaggatgattcagtcttgtctagttccacaaatggaaggagggtgtctgcata

SEQ ID NO: 95368 - DNA, 460 bp, Homo sapiens
ctcttatctctgtttacagatcacttataagtcaaaggtattgtgtaagaacaaagtggtattttaaatgacaaaagggctttcatccttagtgcagccttatataattgagcacagtgattctgtctttggtcatctgtaatccacacaggtggatggttttatagattgatgtgtaatttgtgggggttatagaaacgattatattcatatagcaaagtctatatgtattatttgtagttcagagctaggaaaactcaatgcagtccttcctgatcttgactcaggaaatcagtagttccaaggatgattcagtcttgtctagttccacaaatggaaggagggtgtctgcataaaaagataaggggaatcagtcaggaagcccattttgaatagcttcatgaatcccttaaattgttgctcacttcagcagaactcattaaagctatcacaattttta

SEQ ID NO: 95369 - DNA, 590 bp, Homo sapiens
acgattaccttatttaagcttcgtaccactgctatctcccttttacagatgaaacaaccaaggcttcagatgttgagtagcccaaggccatacaactcttaaatagtggggctgggatttgaatccagatctgcttttctccaaagcaccaagctgtgcttggtacctccttatgtagttcctacatccccagtgtgagacaactgggttatataaagaaatactgggtgcagtggggtgcttaaacatcaacatgggcttttaaatgtgggccggagaactgggctagtctagtctgccttctttccttccttcaacaaatgtttatgagtgcatgctgtataccaagggcttatctagacattgagaaatcctaggaagcaaaacagaccacacttactaagctatgtgacctgagcaaatcaccaaatgtgctagttattaagcaattgactttcacaccaacttgccttctgtatgtggctttgagatggtgcatctaagactctgcaaaccacatttctcctttgccgctagtccctgtgaagctctgccagggtgctagatagagggagactcaaggaaggaga

SEQ ID NO: 95370 - DNA, 364 bp, Homo sapiens
ttaaggaagccccagcaggctctcaggagggaatcttgtcttcagttccaggtgatggaagaagccacgcccagcactcagccagccccgagggccctagctgtgggaacaggctgagcaggttgctgggaaacccagctaaaggtgctcgggcaagctcctgccctgcacctgctgccctccacagagcacacaattgcttttcttttctttttgagatagagtctcactctttcacctaggctggagtgcagtggcacaatcagagctcactgcagcctcgacctcccaggctcaggtgatcctcccatctcagcgtcccgaatagctgggactacaggcacgtgacaccacacccggctaa

SEQ ID NO: 95371 - DNA, 430 bp, Homo sapiens
cactccagcctgggtgacagagctagaccctgtctctaaagataagaaataataaaaaatatatatatattaatcaaactcatatataaaaggttttggtgggataaaggactttagaccacagagcaatggctcttctgtctgttatgttttatttgcttacattcattcattttgatgatgctggtagtctcaaaaattaatggattttcaaaagatgttggccttttattgttgacatatttctaggaaacaaagtcttaatatcattattaattattcttaatttaaaaagacatttatgtctcttgattaattacaagcttacttttttcaaaaataatttgagacaagatgcagacattcatacagtattttatatatagtacatgaaagaaaaataatcaaggtgaagatgtaaaaaaggaaa

SEQ ID NO: 95372 - DNA, 333 bp, Homo sapiens
aaagaggatacataaggcatagttttgtcccaatagacttacatgaaaaaagcaggaggacaaattttaaaaaagaagcctttagagtatgccaaatttatttctttttttgagacaagagtcttgctctgtcaccaggctggagtgcgatctttgctcactgcaacctccacctcccgggttcaagcgattctcctgcctcagcctcccgagtagctgggactacaggtgtgcacccccacgcccagctaatttttgtatttttagtagagatggggtttcaccatgttggtcatgatggtctccatctcttgacctcgtcatctggctgcc

SEQ ID NO: 95373 - DNA, 230 bp, Homo sapiens
gtcataaggacgcccgggatacagcaagagaaaaagcaaagctgggaggaagacatgagtgcttaaaaaacaaaatcattggctgggcgcggtggctcacacctgtaatcccagcactttgggaagtcgaggcaggtggatcacctgaggtcaggagtttgagaccagcctggccaagatggtgaaaccctgtctctactaaaaatacaaaaattagccaggagtggtgg

SEQ ID NO: 95374 - DNA, 314 bp, Homo sapiens
aatcagtggatacttggtgagggcaccaagtatccactaacgtttcttagcttctctgtgtgtgtgcccattcataggcagatcctggactctgtctctaggagattaaatttaaaagatgctgggtcctaaagctcgacccagcatcatttaaactggaccgtgtcaatctggggggactggattgtgagtgggatgattgtaaccagaagccatagcaaagggtggactagccgcctaaacatagaaagagcagggcttccttctgcgtttcacgggctgcactgacttcatctgctcctgtggtgtgggct

SEQ ID NO: 95375 - DNA, 166 bp, Homo sapiens
cttcttccccaggattacttgtatctcccatgtcagtttggtgcttctagccaaaaagtggtggtcaaccctctaccttataaggcatctcaaaaccaacctcccagctgggcacagtggctcacacctgtaatcccagcactttggaaggccgaggcgggtggat

SEQ ID NO: 95376 - DNA, 345 bp, Homo sapiens
gcgactcatttagctacctatatttagttttaaccacacccaagatattcctagttgtctgaattcttgattcagatttacttaaaaatatgtaagtatttaatactactttttgaatcagaattgggatattgatcaaagcgaggaaaaaatgcctcttgtcaggtaaagttaatgcattttctttttttgcatgtgttatcagaagttttcaaaatttcagcttagagacctcttctaggacctagataattatttggaaactgcaaaactgcacaaaatttaaaaaaaatgaaaagctaagaagttttgtgttgtgatttggggtggaggagtattcatttc

SEQ ID NO: 95377 - DNA, 812 bp, Homo sapiens
ttgaggcggagtctcactctgttgcccaggctggggtgcagtagcgcagtctcggctcgcaacctctgcaccctaggctcaagcaacactcgcacctccacctcctgaatagctaggactacaggtgcacgcaccataccacacctggctaatttttgtatttttttatagagacaggggtcttgctatgctgcccaggctggtcttaaactcctgagctcaagcaatctgcatgcccaagccattggcccatcttggccttctaaagtgctgggattacaggcgtgagtcaccatggtcagcccatattaatttaaagtaggcttcaaatataattattcactaattgggaatgcctggggatgtatatgaatgtattaccgttttgtgagtagtagtgtgtgcttgtgttcatggatggcattcatcagaatgtttgcaatggtgtagccaggttacactgccatcttcctgttctcctttgtgcttacttgctctgcctgtatttgctgcagtttctagcgagtgtatgtaggtgttggcccagaacttgcttttgtagagatcatacattgtgctaatttatcccaaatcagtttttgtgtattatctgtgggcccaatgtgtaatttgaactttaaggatactacttcagactgcagtgtagcataacctttaaaaaaaaaaatgctagttttgccctaatctgtgcatattccagttgttcaatgggtattagtaatacatgaattacttctgtgccctttttggtgtagagtctcatatgaataattactgttatttaaaaccca

SEQ ID NO: 95378 - DNA, 397 bp, Homo sapiens
catgagccaccgtgcctggtcacccccctccttttttttttgagacggagtcacgctctctcaatcaggctggagtgcagtggtactatcttagctcactgcaacttccgcctcctgggttcaagtgattctcctgcctcagccttctgagcagctgggactacaggcgtgcgccaccatgcccaggtaatttttgtaattttagtagagatggggtttcaccatgttggccaggctggcctcgaactcctgacctcaggtgatccacctgcttcagcctcccaaagtgctgggattacaggcatgagccaccgcagccggcctagtttgtctatatcttaaccaaccacatccactgtgggtcttcttttttttcttttttggaaaaactttaaaa

SEQ ID NO: 95379 - DNA, 523 bp, Homo sapiens
cctggagactaaaggtacaaacatggatttctttaaaataactagtgggatgcttttgttgtgtgttccataaaactcttgcacttccctgtgtgtttattcattgaggaaacatttacgaaggacctcctaaaggccaggcactgttctaggcatttagttttaaccaggaccctcaatttctggactacaggacctgtgaggaggagaccgtgcaaatcactgtcccttctgtgtcttctgtgctcagcagaggccatggcacaaagcagggaagtaaccaacatttgttgagtccagttactgagcatggaggacacgggcgctctggacctgcctggagcctggagtctctgccccaacttctggtgacagcagcccacttttcctggggacaactgtttctccctcgttcctcctacttctgtgggggggggcgtggaggggactgccaatcatgggacctgcccacccacctgatccaaactgggccaatggcttcctcttgctcagggatttcaat

SEQ ID NO: 95380 - DNA, 231 bp, Homo sapiens
tggttgtctcctttatttttcttgggtggtgggcttgtcgatcaattcagtgatttctttaatggtcctggtatgtcctacatctggcaaaaattcctcatgtattttgattggttaataacaccattcctgtgatattttattacataaaaatggctttggtcattttaacaggattttgggaaggaggaggattaaattcacgggcacaagtgaacatcttcaactcaa

SEQ ID NO: 95381 - DNA, 470 bp, Homo sapiens
tgtggctcaactcttcctcctgggttcaaggaattctggtgcctgagcctccaagtagctgggactacaggcacatgccaccatgcccggctaatttttgtattttttttctgtagaggtggggtttcgcccatgttccccagactggtattgatctcctgggctcaagcagtgcactcaccttgacctcccacagtgctggattacagacatgagccaccaagcccagcaaaatattgttaatatcttcattttatagttgagaaaactgaggcatagagaaaattttaaaatgagattttgttgtttgtatgaaaacccacttttgaattttttccaggaataaaaggaatttcttttcttcagtatttcaacatactgtcatggtagttatataagttttcttaatagcatattgacagcttcctgtgaatttgcttattatacaactaaagttactattagttccc

SEQ ID NO: 95382 - DNA, 836 bp, Homo sapiens
tgagacaaagtcttgccctgtcgccaggctggagtgcagtggtgcaatctcggctcactgcaacctccgcctccagggttcaagcgattctcgtgcttcagcctcccaggcagtttggattataggcatgtaccaccattcccggctaatttttttttatttttagtagagacagggtttcaccatgttggccaggctggtcttgaactcttggcctcaagtgatccactgcctcggcctcccaaagtgctgggattataggcatgagccactgcaccctgctgtcatggtggttgtgatttttatttctctgatggctaataatgttgagaaccttttcatgtggtttttggccatttgtgtatctttggagagctgtctattcagatcctttgcccattttaaaataaggatgtctttttattattgaattataagagttctttatatagtctaaatacaagtcccttgtcagatatgattggcaaatatgttctcccattctgtgtgttgccttttcactttcttgatggtgtcctttacagtacaaaagttttaaattttcataaagtctaatttgtttttaattttttaacttgtgcttttggtgtgataatctgaggaagatgtttttaaccctactattgagcaagaatatggatatcacagttaattcatagtaattggttatagctcgtgaatgattcggccttgtctcttactgcctcttgtaattgctgggcaattatgccttctctacctggctgctacctagcctttacacagagtaccctgtctacttggagttcccttcctcccatctcatatgttcaaat

SEQ ID NO: 95383 - DNA, 364 bp, Homo sapiens
catgtctctgaacactattaaaagctcctttctaggaatgacatgttgaaaatgaaaatgcctctttggaatttcttcccaaacacatcagttctagcccacatttagattcattcaatccactgctccagtttagtaattgcaatggaagcttcttactatacattttctcgtctggactccccctgtcattttttcacctgtctgttttggataaaaatccttgaaatatgtctttctctgccccagagacatcataaatctggtgtatttcttgtttcttagatggaagtttccagtaattctttggactttcataagatccaagaggccagagatatttttaaatatataagaaacaatg

SEQ ID NO: 95384 - DNA, 576 bp, Homo sapiens
ggaagccgatggctctgggttcaaatcctcaagtacaaatggtgtgataccaggcaaagcatgacacctccctgacgctgggcacagtgactcacacctgtaaatcccaacacttctggaggccaaggcaagaggatcgagaccagcctgggcaaaatagaccccatctctggaaaaacaacaacaaaactttccgcgtggtggctcatgcctataatcaataggactttgggaggccgaggtgggaggattgcttgagtccagaagttcaagaccagcctgggcaacatggcaaaaccctatctttacttaaaaaacaaaataaaacacacacacacacacacacaaaaacctagctgggcagagcagcacatgcctgtagtgctcgggtggctgagatgggagaatcacctgagctcagaagatggcagctgcaataagctgagatcccgccactgtacgcaagcctaaacaacctgagtgagaccctgtctcaaaaaaacaaaacaaaacaaataccctccctgagcttcagttcccctaatggtaaaatagagaaaataatacctaaaaaaa

SEQ ID NO: 95385 - DNA, 410 bp, Homo sapiens
ctgatctggaattcccattctctcttacaacggactccccaaatatggcagagataggtaagttccacacgtgtcgaaacttaaatgaacacccacaaatggctcgatcgaggtaggaaacagtcaaaaggaaaccttttctgaatttagttctgaatccaaaatacaaaacccaagtttacaagtaagatgagaaggggagagaaaggttttgactggtaacagcacacagcccccaaaatcggctttgtcaaaggcctctgggaaccaaacacctccctgctgaggcaggatggcctcatggccggaggggctgcagacaatggggccagcacacgcctgtgcacccggtcccagacccaaagccactggacgtcccccttggactcagcaggaagaactgaaatgtc

SEQ ID NO: 95386 - DNA, 623 bp, Homo sapiens
atataaatcctttcagactaccagggaaccacttagggtttgaaagaatttatgtactttccaactgcctgatttaatagctgggacagccttaggcatttggtgactaaaagtcatagataccattgagattccaaataaattattgaaaaacataagggtgatgttttcagataccttctcaattaattattacatgtttttgtgttgtaacattataatggttctgtgccttaaagtattaccaagtaaataaaacagcaggaagctctctttggtgcagtattgaaattcttttaaaactggacttttaattaaaagttgtaatgcttttaatttattaagtgccttctgtgcagtattcattcagtacggtacataaagtactcttacaatactttgaaaataagtggttctagtttacctcttagtgagcattgaggattagggttcagatgacttacttaggctgacatggctggtaaggattggagttaggattcaatctgggtctttggctatagccattattctttccagtatattttaggaaagatctcctgttgtgtcctgaacaaagcagatggccagtcagtaaacaagggcacgagttcacttttaac

SEQ ID NO: 95387 - DNA, 353 bp, Homo sapiens
gaagagtcttcaatagcaccagtctgcacttcctagtgactttgggtcgccaatagaaaatgacagaaatggtcatctagaggacccaggactctcccacccagccaggataattgggttccttagtaaagcccaaggctagaccactccctaacctgatatgcatccctgaggcattatcctgagcagccactagatgtccataatgcctcatagggtgttccaggagtgagctgggtatcgttttgccaccaaataggctttgcggactcttttaagggtaggtccatcagtggcaggaacagaacaggagcaaagacataaaaggaatttgggaaactaaaaagaaaaaa

SEQ ID NO: 95388 - DNA, 522 bp, Homo sapiens
aactcttttacttgctcccctttgcaagaaaaactcctccttccccaaatcctctctcaaaaccactgccttagcctttgcctcccatgaggcttcccttaccagggcccccaaaaaccttgacttactgaatccaaggacctattctcaggccttattttactgaaccaagaagcagcatctgacccagctattactctttcctcctaactctctcttctcttagctttcaggacaacacactctgttgtttttcttcttggtcactgatggtttcttctcaattctcttcactggttgctcctacttgcctcatcctaactgtggaatgccccagcagaatgccccttggtcctctttcctctttatcctcaatgccatggtgatagcacagatttaaacaccctccgtatgccaataacttccaaatgtgcttctgcagccaagacctttctccagcactccacactcacatcgactgcctatttggtatctccactaggatgtcttgcacgcacatta

SEQ ID NO: 95389 - DNA, 287 bp, Homo sapiens
ccttatgttggcatctgcatgaaatctcttcttacaacagtgcctagttttcttttggaggagtgctcttccccagccctgcggtcgcgatggcagggccagtaaggaattcacaccctctgaacttgtgctaaaacggagctgctctgcgtcgtctatgggacctttctgccatggctggtaattaaatttggaagtataagccgaggactgatgacaactatcttactcatcacatagatgaggagcctatcaagaaagaaacaaatgagagagaagcagaacag

SEQ ID NO: 95390 - DNA, 547 bp, Homo sapiens
gtaagtacctactaggtactaggtgctgagattatagtgatggacaagacacaaatccagtctattcagcttaatgtctgggtggggagacagatgagggagcaggcaattactaaagaggatggcaggccaggacacgggagagcacacaattgggcagcaggggttgggagcagggcatgtcaggtaagacgttctagaagaaggtgatgtctaaatgaagggggaagagggcgaggcaggataatgcaaaggtccttttgaacttcatctgcaaattccatggggtgagagtatagctggaaagctgagattgggttctgtgctgatagcaggaatgacaagaaagactctgaataaaaaatccacacgtggaatcgtgaatgcttaaataatccaaggttgatggtggtaactcctatgctattcaaatgtggcagaaaataaaaaaaaaaaacatggaaagcatctcagctgattttacaaagttaaaataaccctgatagagagcagtatatggatactgggggttggaaattttaaaaaa

SEQ ID NO: 95391 - DNA, 471 bp, Homo sapiens
agtgttaaagcaaattaaaactattaaagcaaattaaaagtagttctttctagagtgttaggaaatttcgaagattatactaatttatataaagaattcaaaaattccaaaagaagccagacatccatcttgtttttcatgatttttcatcccctttgaatataaaaattagcaccaggacagaagactctgaattaccttttttccccccatctgatctggtctgtgcttagattttttgttgtcactttggctctgatgtgattattcgctgtatgagtgttgttaggcagtctgtcctctagggggcgccccgttactgccaaaacattttttattagcgatcattttaacccagctgccctgaacgcacataaggcagccccatgaagagagtagctcttttacctggagctcagggtacaatgggaggaattggaatatctcagcaccctgaaagtgtgaaatgtt

SEQ ID NO: 95392 - DNA, 298 bp, Homo sapiens
ggtgaaatgttgccaggaggggaggataagtagaaaggaaataaagaaagcactctggagcctgcttacctcccactgaggcctgacatttgggacacggtgggaagttggagaagggggagccaggggaagctgttggaatctgaagaaccagcagtcactgagaattctctgttgcccaccctaccctcactctggccaagggcagtgctcaacaacattggaaggttttctctttatgcctcccactagggcaactttgtaaatctttaccattctcaggacccaccttcctgca

SEQ ID NO: 95393 - DNA, 210 bp, Homo sapiens
gtgtcaattttctctccatcttttttatttttccttcccttttaaggcatgagtgtgtctcacctccatgtggtgcctggggatgtccactgtcattcatcctggaccagaaacagagtttagatatcttccaacctcctttccttcctcagccttgactaaccggagggctgcagagaggagggtgttgaccccctggctcttggtaac

SEQ ID NO: 95394 - DNA, 942 bp, Homo sapiens
aattaacctgcactttcaaaaagtaccatgtataggaatgaaacattgaggtcccactttattctgtctttagtacatggttttacttattttggggatggatagaaatatatttttgctagttctaggcttgaatcatgggctccttggctttcctagcatcccaaagcagtcaacagtgatttcttaagcaatttgatctgtacctttacttgtgaaaggtatgctatataattcagcaagtaccaacttgtgtagctgcagaataaccaagtggctatccagtcaagtaaatacagtttgcttacatacttcaacagtttcataaaacgattcccctgagtgacacaagaacataaaatgttaatatcactaatatagcctgttaaatcttttgtggagacaggtgcaaatcagaagattgacaaggaagaacttgagcttgctaaataagacttcctaaatttaaaagctctagttttgcttagtgtgaattctggcactttaaaaagattaagcaagtgaaattctgctgccctccaccatttatttttacagtgctttgtaatttttttcatcagttccttaaatgttatttggaggaaactaagttcttgacctcagtaattttatttttgtttttccctaaatgtttccctactagtctttttggaaaacatgtttgttttaatttcatcttccctcactttatttaggtagaatttttcccccttcatttctgaaattttttgctcaccgccatgtttaaatggggttgaatcatagcgagccatttgctcttgccaaagtgagatagatgtactgaggagataattgaaaagtcagactctgtactgtggggctttaatcggagcactgctggaaatgattgcagagaatgtagtgcttcatatatccatgaccaagattgacatgttgctc

SEQ ID NO: 95395 - DNA, 516 bp, Homo sapiens
tcctcccacttaagctttaagcaaattctcatttaaataagcaaagggggggcaggtggcttatttccagaatgagcaaaacaacactgttaataagaaaaacatttaatgcctttcgtttctattctgctactcagaattcaaaaaatctattaatcttctacctcactcaaaaataaaaatctataaactacggatcataagcaactcctgtttctgtgggtttcaccacattctccagaaactgaacttttgctcataaaaattacatagaatgtaaactaattcattttttaaagtaaatgcaaaactaagggttacacaagcactgagcatcaacactgacagaatattaattctgaagcccattaactttgacaaacgtttattcatctttgccttcttgaagcgtgtgactatcccagttttacaggaaaagcttaaacagaaaaagttaaataataatctcaaggttagaaactaagacataatttctagctcctagtatccctggta

SEQ ID NO: 95396 - DNA, 397 bp, Homo sapiens
aggaaaactgttcttgtgaaggaacaagaagcatagtgagtgcctgtagggagaaaaacccctgagagcagttagagacaaagagcaaccccagcccttgaaattcttctctttatcttagccaaaggagacactaaatcagagtgtctgttcagcagcaccatgctgtaagaggcacactccatgggtcctctgggcacaaacctctagccagtgttcttctcacacagttggactgttccctctggggcctcctccgccagcctatgatgggcaacactctgaatgtttgtgagaactgaggcaaacctggatggacttacagcaccactagtgctgaaaaggaggtagcaatccagcattaatggaactcagcaggcaaactgcaaagaacctc

SEQ ID NO: 95397 - DNA, 721 bp, Homo sapiens
taagtaatgagagtaatgagttataacttattcaataaaatgaaaatgtatgagtccatcctgatataaataactgaataaatgggagaaaaggaaaaggttttctttgtggtaaaatgccaattaatatcttaccaatagaaggaatgttggagttagaaagtcatgaatgaatgctaaaactagtgggtgaaaatatgatggggaagaagatatttggataatccaaaaagaacctctgataaattattgattacttataaatgaaaaaatggtacctttaaaagctagaaacctggtgaataccaaaccattttaaccaagtgatcaaagataacatcacctgggataaactgattgtcatttgtgtcctaataagactcactgagaaaaatcatactatcattcagtggtatacctgccttttggcagaatcttaatctaattctgaggaaacatcagacaaatcaaaattgatgacccttaacaaaagaactcgcccatgttcttcaaaaatatcaagcttaagaagcatagtctgaagaactgttacagacaaaagcaaactagagagattgatagttgtacaatgcatgcttctttattggctcaaataaaggagctagaaggacattactgaaatataggtgaaatttgaatgtggaccaaggattagataatagtgtttgattcatgttaaatttcctgatttttgttttgt

SEQ ID NO: 95398 - DNA, 414 bp, Homo sapiens
gaggtaaacggatctgacgtacagtcctgctcagcctcttggctgggtgaccttgggtacactgtcccaccaggatctgtttgttcatctataaaatgaaaaggttggactcaggtttcttctgcctcagatgttccataagactaggaggctgcgctgcctaaagttcgtgcacctagagtgctgcctctggtttcaccaacatggaaatattaacaggccagagcccaagtcaagaactcaagaggacacgcctcttcctcctgccagagtaccttggacaaaagtattcactgctaagcacgtagaactgaattcttcagtctaagacggaggtcccatttctctctttttttttttttttttttagacagagtctcactgtttggctcaggcgggagtgcagtggcgtga

SEQ ID NO: 95399 - DNA, 779 bp, Homo sapiens
ccttaagtaggttactgaattctctgagcctctgtttccttatgggtaggaactatctcacaaggctgtgataacaactcaggtcatggcaggtaaagggccagtcccatgacaatggcggagtgatgctcatcgaatggtagctattactgtttacataggttaagataaatcggtcaccactgcctcttataaattgaaaagaaatccctctcatacttataagctattgtattcagggttatcagtgagatgtgggttgagttatctgatcaggtagataagggactgccccttggaagcttttaagcatacctgtggaggagagcagccacgcaagaattctgaaaatccattcgtggcatcaagtgagagagcacgccgccattccagactctaggacattcttggagggatgacgatcattttgacagtgcacgggggacctgcctggcatgttgataaaatcgtccaggagattttgcaagagctaaaacgctgaagctgctccctgagacctggccttcgtctcatatatgcagttctcttcagatggaagagagcaggtgccatgggtcctggactgggtgaagcaggtcatttggttctggtgttcaggccacactaagaaccaagtattcccagtgtacctagtgaaaacaggctataagtagcctaaaaacgattttttaaaagatttttaaaaattgtttttagttgttgttttgcccttgctaggaataaaacaggaccgagaagccctagagctcgtaggaacc

SEQ ID NO: 95400 - DNA, 387 bp, Homo sapiens
cattagcacctccccctacaatgaggcacctagctagacaacttggctgtccgggcttaacctgcgtggcagggaaggacgcctgcccagccttagcctctacgcaatggtggaggcagggagggagagaaccacacagctcccctcatttcccagcagcccccatggagcctagtcaacagggtgtggtcacaggctaaatgagcaaagatgtgagctaatatactggtaggtgtcatgggggctttcagagctgggtaaggagggaaagagatggagatactggttccccactccttaacctgccacctgccttccctgtcctttaccctccctcattctgctggacctgaggaaaatgcaagggaggctaggcctagtggctca

SEQ ID NO: 95401 - DNA, 515 bp, Homo sapiens
tacaggactaacacggatcgagtctgaggatatggcttcagtgcatccatgtgctgcaaagaatgtgatctcattctttttatggctgcatagtattccatgggtgatcagtctggctgggtggtcccagtaaaaggatatgaacttgcagtcacccagcatcagcagcttgctgaaattgatataaaactccaagaactctctgcagcctcccctacaatttccagtttttctccaagacttgaaaatcggaataatcaggtccttctcatgaggaggaagacaccttttcctcagtgtttcatactcaaatccctccagaagaatatgaaatgcagatgcagaaactcaataaagattttacctgtgatgtggaaagaaatgagtcattgatcaaatcaggaaagaaacctttctcgaatacagaaaagattgagctcaggggtaaacacaaccaggattttattaagagaaacattgaggtatgtacttagaaattcagaagccagaatttg

SEQ ID NO: 95402 - DNA, 441 bp, Homo sapiens
cctcttcattcatacaatttaacacacattgaagtatcaaatttaaaaatgtttatgatccacagttttctcatataaaaaagttttataatttgaaataattatgttgtaaatgtcaaggatgaatattcccgaagtagcacatttgagagaaaggagggaaacaataacctcaaaaaatataatctcacagtagaaatttacaacttgcccttatacaaaactacttcagacattcagaacaggaggtgttcctatggaggggaagtagttttcagaattaaaaattagcaccagtagacagaaaatgtatgagtaaaaaatttgcataagcaaatacatagctgctttgaaatagagaaatccaagcatttggaatatactgcctccaaaaaaaatctaatcaataatgaaacaaataaattacaaattatattattc

SEQ ID NO: 95403 - DNA, 184 bp, Homo sapiens
acattttcattctactaagtaaactcaatgaccctggaattgactaggaagttattcattcatccagaaaataatagaacacttttgaaatgtgtgctcacgccttttgcatgttatggttataattaagctatttgggattcatttcctgggtttttgacagtacttgacagtagccgagaag

SEQ ID NO: 95404 - DNA, 193 bp, Homo sapiens
attgattgtgttggagttcaatacagtttttctctcagggtcataaagccattcacagaatcaggggtgttcaagggcgagaattcagtcatgggttcttagtttgtgtttctggttgggccagtaaagccccttcctcatctctcttttccacttatcactacagatgcagacttaaaaccatggcttcagg

SEQ ID NO: 95405 - DNA, 435 bp, Homo sapiens
ggcttgggagcaatcctgggctgtgggcattccttggcctagtggccagatttctggcacttgaaacaagatcctgatggaggaagtcttgtaagaatgcttgactgctgtggcttaggtgtgtgcggcttaggcattttgaagttcttgtgtgctggaggtgtggctgggttttgtctcacggcagaggcaagtaattgtaactcagaaatgcgttgccgtctggctgcctcctctctattattgtacaccttgaaggcaaggttgattaattcctgttgtggggtttgagggccagattctaatttttgaagttttttcctaatgtcaggagcggattgggtgataaaatgcatattaagaataaggcggccttctggcccttctgggtctagggcggtaaagtgtgtaagggttgctacaaagcaggccatg

SEQ ID NO: 95406 - DNA, 328 bp, Homo sapiens
cctaaaacttaaaacttaaagtataaaaaaaaaagtaggagaaaggataattttaggcagagggaagtgtgtacagaggggcagaagctttaaggtttatagttctgagaacctcaggtagtttgtttatatcacctgctggaagaggatgatgtgctggaaaggtaacttgtgtctagcttgggaaggttttgtgtggatttgggagtatcctaggcattaaagagactgttaagaagggaaggaaaaacagatctcttgcaaatatgacagaggagactctccaatttctagcttgggtaatatgggggaagggctttctaggcaa

SEQ ID NO: 95407 - DNA, 627 bp, Homo sapiens
ttttttggatttttagtagagatggagtttcgccatgttggccagggtagtcttgaactcctgacctctggtgatccacccacctcagcctcccaaagtgctgggattataggcgtgaccactgcacccagccatatttgccctttaaaagggaaaacctaaggaaactgatgttaaccctttgccatcgccaatctcattgatgtcggccagtcaatcctgtcaaatcttgctctttttttaatgatgcttgaaaattggagcctcacaactgtttactaggtgggtctaggatggtaatttctggaaatgactgtagactatgccaaatgtctttttagcctgttatctgaccatgcccagatggcttaacttttctctagcagtgtcactttttccttacttctctgtatctgtggagtagcgtagaaccgtatgtacaaaggtttctgctgacatatcaatgtctacacagctatgtgggtatccatgttggtgcctgaagagtctggcccgcgcccagtatttggcagctgtaaaatgttagatgaacttccaccctcagtaaaatcagccaccccttcaaaagagtcacaggcatccatccagtaatatctttccaggaaa

SEQ ID NO: 95408 - DNA, 872 bp, Homo sapiens
gtggctgggagacctgtttaattctgggatatagaattaagatggccatctgcctgcaagtagagataagctgcattctccgaaatcaactttgttcatgataaaagtaacattctggcctccatatgccatattctttattgttaatttcttaaacagttaacaaattggttagagaagaggcaggctatctattgccccatcctctacttttttttttttttaaaactaaatacctaatcgttatattgttattcttttgactattattgctctccttaacacatataaaaatagaccaaactgacatgatcatattttataaaaatacgattttcttttcttgaaaaggaaacagaaaaaaggataaatggcttaaattgtctacttatcataactagaattagaaatcccagtctttgtggctgccaaaaaaaaaaaaaaagaataaatgaccaaaaaatgaagtcaaatgcaagtctttcatgactctctccctgtgactgttagtatgaggaaacttaatagttctgaaaataaagatgtaaatttctgcagaatgtaaaacaggataaagtaacaatagccaaaatgtggaaacaacccaaatgttcatccatagatgaatggataaacaaaatgaggtatatatgtacaatggactatgatttagcctaaaaagaagtgcaattcttatatatgctacaacatagatgaaccttgagaacattatactaagtgaaataagccagtcacagaagcacaaatatatgattctatgtatgtgaagaacctagaataggtaaattcatggagacagaaagtagtttccaggggctggtggtaggggagaatagagagttagtgtttaa

SEQ ID NO: 95409 - DNA, 417 bp, Homo sapiens
tccggtacctgcagcctctctctgctgtatctagactgagcccatcctgctccctgcaggctcagtctgtgttgggcctgggaggaaggagacccctgaccacaggccctgtctccagctgggtgctggggctgtcagctccgccctctcttctctcagaagcccagcctgactctgtggctgccctagccacacaggccccaccctccaggagtttaaaatttagttagggacgaattcagattactgagccaagatccccaatggtaaaaagatagcaaacggtaggcacaaaatgaatggcagggcctagggcagaggaaagcttctaattctctagaaggttctctaacccttggtgggtggtcccaggacagtcttttgtctgggccctcctggtagatgctctgcgccccc

SEQ ID NO: 95410 - DNA, 274 bp, Homo sapiens
gagtcaccagcagttgctgggagcggtaggattatggtccctacctggggttcagaacaagaactttgctgtgaactcccctggttgaagcagagggccaggaagcagagggacctgaattccccaccaggcggtccctacagagtcatggaccttcctttctccccgcttcctcctgccctgttgtctctgctgagcaaggcacggggcgggggggcttccgctgggtggacttgagttggcctagatttgaatctgctcttactgccgtgga

SEQ ID NO: 95411 - DNA, 392 bp, Homo sapiens
aatgtggggccggtgccattctaattggttctgtttccctctagtggttgatcgcggagatttcggcttctccatcaggacaagttcagatagcctgagatggtatcagaactcagggacagagctgggtgtggcggccctgcatccatctgctttctctccatgctaactgatatggtcagagagctggaagcaaattccaggaccccagggctccgcaaaggcaaacacattacttcatcggctgctgacatgcaacttcccccaggggttaaaacaatgtttaatactaacagtaataatatttttgagttttactttatgctggcgctgttctaatgttgtaagtgtattaactcatttaagccttacaacaacctaaggacatggga

SEQ ID NO: 95412 - DNA, 646 bp, Homo sapiens
ccagcccctgcctctctcctgagctccagacttcagtatctaccaagatttgctccctcactctcagcgcgtctaaagagctctcgtttcccctgggggctgattcttctgtgggctcgttgtcttcagcactctgctccacgcttggctcagttgcccacccttgcaccctgttccgcagtcccagccatgtcattccctctgccaccacctctccatcctcaccatagcgtccccagctcggaccctttctctctccttgcctctgaccgccgtacctgtttcctgactagtcttcctgctgtgatcgtctctctaccatccctgatgctggagttgacattctaaaatgccagtgggtcacgtggttgttgcacgtcctccaggtgtacccactgattataccatctggaccctgcccctgctgtcttccagtggggagtgggggagaccctgtgcaacctccttggccactgggctgtcttggatggagtcatgggatctggcctcacctggcctaggcagttttttattttggtgtggttgggccaccacaccactggcaagggaaaagggatggatgtgtgagacctgggaagtgaaggttcagctcaatcagcagtggaatgtgaggtggggtgtgaag

SEQ ID NO: 95413 - DNA, 841 bp, Homo sapiens
cattcacactatatttatttcatatatgggttatatataaatggcacttattcagccagaaaatggccctaaatccatgtttcttctgcagaggaaagtccatttcatctattatttctttgcatgattatttgtgttagaggaaagatacataaagttaaaaaaaaaaaagaaatcaagggcatttctcatatcacattaccctgcactgttgaaagctacaatttttaagtcataaaatgtaagtcatttcaagaaattttgttgggaaaatttcatatttccaatgaatttaaatatatgaatttggtagagagaaatggaacaagagattctgttattttatcaggttgagtttcagccaaatctggttgatagatcctttagaaattatccattatcatcaaagtatccatttgatagtttacctttccaaaaaatccactgctggtttcttcctttcaaaggaacactaagctttttgacatgaaacattctttatatagaaaacatcattagtgaattcctggtgaggagccatatgccccatatgtggaattttccattttattccccatttactggtaggaagttcaggtctaatattccgaggtacaacaatccatttcattagaagagtaatggacaagtagttcaggagtctatggtggtaattaacattgcatttctgtttagaaacttatttatgccttggtttccccatatgaaaaataggcagataatgaagattaacaaaataattagttgatcactaacacatgccactgagtatatttttcttttgaaagtaaatgacaccagccatcccacctctgaacac

SEQ ID NO: 95414 - DNA, 772 bp, Homo sapiens
tgccctccatattcatagaagtagtagtttgtgtcaagatttcatttaatactttttttctcttttgagacagggtctcattctgtcgctaaagctggagtgcagtggtgcaatcatgacccactgcagcctcgacctcctgggctcaagcagtactcctgtcctggccacccaaaatgctgggattacagggatgagccactacacctggccttcatttactattcttaagcattaaacaaaatcttgttcggtctaattggagagctttactgcagaaaagtggcaaatttggtatcacccacttatatttggtggcaatattttcatattgtagcgttatataaattggatgaaaaagtttgttctaaggacatattgtataattaaattttaaaaagagaaagttactgagcccctatctctaaaaattaaaaatagctgggcgtggtgctgcacacctgtagtcccagctacgcaggaggctgaggcaggagaatgactcaagtctaggagtgagctgtgatggcaccactgcactccagcatgggtgacaggaagagttcatctcttaaaaagaagaaagaaaaatttcattaggttttggtgtgttttagaactatttgacaacagtgatttttgtttcaaattgagtgaggttgggcctgatggtcaacagtttgcgacttagagccattttttgcagttgcaaaagcgtttcataaaatctgctcttatgcgtcacatacttggtcattcatttgactctgag

SEQ ID NO: 95415 - DNA, 434 bp, Homo sapiens
aggtaagccacagaagaggaaatctaactagtcaataacatatgaaatgataaatactttcaatagtaatcagggaagtgaaaattacaataatataccaatttacccttgccatattaccaaaattcaaaatctataattctgtgtgtgtgtgtacacgagtctaaatcacacactatctgtaacattaattttgccacataaggtcatagagctttgcattttaacattgatgattcctattcaaaagctgaattccatacatttcacgaagctgtatctgcccacctggctgcaatccatgcttttaggggattaatttgacatgatgttaaaaccagctctttttatttcaaagactggtaataaaatactatcaagtattttcccagtccgcaggcctttacgggactcaaaaggaataggtcaaaacc

SEQ ID NO: 95416 - DNA, 863 bp, Homo sapiens
  misc_feature (650)..(650): n is a, c, g, or t
  misc_feature (656)..(656): n is a, c, g, or t
  misc_feature (726)..(726): n is a, c, g, or t
  misc_feature (728)..(728): n is a, c, g, or t
ggcggggcgtctccgagcggcggggccaagggagggcacaacagctgctacctgaacagtttctgacccaacagttacccagcgccggactcgctgcgccccggcggctctagggacccccggcgccaacacttagctccgcgcccgagagaatgttggaccgacgacacaagacctcagacttgtgttattctagcagctgaacacaccccaggctcttctgaccggcagtggctctggaagcagtctggtgtatagagttatggattcactaccagattctactgtatgctcttgacaactatgaccacaatggtccacccacaaatgaattatcaggagtgaacccagaggcacgtatgaatgaaagtcctgatccgactgacctggcgggagtcatcattgagctcggccccaatgacagtccacagacaagtgaatttaaaggagcaaccgaggaggcacctgcgaaagaaagcccacacacaagtgaatttaaaggagcagcccgggtgtcacctatcagtgaaagtgtgttagcacgactttccaagtttgaagttgaagatgctgaaaatgttgcttcatatgacagcaagattaagaaaattgtgcattcaattgtatcatcctttgcatttggactattnggagtnttcctggtcttactggatgtcactctcatccttgccgactaattttcactgacagcaaactttatatccntnaggggagtactcgtgctaatatcgtgtagcatactgccatgtatgtaaatctcaatggatcgtcctacattcgagtagtagtaggaacaggagaaagaagaatataactgaagtagaacacaatgagataatgaa

SEQ ID NO: 95417 - DNA, 805 bp, Homo sapiens
  misc_feature (592)..(592): n is a, c, g, or t
  misc_feature (598)..(598): n is a, c, g, or t
  misc_feature (668)..(668): n is a, c, g, or t
  misc_feature (670)..(670): n is a, c, g, or t
ggcggggcgtctccgagcggcggggccaagggagggcacaacagctgctacctgaacagtttctgacccaacagttacccagcgccggactcgctgcgccccggcggctctagggacccccggcgccaacacttagctccgcgcccgagagaatgttggaccgacgacacaagacctcagacttgtgttattctagcagctgaacacaccccaggctcttctgaccggcagtggctctggaagcagtctggtgtatagtccacccacaaatgaattatcaggagtgaacccagaggcacgtatgaatgaaagtcctgatccgactgacctggcgggagtcatcattgagctcggccccaatgacagtccacagacaagtgaatttaaaggagcaaccgaggaggcacctgcgaaagaaagcccacacacaagtgaatttaaaggagcagcccgggtgtcacctatcagtgaaagtgtgttagcacgactttccaagtttgaagttgaagatgctgaaaatgttgcttcatatgacagcaagattaagaaaattgtgcattcaattgtatcatcctttgcatttggactattnggagtnttcctggtcttactggatgtcactctcatccttgccgactaattttcactgacagcaaactttatatccntnaggggagtactcgtgctaatatcgtgtagcatactgccatgtatgtaaatctcaatggatcgtcctacattcgagtagtagtaggaacaggagaaagaagaatataactgaagtagaacacaatgagataatgaa

SEQ ID NO: 95418 - DNA, 789 bp, Homo sapiens
  misc_feature (576)..(576): n is a, c, g, or t
  misc_feature (582)..(582): n is a, c, g, or t
  misc_feature (652)..(652): n is a, c, g, or t
  misc_feature (654)..(654): n is a, c, g, or t
acggaagcagggcggcgttcgacggggcaaggaggcacacagtgctactgacagttctgaccacagttcccagcgcggatcgctgcgcccggcggtctaggaacccggcgcacacttagcttccggccgagaatgttggaccgacgacacaagacctcagacttgtgttattctagcagctgaacacaccccaggctcttctgaccggcagtggctctggaagcagtctggtgtatagagttatggattcactaccagattctactgtatgctcttgacaactatgaccacaatggtccacccacaaatgaattatcaggagtgaacccagaggcacgtatgaatgaaagtcctgatccgactgacctggcgggagtcatcattgagctcggccccaatgacagtccacagacaagtgaatttaaaggagcaaccgaggaggcacctgcgaaagaaagtgtgttagcacgactttccaagtttgaagttgaagatgctgaaaatgttgcttcatatgacagcaagattaagaaaattgtgcattcaattgtatcatcctttgcatttggactattnggagtnttcctggtcttactggatgtcactctcatccttgccgactaattttcactgacagcaaactttatatccntnaggggagtactcgtgctaatatcgtgtagcatactgccatgtatgtaaatctcaatggatcgtcctacattcgagtagtagtaggaacaggagaaagaagaatataactgaagtagaacacaatgagataatgaa

SEQ ID NO: 95419 - DNA, 452 bp, Homo sapiens
tatttgataggcatgctttcaatctcgtaactccctatgaggttatgttttacagatgaaaaagggaaaaggaagatactcatcagtggctagcttccttccatcaccgaaccctcaagtccctgttccctttttgtctttgtagaagctggtggcagggatatactttctgagctctggtttaaaactctgagttttgggccacagatcccctctagctgactcttcttttttgacatgaatgagataaaaagttgttcctgggagatagtttcagcatggctacagtagtcagagaaacgtgcatcttttccagtgaaggaacaaagctgatttctttgcactggggcatagtgggggtgtgggaagggggggctgagtgatgggaataggggtcactactgagtcatatggcaggaaaaagatgaaaagattagttacccaaaaaaaaa

SEQ ID NO: 95420 - DNA, 483 bp, Homo sapiens
ccacatggggctagtggccaccttattagacagcataggactctagacaagtcccctgcacattgtgcattctggcaatgttaggtttgcattgtgttcttctgaaaaagtctgcaccttcccccatgccagtgagtgtgttttctcaataactttttttttttttttgacccttatctctcatgctcttgacacaaacttccacattttttcataagggtcacacacgatgccaagaaatgagaaaggagtcaatgccggatcaagtcagacaaccttgtccttatccttgcctccttttctcctgagagcccctagtcaatctaataccaagtgtttcccactcccagagagaaaagaagggaatggctttggatctctggctaaagatcacagactgcggagtcgtcactgttcccactgaacatctgattaagttgctgagtctgacccttgagtttcccagaacttgccaagattcag

SEQ ID NO: 95421 - DNA, 154 bp, Homo sapiens
taatgaaaaagcatcaaagctaagccagaggatttatcacattttcatcatcagctacaggattagaaaggaggctgggatgaatgtgacatagaccacagcagctctcttaagactcctggtattaccaacataaagaggcaggtggaatgag

SEQ ID NO: 95422 - DNA, 830 bp, Homo sapiens
agcgggtcagcagcactgggtcagccggtgaacgggtgtgcagcgtcctcagcgccgcagcagtcagcacctgtgggtgctctagctctttccctcggggtcaccggaggcagagcctcccctacgcggagtagaggagcagctcacatggcagccgccacagaggacaccagatcatgccaacacccccacaactcctgcccgcctgcaggcagctctgggctcaggacaccgcctgcaagaacctttatagcgcagctctccaaaccttggaggcgaggacattctatgtgcccgccctggaaaggcctgaacctataacatctgggctgtgatggtttctgaggtggacaccaggaccaacacttgtcagcatggcacaatcaggcatttctcttctaagtaggatgtgcagccaaaaactcagctgtctgtgagctgtcttctcccaggaacgaggacataagatgtacatcaggttttgatattagagtaatactggccttatagaatgagttacgaaaagttgcccctttctccactttctgaaagagttgtgtaacacaggtctgaactgcacagatccacttacatgtggattttcttccactgcggcctctcctgagacagcaagaccaacccctccttttcatcctcctcctcctcctcagcctactcaacatgaaaatgacaaggatgaaacctttatgatgatccactcatccattttcttttctctagcttattgtgaacatcttaggctagtgtgtcgacttctgacttggctcatctgaacccaagtccttggacacattcacaaacaccccagg

SEQ ID NO: 95423 - DNA, 498 bp, Homo sapiens
cacacccggctaatttttgtatttttagtagagacagggtttcaccatgttggccagactggtctcgaacttctgatcttgtgatctgcctgcctcggcttaccaaagtgctgggattacaggcgtgagccaccgcgtctggcacctccacactctttaatacttggtattgtcttttttttaccccttttccattctggtggatgtaaaatggtatttgattttgttaactcaaactatttagaatatattttatttataaattcatggaatttaaaaaaggaatcaatttatttgtttgaaattttattgcaataaggtccaaaaccatgattggtatcatgactgttctctgaaaatgttgagatctcttttgtggtatagtatatgaccaaattttataatgaatggttatttgataagtatttgtatctttattagatatggagttcttctgtttcctataaattaaagattttaataaaaattcaagcatat

SEQ ID NO: 95424 - DNA, 351 bp, Homo sapiens
tgaagtcattacctctgcaactaggacacaggtgcctccgagtctggtctcccataatttgtctgagagaatatgggtttgtgcccacaaaatagagtgcaaggaattgcaaaggatgggatttaattccactatttggagtgttttgagaagcccctaaacagcctgcagtagaatgattaattttccacccactctttctgctggggttccatgagatagacatgaaatctaggcagctacccctgcacctgtgtcctggggctttgagtcagctcatgtgcctaaatccatatctctttcaagatcccttagatttccatatggagaaattttatcatgttaaaacta

SEQ ID NO: 95425 - DNA, 338 bp, Homo sapiens
atttatgaaggaacgaactagaccataagtttttgtaggccatagtggctagcccttctcattcataatctttaggttgcttctgttctgcagtagcccttcttcatataatggtcattattttacaataggccttttatgcaatagttggtaaatatatgttaatttccaatacctttgaatattttgtatcatgtaattttacatggtacctcttcctgtccctattaggaacctaaataaatgcatgattccctattaacagttatctagtgaagaatttttatattcttccctaattgagtatttgatcattatcttaaatgtgtatgcacata

SEQ ID NO: 95426 - DNA, 379 bp, Homo sapiens
tcttgcacaggggggttatccaggtggcagatctaccaggttctctgttcatccttctctagggctattgctctactcatagcatcttctgcaggatatatgggaaagaagtgatacacctacacctctccttttctctccttacaggagcttaagataaaagttacctaaagaggccaagcatggtggctcacacctataatctcagcactttgggaggccaaagagggtggattgcttgagatcaggagttcaagaccagcctgggcaacatggagaaaccccttctctacaaaaaatacaaaaattagctgggcctggcagacacctgtggtcccagctattcaggaggctgaggtgggaggactgcttgagccca

SEQ ID NO: 95427 - DNA, 699 bp, Homo sapiens
attttatgctaccttctactgttgtaatccttgcagactttttttggtaagctgacaaaaacattagaaaactttgaatgcagagctatattttacaaatgagggaccagagtccaaaaaatcaagagatttgagattcagcattcatgctagtgtaatgataaaactgaaatataggcctaatgatatctcttgagttggtctgttattctgtatcatgactatttttaatgcctattgaagtataaaattaaagaatgaatatatgtttaaagcaaattaatgaattctctgtgatgctctacaaaggacaggttgttttttcttaagaactggtaaaatccttaaagtttacctaatccaactcctttaactgctgaagaatgagtttgagatataaactatttagtattatatgattaaccaagagtaggtctagcagtcacacctccatctagtcagaattgaatttgcaaatggttaagatatgttctgggattggagaagggaaggataggtgaggatactgtttgaaatggagggtgacagcttgggaggctcttgtagtaacctcattgtgatagcttgaactaagttgaactaagtaaatatgaaatggaaggggtggtgggaaaaattacaagttcgcttccaaaacactgaatgagagaaagctatagtatcacaaattgaccccca

SEQ ID NO: 95428 - DNA, 431 bp, Homo sapiens
gtaaaatcttagggcaaagatagctccttcaaaatgattagactctcctgttgtacatggtatgacttgatactgaatacatggaaatacctagaaatgttatttgctaaatcttacgggaagcagctgttagccactgcaccaagcagattcccacaggaccactgactctgtacctctgtgccccttctgtgcttcactgaacacaagtccatagtttgcatgatagagcctcacaaagctccactcaatgtcattaagctatacagcaaagctacactgccagagagaggaacagagacagagagtgaatacactaaaaacagagggccctgaaagagtaagacctatagaaccaatttcttcttgggtactacatccagaaaatctggacttctggtgtgtaacttaactagcattacaacagtgct

SEQ ID NO: 95429 - DNA, 1701 bp, Homo sapiens
ctggttactaggctgtcctcccagtcttcctttccactcccagagggggctgatcgcacaagtacaaagtatgttgctgcattcctaaccccaccagctctgagcccttcaggaataaatcacatggcaagctggagggagctgcagggacagaggccaaagctgtctttccttgtgtaagggaggaactcttgctggccggggaatctcttggaattggtcttttttggggtttcagaggcaaagcttgaacaccatcagtcaagagtggttccgcgtctccagccggaagtcgtctagccctgccgtggtggcctcctacctccacgaggtccagcctcactccccacacttcctgaagctgcttgtcaacttggccgatcgcaacgggaacacggcccttcactacagcgtgtcccactccaacttctccatcgcgaagctgctgctggagacaggctggccgcacagctttgtccatcgctctgaagtcacccacccatatggaaattgctgggcttctgagagcccacgcggagcagggcaggtccctggggctgtaggggctgcagaagaactggccgtggggaacaaaagccttcttctctggactcctccctcgcccttgaagagggcagaggtcacaggccagagagccacccttctagagaagaaactatgtcaaatatgcacatacattcctgttgtataattctgctcattaggatgctttgtagtttttgccttaggccaagcctgaaaactacacgggcttcagagcagggttcaaggtgcaaggtgaggggtacgtcggtgtcatccaaacatccaaaacatcttcagccttgaattcctcatgactctaccctctgtaacattgtgtagcaagcaggcaggcaggagcacattagcacattagaaaagcaatactttttacatggaattttacagtgcactatctttctgttttttaagcaagtgtatacaaatatgtcccattgatatgcatgtctatagatgggaggggatttaagccaaccccctggcaagcattctgtaggggaccctagaagaatcaccgtgcagactggtgaaactgaacaagcaccatttgggagctttgtttcgatggggttgacagagaaatcttaaaatctgacagggtagaagaagcactttggcatcaatgccatatgtacagtcttgactatttctgagtcatctagtggctccaatttgctccagggaaattggaattaattaagaaatttattatctagtaagttgctatgtaataaagaaaaaaaagaaattcaatccaatgacacacaccacatgtatttgggcagagtcagattctctcagctattttgagtctgtggaagaaacaaaaaaaagcttcctcctgaggatgggttattgtcatcaagaagccacctgcatagccgtatccattacctcatggtaattcccggtgctttcccctcatatcccctagaagcaaatatctgttctgaggttttttgggacttctggctgcaataggagcaagggacccaggcagggcagagcaataccttccgaagcttccatattccctggggccagcacatgcaaggtttatatggtcagtagctcacgtgaagtcatctgaatctttcttaaatctgctctcttaaaatctcttatgcaaaaaaaaaa

SEQ ID NO: 95430 - DNA, 975 bp, Homo sapiens
  misc_feature (838)..(838): n is a, c, g, or t
ctggttactaggctgtcctcccagtcttcctttccactcccagagggggctgatcgcacaagtacaaagtatgttgctgcattcctaaccccaccagctctgagcccttcaggaataaatcacatggcaagctggagggagctgcagggacagaggccaaagctgtctttccttgtgtaagggaggaactcttgctggccggggaatctcttggaattggtcttttttggggtttcagaggcaaagcttgaacaccatcagtcaagagtggttccgcgtctccagccggaagtcgtctagccctgccgtggtggcctcctacctccacgaggtccagcctcactccccacacttcctgaagctgcttgtcaacttggccgatcgcaacgggaacacggcccttcactacagcgtgtcccactccaacttctccatcgcgaagctgctgctggagacaggcgtctgcaatgtggaccatcagaacaaagctggctacactgccgtaatgatcactcccttggcttccgcagagaccaatgaagacatggctgttgtctggaagctcttaagagaaggaaatgtgaacattcaagctactcagggaggccagactgcgctgatgctgggagtcagccacgacagggaggacatggttcaagcgctgcttagctgccaggcagatgtcaatctgcaggaccacgatggatcctcggcctcatgctggcctgtcaccatggcaacgtggacctggtgcggctgctcctggcacacccagcctgcgacagcagcctgactgacaagggcgacagtttgtcatcgtctgaagtacaccatatgnaattgtgggtttgagagccagggagcagaagccctggggttagggtgggaagaatgggggcggcaaaccctcttgagccctgcctgaaagggggtcagcaaagactttaaaaaatgattggacatcgcggaaatgga

SEQ ID NO: 95431 - DNA, 2045 bp, Homo sapiens
ctggttactaggctgtcctcccagtcttcctttccactcccagagggggctgatcgcacaagtacaaagtatgttgctgcattcctaaccccaccagctctgagcccttcaggaataaatcacatggcaagctggagggagctgcagggacagaggccaaagctgtctttccttgtgtaagggaggaactcttgctggccggggaatctcttggaattggtcttttttggggtttcagaggcaaagcttgaacaccatcagtcaagagtggttccgcgtctccagccggaagtcgtctagccctgccgtggtggcctcctacctccacgaggtccagcctcactccccacacttcctgaagctgcttgtcaacttggccgatcgcaacgggaacacggcccttcactacagcgtgtcccactccaacttctccatcgcgaagctgctgctggagacaggcgtctgcaatgtggaccatcagaacaaagctggctacactgccgtaatgatcactcccttggcttccgcagagaccaatgaagacatggctgttgtctggaagctcttaagagaaggaaatgtgaacattcaagctactcagggaggccagactgcgctgatgctgggagtcagccacgacagggaggacatggttcaagcgctgcttagctgccaggcagatgtcaatctgcaggaccacgatggatcctcggcctcatgctggcctgtcaccatggcaacgtggacctggtgcggctgctcctggcacacccagcctgcgacagcagcctgactgacaagggctggccgcacagctttgtccatcgctctgaagtcacccacccatatggaaattgctgggcttctgagagcccacgcggagcagggcaggtccctggggctgtaggggctgcagaagaactggccgtggggaacaaaagccttcttctctggactcctccctcgcccttgaagagggcagaggtcacaggccagagagccacccttctagagaagaaactatgtcaaatatgcacatacattcctgttgtataattctgctcattaggatgctttgtagtttttgccttaggccaagcctgaaaactacacgggcttcagagcagggttcaaggtgcaaggtgaggggtacgtcggtgtcatccaaacatccaaaacatcttcagccttgaattcctcatgactctaccctctgtaacattgtgtagcaagcaggcaggcaggagcacattagcacattagaaaagcaatactttttacatggaattttacagtgcactatctttctgttttttaagcaagtgtatacaaatatgtcccattgatatgcatgtctatagatgggaggggatttaagccaaccccctggcaagcattctgtaggggaccctagaagaatcaccgtgcagactggtgaaactgaacaagcaccatttgggagctttgtttcgatggggttgacagagaaatcttaaaatctgacagggtagaagaagcactttggcatcaatgccatatgtacagtcttgactatttctgagtcatctagtggctccaatttgctccagggaaattggaattaattaagaaatttattatctagtaagttgctatgtaataaagaaaaaaaagaaattcaatccaatgacacacaccacatgtatttgggcagagtcagattctctcagctattttgagtctgtggaagaaacaaaaaaaagcttcctcctgaggatgggttattgtcatcaagaagccacctgcatagccgtatccattacctcatggtaattcccggtgctttcccctcatatcccctagaagcaaatatctgttctgaggttttttgggacttctggctgcaataggagcaagggacccaggcagggcagagcaataccttccgaagcttccatattccctggggccagcacatgcaaggtttatatggtcagtagctcacgtgaagtcatctgaatctttcttaaatctgctctcttaaaatctcttatgcaaaaaaaaaa

SEQ ID NO: 95432 - DNA, 2703 bp, Homo sapiens
cccagctgtcactgccacagggacccgagcaggtccttacctcctctgtacatagcttcctctccactgaactcaggattgaagaagcaggcactgaacaggaaggaggccctcagggaggaaccaggggagcaggaggctttctgtggggcagcgacagaaagactcccccagcagggagggaggagaccagttccaatctcccagggaaggagcacccgggaaggccaccaagctcgccaacggatgccactattgggcagtatgtgaagaagatccaggagctcctgcaggagcagtggaactgcctggagcatgggtacccggagctggccagcgccatcaagcagccagcctccaagctcagcagcatccagagccagctgctgagctccctcaacctgctgctgtcggcctactcggcccaggctcacccacccaaggagccaccggcctcctcctcctccccgccagtggagatctccccatcgaccagccttaaatccataatgaaaaagaaagactatggcttccgtgcaggaggtaatgggaccaaaaagaaccttcagtttgttggggttaacggtgggtatgagaccacctcaagtgaggagaccagcggtgaggacagcaccccagaggacttgtctgacagcgaggcagagaagaagtgtgacggcccagatcacaagcatgtcaaagatgcccatctcacctgcgaggctgggcagggcatccctgagggcacctgccatgctgcccaggaaagtgggcctggggaagaagtcccccactccaaggccgagagatataaaccctcagaagaatttcttaatgcatgccgggcactgagccagcatctgccagaaactgggaccgccacagaccagctcttgaggcaaagcttgaacaccatcagtcaagagtggttccgcgtctccagccggaagtcgtctagccctgccgtggtggcctcctacctccacgaggtccagcctcactccccacacttcctgaagctgcttgtcaacttggccgatcgcaacgggaacacggcccttcactacagcgtgtcccactccaacttctccatcgcgaagctgctgctggagacaggcgtctgcaatgtggaccatcagaacaaagctggctacactgccgtaatgatcactcccttggcttccgcagagaccaatgaagacatggctgttgtctggaagctcttaagagaaggaaatgtgaacattcaagctactcagggaggccagactgcgctgatgctgggagtcagccacgacagggaggacatggttcaagcgctgcttagctgccaggcagatgtcaatctgcaggaccacgatggatcctcggcctcatgctggcctgtcaccatggcaacgtggacctggtgcggctgctcctggcacacccagcctgcgacagcagcctgactgacaagggctggccgcacagctttgtccatcgctctgaagtcacccacccatatggaaattgctgggcttctgagagcccacgcggagcagggcaggtccctggggctgtaggggctgcagaagaactggccgtggggaacaaaagccttcttctctggactcctccctcgcccttgaagagggcagaggtcacaggccagagagccacccttctagagaagaaactatgtcaaatatgcacatacattcctgttgtataattctgctcattaggatgctttgtagtttttgccttaggccaagcctgaaaactacacgggcttcagagcagggttcaaggtgcaaggtgaggggtacgtcggtgtcatccaaacatccaaaacatcttcagccttgaattcctcatgactctaccctctgtaacattgtgtagcaagcaggcaggcaggagcacattagcacattagaaaagcaatactttttacatggaattttacagtgcactatctttctgttttttaagcaagtgtatacaaatatgtcccattgatatgcatgtctatagatgggaggggatttaagccaaccccctggcaagcattctgtaggggaccctagaagaatcaccgtgcagactggtgaaactgaacaagcaccatttgggagctttgtttcgatggggttgacagagaaatcttaaaatctgacagggtagaagaagcactttggcatcaatgccatatgtacagtcttgactatttctgagtcatctagtggctccaatttgctccagggaaattggaattaattaagaaatttattatctagtaagttgctatgtaataaagaaaaaaaagaaattcaatccaatgacacacaccacatgtatttgggcagagtcagattctctcagctattttgagtctgtggaagaaacaaaaaaaagcttcctcctgaggatgggttattgtcatcaagaagccacctgcatagccgtatccattacctcatggtaattcccggtgctttcccctcatatcccctagaagcaaatatctgttctgaggttttttgggacttctggctgcaataggagcaagggacccaggcagggcagagcaataccttccgaagcttccatattccctggggccagcacatgcaaggtttatatggtcagtagctcacgtgaagtcatctgaatctttcttaaatctgctctcttaaaatctcttatgcaaaaaaaaaa

SEQ ID NO: 95433 - DNA, 2758 bp, Homo sapiens
cccagctgtcactgccacagggacccgagcaggtccttacctcctctgtacatagcttcctctccactgaactcaggattgaagaagcaggcactgaacaggaaggaggccctcagggaggaaccaggggagcaggaggctttctgtggggcagcgacagaaagactcccccagcagggagggaggagaccagttccaatctcccagggaaggagcacccgggaaggccaccaagctcgccaacggatgccactattgggcagtatgtgaagaagatccaggagctcctgcaggagcagtggaactgcctggagcatgggtacccggagctggccagcgccatcaagcagccagcctccaagctcagcagcatccagagccagctgctgagctccctcaacctgctgctgtcggcctactcggcccaggctcacccacccaaggagccaccggcctcctcctcctccccgccagtggagatctccccatcgaccagccttaaatccataatgaaaaagaaagactatggcttccgtgcaggaggtaatgggaccaaaaagaaccttcagtttgttggggttaacggtgggtatgagaccacctcaagtgaggagaccagcggtgaggacagcaccccagaggacttgtctgacagcgaggcagagaagaagtgtgacggcccagatcacaagcatgtcaaagatgcccatctcacctgcgaggctgggcagggcatccctgagggcacctgccatgctgcccaggaaagtgggcctggggaagaagtcccccactccaaggccgagagatataaaccctcagaagaatttcttaatgcatgccgggcactgagccagcatctgccagaaactgggaccgccacagaccagctcttgaggcaaagcttgaacaccatcagtcaagagtggttccgcgtctccagccggaagtcgtctagccctgccgtggtggcctcctacctccacgaggtccagcctcactccccacacttcctgaagctgcttgtcaacttggccgatcgcaacgggaacacggcccttcactacagcgtgtcccactccaacttctccatcgcgaagctgctgctggagacaggcgtctgcaatgtggaccatcagaacaaagctggctacactgccgtaatgatcactcccttggcttccgcagagaccaatgaagacatggctgttgtctggaagctcttaagagaaggaaatgtgaacattcaagctactcagggaggccagactgcgctgatgctgggagtcagccacgacagggaggacatggttcaagcgctgcttagctgccaggcagatgtcaatctgcaggaccacgatggatcctcggcctcatgctggcctgtcaccatggcaacgtggacctggtgcggctgctcctggcacacccagcctgcgacagcagcctgactgacaagggctggccgcacagctttgtccatcgctctgaagtcacccacccatatggaaattgctgggcttctgagagcccacgcggagcagggcaggtccctggggctgtaggggctgcagaagaactggccgtggggaacaaaagccttcttctctggactcctccctcgcccttgaagagggcagaggtcacaggccagagagccacccttctagagaagaaactatgtcaaatatgcacatacattcctgttgtataattctgctcattaggatgctttgtagtttttgccttaggccaagcctgaaaactacacgggcttcagagcagggttcaaggtgcaaggtgaggggtacgtcggtgtcatccaaacatccaaaacatcttcagccttgaattcctcatgactctaccctctgtaacattgtgtagcaagcaggcaggcaggagcacattagcacattagaaaagcaatactttttacatggaattttacagtgcactatctttctgttttttaagcaagtgtatacaaatatgtcccattgatatgcatgtctatagatgggaggggatttaagccaaccccctggcaagcattctgtaggggaccctagaagaatcaccgtgcagactggtgaaactgaacaagcaccatttgggagctttgtttcgatggggttgacagagaaatcttaaaatctgacagggtagaagaagcactttggcatcaatgccatatgtacagtcttgactatttctgagtcatctagtggctccaatttgctccagggaaattggaattaattaagaaatttattatctagtaagttgctatgtaataaagaaaaaaaagaaattcaatccaatgacacacaccacatgtatttgggcagagtcagattctctcagctattttgagtctgtggaagaaacaaaaaaaagcttcctcctgaggatgggttattgtcatcaagaagccacctgcatagccgtatccattacctcatggtaattcccggtgctttcccctcatatcccctagaagcaaatatctgttctgaggttttttgggacttctggctgcaataggagcaagggacccaggcagggcagagcaataccttccgaagcttccatattccctggggccagcacatgcaaggtttatatggtcagtagctcacgtgaagtcatcatcatcggggtatcgctctctatcttgttttttgtttcttcctttgttctttttttctttttttttctcttttttttttttttttctttttttccttctttttcc

SEQ ID NO: 95434 - DNA, 346 bp, Homo sapiens
tgatttttgtaggtacagtctttaagaaggtgaggtaaaatgaggtcataaaagtaggtccctaactgagtagaactggtgttcttagaagaagaggaagagatactagagctctctctctccctagtgtgcacacagcaaaggtcagacagagtggcctcatcagacaccaactctgaaggcaccttgttcttgaacttctgacttccagaaccgtgagaaaataaatttctgttgtttaacccactcagtctatggtattctcttatgacagagtaagtacaccaatatagttacatagagtggaatacacagaatttaaatttacattgcaatatgttttaac

SEQ ID NO: 95435 - DNA, 400 bp, Homo sapiens
agactccatccatctcaaaaaagaagaagaagaaggagaaggagaagagaagaagaggaagaagaagggcagaaggtcaaaatcagagttttggggaacacctggacttacaagcttctggaggtagagaggcctaagagagagctacaagacaggtaagaggacaatcaagaaagagactttccaggaaggagatcagacttcatggagaagtcagtaaggtaaggtaagaacgaacaaaggggtctgttgtagcccttcctctgcacaatgtctggggtgggagttgggaaggtaacaaaaagctcaattgcagtgggttggaggataaactggaagtggggaaggagagaagtgggtgtggactgctctttcttggttctggagggagcaggtgacg

SEQ ID NO: 95436 - DNA, 719 bp, Homo sapiens
tctgttatatcaggaaactggtctgttttatattctactcatgtttctaaattgtttaaacttttatagttggaatacattccacttataatcagcaaaaataataaagatattaccaatttaaaaacatagtagtgattatctttaaattttttctatgagaagtattttccctacttcctttaaaagggcaagctaagttttttttttttttttttttgagatggagtctcactctgtcacccaggctggagtacagtggaacaatcttggctcactacaacctccacctcccaggttcaagcgactctcctgcctcagccccccaagtagctgggattacaggtgcacactgccatacccggctaatattttgtatttttagtagagacgaggtttcactgtgtaaaagggcaagctaagttttgtgttttaaaattggaggtgggatgaggggagcggtgggcttcctagggtagcatgcacaagatcagacaagttgttatgggttgaattgtgacccctaaaaagaaatattgaagtcttaacatccatatcttagaatacaccctcatttggaaataaagtacttgccaatataattaattaagataatactggagtatggtgcacccttccaatatgaccagtttcttataggaaaagaaaacagaggcatggtggctcatgcctgtaattccaacactttgggaggctga

SEQ ID NO: 95437 - DNA, 112 bp, Homo sapiens
taatcttttaagtctataccttggcagaattcaagccgctttcatcctaccaatgtggtggtcttgcattagttttacaaaagtggtttagttttgggctattatcatttaa

SEQ ID NO: 95438 - DNA, 385 bp, Homo sapiens
tagagatgggatttcaccatgttggccaggctggtcgcgaactcctgacctcaggtgatccgcctgccttggcctcccaaagtgctagggttacaggcgtgagccactacgcctggacgacagtttttgcttgtttttcgtttttgctttttaccaggtttttattcttctatgggtgaatttaaaagcatagatgtaaattaggttgacagatctgagctagtataaggacatagtcttttcgcacttattggaaagcctctgatttttattattcacaatcaaatttggactgtatataattctttaagtaatctgggtgtggtggcttatgcctgtaatcccaacactttgggaggctgaggtgggagtatcacttcaggac

SEQ ID NO: 95439 - DNA, 1268 bp, Homo sapiens
ctgttccctgagaggagatgacacaagggatgctatttactagacacttcaagagtcatggccactgttggtatcttggggattctcaagcagttttgaaacccaaaaccaagaaaataacacaggatgcctgaggatgtattgccctgtgaggtttctgaaatgaaacctcaacccaaagacattctgatggggtgtctgtgccaagggaagattaaagaaagggacacaaatattttctttccttttattttcttttttttttactgtggattgtcaggggattattatgtgctttcatgtcctgtgaaatgtttacaaatgaaaaatattttttaaagtgtcatccactgctttttgaaaaaatgcagaattaaaatactatgtctaaaatgtacaataaagaacagttgataatgttgtgagttacacaaggttagttagtgttggtaagtgtcaggaaagaactggaaatttaaactctgactgcaagcaagagttaggctggggtaacagggtggtagatttgaggctcttcttgccacacatttggaaaatgcatgagaaaatgaattcttttttggagcattaaaacaactaaaaaacaggcaattgcattgaggtggctctagtgtactgacctctgagtggagagacaggcaaaggcatccctagatccaaaaagctgcccattcttctccagctgtgcacctgattagataatttccactccagcacccgtgactggatatagttcaattccccaccaagccccctcaggccatgagtgacatatgtgatttgacactggattgaataaagcaagaattataggtttttcctggatccttttctggcagggcttccttcatgcactggacactggccctgcctgtaaaatacttgcattttcatttgtgtgtaagattatttgtatttatgaaaaatatatatgtgttattcatacatggaagcaatataatgacaattattttaaaatttcagattttttactttcctggcacatccaggttttagagcaggcagcctgagatttcaaaaatgaggcaattctctaagaaataatatgtgaggcacatgtgaattttaaatattctagtagctacattttaataaatacaccaggcatggttgcctgtgcctgtaggttgaaatgtttgggagactgatgtgggaggatcatttgaggcaaggagtttgagactagcccatgcagcatagagaaagccatctcaacaacaacaaca

SEQ ID NO: 95440 - DNA, 1216 bp, Homo sapiens
ccatgttggccaggctggtctcctgaccttgtgatccacccccgcctcgcctcccaaagtgctgggattacaggcatgagccaccacacccggcctgaaaatggggtactttaaaaatagatgaatagtggctgcctgagtagtggagagggtcttctggattccttttccaatactctcctgccctcaagaagctccagctcaatatgttcttagttctggtaaaatagcaatgtcagaatatcaaattaacattaggcacatctcatcacagtgactcccatatattgaggctatgccaaagccccatgctcaagacctttggaaaccgtctgtaatttgactctgaaaatacaaagtagctaaattgatcttgccacctggctagcccttttggcctagagaatgcgctgatctgttcatagtggtccttttgaaaaggcagaacacgagcagtgagagaggtaagaggattcatgttgaccttagaaacttcacccagaaggtgaagctcatttaaactggtagattttctatagcaaaagaaaggagaacaagtaattacatggtttcattaagctacttaatttaggcccagtcagatctgcagttctctctggtctggggttaagactagcagcgttggattatttgtctttcctggctaagaaacattgtgctttcctcctgccccccaagttcttgaaatgcaccttttctttcaccaaaaagacagctatcgggtatttaccccatcctctaacacaccttcaaatgaaggttcctgattgagtcaatttgctgtggatgaagttagctgtttaatgcgaaagcagtctaacttctagtagcctagctaaatcctactgggagccttatacacgtagactaaactcttgctggtatcttcagatagtaatgcatttgtgtatttcagatgagttcatcttaattcacttccattttttgccttctattgccttgcttggcaggtagctgcattccatagtgtggcattcagtatggtggatttaaaagtgagggtgggagggtaaagtaggggttaggaacttttgcccaaggatcaggtttagtcttgcttatgggtaaactggtggggttccggaaaccgacatgggtcttccagtaggagtgggaacacatgaaggacccccaacaattcctttaattagtgcttattctagtttgagcactg

SEQ ID NO: 95441 - DNA, 778 bp, Homo sapiens
ttctgaactgaccgttagcgccactcccaccgtgctgctcgctacgataatcgcgccaccacttgtcctccgtagctctggagtcctggcctgccggttgctaactgggccactttacagaggcagaagcaagctcagggagggtaaacaggaagggtaactaattttcctgggattacacagtcggtaaataatggaggcagcatcgaccccaggcagtctggccccagacaccacacttttacccaattcccacagctgcctggaaaataaatagaaatcaaatagatgttaacaaggacctttgggagttgtccggcgtttgggcaacggattgcttttctgtttcatgttagtccaccgccctcacgtggccccgtcctgaacttcacccttgtttggtcccaaactgtaaagaccctcacggtgctgggaaacacagccctgctggcctcggactgcaggacagaatccttacccctcctgggcctccgttgtgttctttccaaaatgggataatggtagcaggttaatggaaataattaaataaaatagtccatctaaattcctggatcgaacgaagggtccaataaacattagctgtgctgttgtagtgctcagtgcctctctctcaaaagcgggtggcaacagacaccctcacaccttcgctgtaatgagagctctgcaaagccaactgcaaatattaggaatcagtgtcctcacgaggccaacccctttccaaggctgcttggaaaatgctttgctagactagcttgga

SEQ ID NO: 95442 - DNA, 188 bp, Homo sapiens
ttgcttatgagaggtcctaaggaaccctgtagcacagaatgctgttttcaaggaagagcaagaaggttccactgtttgatgcagggatatctgtcagtacggtaaatgatagtataaggatttttaattttaaagtttctatcaaacgcaaggttttttgtttgtttgtttttgtttgtttgtttgtt

SEQ ID NO: 95443 - DNA, 382 bp, Homo sapiens
atgggatcccccccaaatttcaaaagctccaggcctcaccaccctgggccttcccctgagctctcaccccagccaggccctgggtatatgtcctctcagtcacactcacatccaccgaataaagtgggtctgttattatcccttttacagttaatctaatttattggctcatattcctttctccaaaacatgttaaggattctgacacttaatttggaagtgcccaaaagtctacatcacagaagaaatccccattaccctttattaccacattatagagtccacgcgtgtcagtgactctcatatcagaggacagagacgataccctctcactgtgacctacagtgggtactgaaactctcaagacagcagctaacgtgac

SEQ ID NO: 95444 - DNA, 588 bp, Homo sapiens
aagattataaagaccatttaaactggagattgtaatttattcttttacagtccagcatttaagtgaaaatgagaacatcacaatttgggaatctgtaatggttttgttgaaaacattacttgtggcttgtataagagtggctgaattcaagaacattgattcttagcagatcaataatagtatttaaagaatctgatgctaaaattagaaacctaaatgatttgtaatttgtactgtgacacagcagatgatgtttccttattttctgacatctttttatgtttttggagaggcacattagaggtgctttaaaaaaaacctgtgaatttttaatattttgtggtgccatttgtgaagcacctctttcctgatccatctaactactcctgtacgtacagtctgagtttgtcccacttgttgacttggttacttccctattgtatttatttctttaaagggttgttttagaattttagaggaatttatctgagaacacaagatctaccactttcagtaggacaagtgacccaagttgttggtcaccagcctcaaagtttagaaaacactacctactacctactgatagaa

SEQ ID NO: 95445 - DNA, 713 bp, Homo sapiens
agccaatagaatgtcctaagatatgcagttggcaagctggagacccaagaagagccaatatttcagtttgagtctgaaggcaggaaaagactgatgtcccatctcaaagcagtcaggcagagggagttccctcttgttctcactcaaggaaggatggcgcagtgctcccgctgttccgaggctcagctaccctgagggaggcagggaattttgatcagcttctgaagaatcacctcatctctccccgcagagagcacagagcacaggacttcacgttatgtcaacatctcttgcaaaagcccagctcctagagagcaggagccttcccagactgtgtcaaattacctcggggatggagagacttacatggcattaatagaaatcaaatggcagagctcgggtttctgatgagtctcctgaggttcagaagggtgagatgacacattcaaggtcacatggctcatttgtgttggagtcagaagtttccagatttcttgacttttagtccaaggagcagtccctgtgcatgtgtcagagttgaacaagccagctggactgagtgcccatgacctcagggacatcttggaagctatatgtagaagatggaaaagcctctgtcatctccatcaatttaatctccaaataactacttagaaaagggacagcttactaactccttcattgcccagtactattaggtgagtaagaaataa

SEQ ID NO: 95446 - DNA, 796 bp, Homo sapiens
gcctggtcaacatgaaaccccgtctctactaaaaatacaaaaattagctgggcgtggtggcgtgcgcctataatcccagctagtctactcgggaggctgaggcaggagaatcgctggaactcaggaggcagagactgcagtgagccgagatcgcgccactgcactccagtctgggtgacggcatgactccatctccaaaaaaaaaaaaaaaagattttggagtagattcatcattaataagtaacagattttaggaaaatcaaaaaatggctaataaaatgaacacaatgtaaaacatttattaaaatgtagacttttaaaaatctataaattgatcatctgtttataaattggcagatggttgtgtaccatcttttaaaataaagattgaatttcacccagtgtgatggttcccattgcttatatttctcctgctgaggccggacctgatatggccctggtctgtgttcccagccttgtttcctcattaccactaaaatctttcccctgtatgcccgcccaatttttctggctctgagtccttgttcatactgttctctccaattctaccttccaaaggcctttcttaacaccttcggattctttctttgagaactttccagattcccatgcctttttggaatcaatctctatcctattgtcatcacatttaagtttctacttccatcatcctcactcctatccctttggtcctgggatgacagggatgctgtgttttatttactcatctttgtaacttccacataacctaaccccggttcttgcttatgggaga

SEQ ID NO: 95447 - DNA, 1006 bp, Homo sapiens
gcctggacaaaccaggatgagttgtcaacctgcatgggggcaatggatttggccatgaacttcatcatttcaaagtattaagttgttggcattctgaatgcccctgaacctattttgcatcgtagagtggacttgttccccagtgacccatgtccacccctagtggactcgatcaactcctgacacacccctactaggaacacgaaaatggttgtagaatgtgtttcattgtcctcatccacagatacagacactttggtgactctgtgttctatctgaatgggggctgagactacaggataccccatcccatttctgtcctctgtccttcatccaaggtgtcaccatttgtatcaggaaggaggctttgcagctaaaatttaaaataataagaagaatatatttccgagccagagattagatgcctacatatctcttttggcctcagcattctgtggtcttctatggagaaaggctaattttctgaaggctttgaatggaatgaaaactgcctgttcaaatggttctgaggatactgagagacgctcagtgtgtggtctttttatttttagtaatagtgttggaaaaaatcaggttatgtttacgctgagtgtgtggggggcgctggtgagattgtgtagtctagaaaaggctagaattataaattattataaacgttggccatgtggggaaattcttataccaaaaatactgcaatgtatgtcagcctatagattttcatgtagtttcttgtccaaaactgtatatgagagcagaaatgattgattatgttatgttcaatgtatacctaatatctagtgctgatacataaataaacccatcatttgtgacaagggtcttttgtccgcatttaattttattttgttactttttatttatttatttatttttcagccagggtcctgctatgtcgcccaggctggtctcaaatttccggactcaagcgattcccccacctcagcctcctgagtagctggggtcgagg

SEQ ID NO: 95448 - DNA, 417 bp, Homo sapiens
  misc_feature (379)..(379): n is a, c, g, or t
  misc_feature (410)..(410): n is a, c, g, or t
  misc_feature (413)..(413): n is a, c, g, or t
cctctcctgagcctcttttgtgccgccctgggcaggagcacaccctagtgccgcaacattgggtgaaaagcgggatgccctcccattatcattagcagtcatcctccttccactccaacagggacatctgctatgagggagttatttttacaagatgaagttaaatcttgagctgtctttaaagtaaaaacaatgaagcagcaaagggaaataagtgccttttttgtttgttttttgagacagagtttttgctcttgttgcccaggctggagtgcaatggcgcgatgtcagctcaccacaacctccacctctcaggagaatcgcatgaacctgggaggtagaggttgcagtgagccaagattgcaccactgcacttcancctgggaggcagcgcgagactccatctcaanaantaaa

SEQ ID NO: 95449 - DNA, 374 bp, Homo sapiens
agtgaccacggcccatgtcctgccccacacacaatgacaaagaagagatggcactaaggatctttgcttttctcctctctccagccccctcaactgcagtccaatattgttactaatttctttcctttggcccaccttggcagacagctcattaactgcctggaaggaaatgccctctggttcaaagcagcttcctgccaagaattcattcatttagcaagaaatatgcaggatcctccccccaccgccccccaccacccgtgccatgacacgggctgggtgccaggaatgcaaaagaagaagatccagatgagacaatcatgtttttaaaaagcaacaaatactggagtcagaggtgttatcccagtgtgaga

SEQ ID NO: 95450 - DNA, 406 bp, Homo sapiens
accctcctcagcctcccaagctgctgggattacagatgtaagccactgcgcccccaggatctgcatttttaaataccaccctaaagaatccatttgcaggggtcaaaccacactttcagaaacatataattccttgggggtacacttcctggaagactgcaaatgcagagttttatgtggctttcgagtttgagggagtgagtaaaagaaatgaattttttagttctgaataaatgaaagatttttctttaagtgatctttctcagagattaggggttctatgacttttatgtgacagaccaaaagacataggaaacttttggcatcctaggtaccaagtcaataaatatttattgagcacaaactttgtgtcacaaatgatagacaattctagaggcttctaccc

SEQ ID NO: 95451 - DNA, 939 bp, Homo sapiens
ctttcttcattcagcatctgctatagatgccgaatgagaaacaagggcaggggattaagcttgaaatctcattccttgctgactcaggctctctttcaccctttattcttatagagggctcaagatctgtgggtgtcagctgaagagattaggccaacacccccagcccatttatatactttggtttctggccaggcaaggatttgtatagtgtttgatttttacatagcgtaaacactcttagttctttttctccgactccagattctgatcctctggatcaccacaagtttcgatcttagctgggataacagagggtgtctcccctttctgccaggccctggctgccctagcagagtttatagctcttggctgttccccctgctgccctgcaggtctctgcttgctactcccaccatcaccccatgatttcagcactgtagccttgcctagcccaccactcaggttgggcaaagttgtaggtttcctcagaaagcaagctccctgacttagctgagcccccacagggggtgaggtaagcaagcctgtcagggcttgcctgctgcctcccacatctccctgcagtatcttaccatatctccacatactcagctagccataggctccccaatttttttggttttttttttgagacaaagtcttgctctgtcccccaagctggagtgcagttgcacgatcttgacactgcaacctccacctcccgggttcaagtgattcttctgcctcagcctcctgagtagctgggattacaagtgaccaccaccatgcccagctaattttttgtaattttagtagagacagggtttctccatgttggccagggtggtctagaactcctgatctcaagtgaccctcccacctcagccttccaaagttctgggattacaggcgtgagccaccgcgcctggcctgtgctcc

SEQ ID NO: 95452 - DNA, 399 bp, Homo sapiens
catgcagctgttttggagctaattcttcagtccattcaatcattgactccttgaatatataggaacaaatgagcaacatcaataacacctgtcaattcagtacaagctaaggaaaaccattcaaaatcacttgccttgctttttttttctaatcaaaaaaaaattttttttttctaatcaaaaaaaattttttttttagaaatgggatctcctgtgttgcctaggctggatttgaactcctgggctgactcagttccctgagtagctaggactacaggcataggccacctcatgtggctaacttgccttgttttactattgatgtttgtgtcctgtgtccttaacactttaagcagctgttctcacctaaaggctaatagttttaagtaagtttctttt

SEQ ID NO: 95453 - DNA, 309 bp, Homo sapiens
gcaaacgcacagtcaggcagcccccgatgaacacacagtcaggcatctcccagcaaacgcacagtcaggcagcccccgatgaacacacagtcaggcatctcccagcaaacgcacagtcaggcagcccccgatgaacacacagtcaggcatctcccagcaaacgcacagtcaggcagcccccgatgaacacacagtcaggcatctcccagcaaacgcacagtcaggcagcccccgatgaacacacagtcaggcatctcccagcaaatgcacagtcaggcagcccccgatgaacacacagtcaggcatctc

SEQ ID NO: 95454 - DNA, 312 bp, Homo sapiens
tgtgggccaagtgtgacaggaggttagagagagagacagagaccttgcaagacctcagaggccacagtgtgcaacgtggacctattctccatgcctagggcagccattgaaggctgttcactcgaggagtgatgtgatgtgtaggatttgcattttaagaggtggctctgtctgctgtctggacagtggattggaaagaggtaagagtggaagcagggagcctggtgagaaggcacgtgcagctgttcgggtaggactacattcatgggtgttactggaagtggaggaaagacagacttgaggtgtattttg

SEQ ID NO: 95455 - DNA, 429 bp, Homo sapiens
cagtaacagctgtaacaattgttgtgtggccacgacctcaccgtcactagatcccagggctgtttagccccatcttataaatttggaaatggaggcctggagaagagaggtgaccagcccagggacctctggtgtgaggagactctctgggggcctgtggattcgctgggaggagtgttctgcgatggccctgactgtgctgaactcagcagtgacccagtgaccccggtgagggtgcctgatgcctgagagagggccaggtgggggccggcgcaggggcccccaacctaacacgctaaggctaggaggcaggcctgggctctgccatgtggtctcagaggagatctgggtctctgggcctgcggtggggacggtcatgatgcccactgcctgcgaggctgcaggacccagctcagtgctaacctgcgc

SEQ ID NO: 95456 - DNA, 406 bp, Homo sapiens
caaggtgagatgtattttacagaataactgaccagtattcatcctaagtgtcatggtcatgaaagacaaggaaagactgggaaagtgtcacaggttggaggagactaaggagatataaggaataaatgccatgtgggatcccagattggatcctggaacagaaaaataacattgggaagaaaattggtgacattcaaataaggtcttgagtttacttaagaatcttgtaccagtgataattccctggttttgataactgtgcaatgcatggcatgtaggttgttgacattgggggaatctggataaaaagtatacaggagtttcctgtatcacttttgtaacttttctgtaagcctaaaattattaatatttcaaaataaaatgtttaaaaggcgaggctgaacta

SEQ ID NO: 95457 - DNA, 359 bp, Homo sapiens
tgaagcgaagtcaatgtgatggtgcaggtagactgcttcccgctgtgagcgacacacagtgaacgatggtccctcaagctccatcctaaaccctctgctctgtttcctatcttcttcctcacgttagtgtgagcggctgcatcacttcccctagtggggatgccaaaacgggctcacagcccttcccctcttgtgggatatttaggtctcttgcgattctcctctattgtaaacactgtgaaaaatgtctcatttctttgtccttctgctggatttcaagaccccaaatccttcacataagttcttccaacagcgctctcctctccagaaggaacctttttgctaccaagttggtcaga

SEQ ID NO: 95458 - DNA, 344 bp, Homo sapiens
taggaaaaatcctttttggcctaagaagagaaagctgaatcagacaattacttccaacaattacttccattaagccagggttttgcttttatgattccttttaataacagctacgttaactttaacagcaagagagagggttacacagacttttggccaggcgcagtggctcatgcctgtaatcctggtgctatgggaggctgaggtgggggaactgcttgaggccagaagtttgagaccagtctgggcaacacagctagaccccatctccaaaaaaattttaaaaaattagctgggcctgtggcatgcgcctgtagttctagctactcaggaggctgaggcag

SEQ ID NO: 95459 - DNA, 797 bp, Homo sapiens
ctgaagaaaggcctgctatagttgtggcaccaagcaggtacctgttcccctctcctttaagccgtatgactgagcatggtggactggaagcgtaccatttcctcctcaaacaaggaagaagtgagagaggctggaggagccctgaagagcatggaaaatggaggcaaagttctctgtcagccactggggaagcattcactaaagcaatcgacaaagaagtcacgtgtggcttctccagagggaagggcttcagtgtctaactcctgctctaagtcctgagcctctccactgagacatccaggcacttgggctcccagactgaaggtaatccagtaataccaatgttgaggctacttcccaagccctatcttttggaatcttaaaaaaaaattttttttaaatttaaaattttcctcatgcataccacagatcttttggaatctaactctcatttagtagtggaagtcaataaagaaatgactttggttgacagtcaatttagataaattgacattccttgtatacaaataaggaaatacatttgtagtatatagaaaatgctaaaaaacagaggtgccattttctccacaaattattgtaactcttgtcaaaggggacaattccctgtatcaataacttgtagtgtatggagaggagaaaaaaaagtagagcaaagggtatattcttctttccctttctctgccttaccccagagaaatttcatgttgtcttctgctacaaggatttatccaatcactgcccagccatctgttgactttctggtttctacccaactt

SEQ ID NO: 95460 - DNA, 547 bp, Homo sapiens
tctgcttggtatcaggaactgcgctaggctcaggagcttcagtggtaaataagagacagtcaatccccaccctcagtgattataaactcctttaaaggaaaacataacacttttctttttctcaaactttctgtgtctgaaggctcactagcatctgtttccagcatagatgtggtgtgatttgttcttcatgtcactcgcttctaattcagagtgaggggctgaggcatctggtagtagagcttcttgttcctgtgccccatctttgtggattctgggaaagtgagaatctaggatgtgtgggctcaacctcaaagttgggatccccaaacataggaacagggtgggatatgaacaagaacataagtgacagataacaacatcaatttttccttttttcgctggatcattccttcaccacacaaacatgccgttcttcctcccatcctcaatattctcttctaaccctactttccctcacaacaactgcccactgctctgcctcttgcagcaatgctcttcaaaggagttcttcttgtccattcct

SEQ ID NO: 95461 - DNA, 396 bp, Homo sapiens
ttaatgcaccagaccattcctggcctactgtgcaaggccctgtggtgcaggtggggaggcgggtagagatagagagcgaggtacagctgagtgcagatccccagctctgagcatcactgggtgtgtgacttactcaattcatcatttagctattgagagctgatgttaggcatattctttcttttcttatgaagccttggtttattgtgggcctcagaatagaagcttcttggcctgaaaatgaagttctttggaagtgccatctgacacttctcctggtgggcagagttgctgaaactggaagcagggggtttgaggggtgctgtaactgatgtggggagaccgactggggacaaagaatgaggatagtaacaggagatgactcctcctccccag

SEQ ID NO: 95462 - DNA, 440 bp, Homo sapiens
acagaagtttgttgacccctggtgtaggctactacagtcacctcctcactcttcctgctcctatccttatctagcccctatcctcccagcctagtctccagccagcagccagagggatcctgttcaaccctaagtcagatcacgtcccgctcctgctcaaatccccacaatggatatcacctccctccaaataaaagcacagtcctcacagtggaacctggctccatgtggtctgcccaccctcaggttcatcacctccctgacctcatctcctaccctctcctcactacactgcccacacagtggcttcctgcagctcactgcagcctccgcctctcaggtcagtgattctcctgcctcagcctcccaagtagctgggattacaggcatgcgccaccatgcctggctaatttttgtatttttagtagagacagggtttc

SEQ ID NO: 95463 - DNA, 830 bp, Homo sapiens
caggcctcaatgccttctgaagtgtctcctatgcagattctacataaagagtgtttccatactgctgaattaaaaattctacaaaaagagtgtttccaaagtgctgaatcaaaagaaaagattacgtctgtgagctgaatccacatatcacaaagcagtttcacaggccacaatgggctcccaatgtccctttatggtttctacaaaaagagtgtttccaacttggcctcaatggactcccaaatgtcacttcgaagatcctccaaaaagagtgcttccaacctgctgaattaaaaggaagctttaactctgtgagatgaatccacacatcacaaagtagtttcacagatggcttctttctagtttttatctggggatattccatttttccctatagtcctcaaagggctcccaaatgtccctttgctgattttccaaaaacagtgtttccaacctgctgaatcaaaagaaaggtttaactctgtgagatgaattcacacatcacaaacagttcacagaaagcttctttctagttcccatcagggaatattcagtttttcctcataggcatcaatgggctcccaaatgtcttttcacaatctccaaatacagtgtttccaacctgctgaaacaagagaaaggtttggctctgtgagatgaatccacacatcacaaagcagattcacagatagcttctttctagtttttatctggagatattgagtttttcccataggccacaatgggctcccaaatgttcttttgcagattctcaaaaaagagtgtttccaaactgctgaattaaaagaagggtttaactctgataattg

SEQ ID NO: 95464 - DNA, 755 bp, Homo sapiens
  misc_feature (525)..(525): n is a, c, g, or t
  misc_feature (627)..(627): n is a, c, g, or t
agcggactgagttctcctaggctcccagatatagaaagctctaagagttgctacaggagatagaattgaaactatacataggctgaggtgggcactgcggaggattggctatgcgagggtattaatgtggtgcggctgtacctgcctgttttgtgaaagtcacttctctgagactgtgaaggtgagaagcccaggatccactagaagcttcactgcggctctttggtgggggaaagcattcccagtggtagctgtcctcatttgcagcgttattctcggaaaccaagtatgtgcagcagtgacagactatgccacagctcctctgcagtttggaagctggaacaaatggaaagagcttatagccaagagaggttgtgatttttttttttttaccatccaagctttctctggcagtgcacaaatgaaggatgagcttggtggcaagcaaaatcagcagactgcctgacagggggtttggatcgaacggttggaagtaagcagccttgcccaaacatccagtgcagnggcctccagtaccgatggcagcatccacacagactctggggatggaacaccagaccctcagcgcacaaaggctgccatggctcacctgcagcagaagatccngaagctcacagaacaaatcaagatggcacaaacagcccgggacgacaacgtggctgaatacttgaagctggccaacagtgcgaccaacaggcaggctgcccgcatcagcaagtctttgcgaaggcagg

SEQ ID NO: 95465 - DNA, 715 bp, Homo sapiens
agcggatatggggaagaaggcaccttgcttggcccacagagcgactcttgaactgtgtggtcctcacccaattgctggatctgacgccttatctctctcatccctacttcgccgttcactgcacagagcgcggtgagacttcctgaacgctctgcagttcatcgctacactcttcctccatatctagaacgtggcctggcacatattagatgctcaatcatcattttaaaataaacgagtagtgatccattcaagtaacgtggataaacatcaacaacaacagctgctttcaggaaaaaagggcagactctgaattatgaagaatgtgagaaacttagatcagtatcatgaagattgtgtacttttactttttagggcagctttattgagggacaaatcacccattttattttttagttttactgaggtatgattgatataaaaaatggcacacatttaaggtatacatcttcatgagttaagacatatgcatgcgaccatgatgccatcgccataaccaaaggttaaatatatccattaaatatatccatatctccagaaattgccttgtgctattttgtaaatcatccatttaaaatttataattcaggctgggcgcagtggcttacacctgtaatctctccactgaggtcgaggcaggagggtcacttgagcccaggagtttgagaccagcttgcacaacatgataagactg

SEQ ID NO: 95466 - DNA, 681 bp, Homo sapiens
ggctgcaggtgggcagcagggcccttcctttccccacaggcagggaacacttgtgtttcctttgtttacttctttagcttatgtcttccgcgatgaaacggtaacttcctgaacgctctgcagttcatcgctacactcttcctccatatctagaacgtggcctggcacatattagatgctcaatcatcattttaaaataaacgagtagtgatccattcaagtaacgtggataaacatcaacaacaacagctgctttcaggaaaaaagggcagactctgaattatgaagaatgtgagaaacttagatcagtatcatgaagattgtgtacttttactttttagggcagctttattgagggacaaatcacccattttattttttagttttactgaggtatgattgatataaaaaatggcacacatttaaggtatacatcttcatgagttaagacatatgcatgcgaccatgatgccatcgccataaccaaaggttaaatatatccattaaatatatccatatctccagaaattgccttgtgctattttgtaaatcatccatttaaaatttataattcaggctgggcgcagtggcttacacctgtaatctctccactgaggtcgaggcaggagggtcacttgagcccaggagtttgagaccagcttgcacaacatgataagactg

SEQ ID NO: 95467 - DNA, 422 bp, Homo sapiens
agttaaatgcactgaaacttaaaactgatattgtacaacataaacataaagatgaatgaaaaactccatgctgagaattttgtaataaggaaatagactgggtgcggtggctcatgcctgtaatcccagcattttgggaggctgaggtggggggatcgcttgagcccaggaagtcaaggccacaataagccatgatctcaccactgcagcatgggcctcagagtgagaccctgtctctgaataaataataacaaatatggaatatgtaataaaataatgtttagtttttaacaactaaaaccctccatgccaagttgcgaggctgagctgcgagtcagcagaggaaagggctgccgcctcttctaggtctctcgactgcaccttttcttgcttttcgagcaagggagtcgcatggcccatcc

SEQ ID NO: 95468 - DNA, 388 bp, Homo sapiens
gcttcttgaaaatagggattttgtctggctggctttcctgctgaatccccagcacctaatatggtgcctggcccatacagagtccttaacagatgttcaataaatattaatatctactaaattattttctgaaatggatacagtatctgagatggttaattttacgtgttaacttggctaagccaaggtacctagatattgatcaaacattcttctggatgtcactgcaaagctatcttctttaaaagattaacatttaaatgagtaggctttgagcaaaacaaatgaccttccataatgtaggtgggcctccaatcagttgaaggccttaatagaaaaaagagcgacatccacagagcaagaaggaattcagctagcagagtgcctt

SEQ ID NO: 95469 - DNA, 126 bp, Homo sapiens
gatcctcccatcttagcctcctcggtagctgggactacaggcgcacactactacacccaattatttgtttatttacttatttttgagatggattcttgctctgtcgccaggctagaatgcagtgga

SEQ ID NO: 95470 - DNA, 201 bp, Homo sapiens
gaagtctctggagctaagctgggacctgtatgtgggcactgctggcagaaacataagtgtgtgtggataaactcttcattagtggaaaggaatcttagttttcggctgattttcagtggtgggcatgaccccaaacagaatctgagatgatgtaataatcatctgtgatttgattgtacttataagattcagctaaatctt

SEQ ID NO: 95471 - DNA, 347 bp, Homo sapiens
atgttctctctcacgggtatacaaggtaagtatcaaagatttgtttccttctgtttttaagactgtatagtattccattgtgtatatatgccacattcattcattcaactgctaatgaacactaaggttgatttcatatcttgactatcatgaataatgctgcaatgactatgggagtgcagatacctcttcaacatgttaatttcagttcccaatagggatatcactttgaatcctagacaatcaaggctcagcactaagacattctgcaaaacttcttcctttctttcagtttagtatattctatccagatgcctaatttattgggtgcgtgagagagggagcat

SEQ ID NO: 95472 - DNA, 464 bp, Homo sapiens
aaactatgtagaaacacaaggtaataattgggaatcatttctacagatgttgcaatgaaatcaattggtgactttatctttaaaattggacttcatgtgcccttatacttaccgactagattgcttattatgtattcactggatctgttctgtttctgaaaataaaataaataagaaatgcacttcctctaaggaagacaggacgagccagtttatactttagccttatgttttctaaccttaggagcatctgcccctgacagtaggtgcttggcagtttcatgggacttaggaggagtgtgctgcagaagaaggatgactgcattgtgtcagggccagtgggtgccacgctcatcctggaagccatctagcagacctcatgtggcaaatgatgataggggaaaatatctcccacactataagccttctgttcttttaatccacatgcacaaaaagagaaagaa

SEQ ID NO: 95473 - DNA, 199 bp, Homo sapiens
cctaagtagctgagaaaaaagtttgctagaatttgaatttttgttaacagtgtttgaatatcaagtctatctttaaaaaatatggggctttctaaaataattttctctacattagccttcctattaatttaatgcatctcagttgtatcagaacttttctagttctagttacaaaaactcaactcaagccaacatcagc

SEQ ID NO: 95474 - DNA, 751 bp, Homo sapiens
ctgtctctattcaaaaaaataaagagagagaaatagaataaaggttcccaggaactcatgggagggggaatggagagttattgtgtaatgggtgcagagtttctgtgtgggatgatgaacaagttctggcaatgaatagtggtgatggttgtaccatattgtgaataatatacttagtgccagtgaactgtacactcgcctgggcattggaggcctgggttgaaccaagctcaactgactctagctaaggctttggaaaagcctctaaatgtctcattacctcatgtcccaaatgtcagactttagaatcatgtgaacagcctatttctttttgtgacagatgtggagtttgcatgataaaggattagggtctcacaataaaggtgacaatttcaccaataaaggtgacagtgaccagagcctagctctcccagctcctgccccagtggcactggcctcaacaaaatagaactattccaacctcttatgcttttgagcagcaagtcactcaagaaatatggttgtaatttgcaaattacaaatacagaacaaacaactatagcctaggcaacatggtgaaacccctgtctctacaaaataataataagaaaaaaaatttagctgggcatggtggcacacacctgtagttccagctactcagaaagctgaggtgggaggatcgcttgagcttgggaggctgaggctgcagtgagctgtgagtgtgccactgtactccagcctgggctacaga

SEQ ID NO: 95475 - DNA, 217 bp, Homo sapiens
aaggggtgggggcaatagcttgggacaggctggaggagataaactggggcagctaacccaggatcttatcagccatttaggaatgtggactttattctagggataattggggaggagcagaggtgacatcagatttgtattttaaagtaattggctgggggtgtacggtggctcacgcctgtaatcccaacactttgggaggacaaggcaggtagat

SEQ ID NO: 95476 - DNA, 410 bp, Homo sapiens
aacaattacttatattaaaaccttcctgttcacatttcctcctccttggactagatgatcaaaacgaacatccccactgtggggcagatgggcattgtgtgcctcgagatgcgatgccctgagaggccgcgtgacgcaggtagtggttcagccacctggaatgcaaaaccaaatctaatcacgaggaaattgcagacaaacgcagataagcagcaccacctaaaacgaactgtatccttacaaactgttcctatcatcacagacaaagctatggaaatgatccagattaaagaagaccaaggagacatgacaactcaactgattacctgatccagaccagatccagcaccgcagagggaaaggtgctatagaggacacgatgcggccaatgggaatatgagtggtgaggt

SEQ ID NO: 95477 - DNA, 742 bp, Homo sapiens
tgtagcaaaacattgactaccaggtcccttttgctttggataaagaggttcctccccagttcattcacccttgcattgtttctcacagggtcatcccacagaacgtctgacttagaatcacttgggacattgctaagtctatagattcctgggccccaatccagatttcccgaatcatactttgggggtacaacctaggaatgtaaatctttacaagctcctcagtggttttcatgcacactaaacttttagaatcagtgttatataataaaagatcaaatgactgagaagaagagaatatgtttaaaaatgaccagatatgtaaattaaaatccttaatacattcctgggaacatgctcagtgtttgtggaagtgtgaaaggcaaagcaacactgaccagaaataaattctggaaagcaccctgaagaaactgttttgaacaaacaggttaatttatctctggtttgcatccaaacccagtgacaccaagttggatggtaaccagaaagcgttatggaatctctttaggtgagtgatagtttagggaggtgaacattgctggtttgacattcaaccttaaaacgaacatcagagtttttcagttcacatgttttctcttactgaacaatttcctaatgaagtactggaaaagacaacctttttctccattactatttggaattttagatcacatacatcgcctgttccaacacctaaatgaaattaaaaagttaggttggt

SEQ ID NO: 95478 - DNA, 246 bp, Homo sapiens
atgacatattattactacgctgtgaatttttaaaaatatcgtttacattgataacaatcaatctcatctagcctttcaaaactgctcagcaatcttccttgaataaggctctatgttctgcaatgtatattttatgccttctgaaaaagctaaggattttttttttttttttgagacagagtcttggtctgtcatccaggctgaagcacagtggtgcaatcatagttcactgtagcctcgaccttc

SEQ ID NO: 95479 - DNA, 387 bp, Homo sapiens
ccaccactcccggctaatttttgtatttttagtagagacagggtttcaccatgttgcgcaggctggtcttggactcctgacctcaggtgatccacctgcctcagcctcccaaagtgctgggattacaggcatgagccactgcacccggcaggcaaattatttggtagggtaaaaagcagtttgttatcttcattgagtctgttcctcacaataaactattatcactcacagacaccttgattgggagagaaaaactttttgtttgtgttgggaccaggttgaggaagggaaggagacaggtctaggagttgctggtggaaactgtgggtacttatcaggtgggaggttgtaggcagagaggtttccgtttaaggaacactgagagag

SEQ ID NO: 95480 - DNA, 330 bp, Homo sapiens
gaccctctgaaaacccaaagaagctttggctaccaggggattcatttctcatcttaaaattattctttagagacaagatttaaaccttcactttctaggccttagagttcccttctcagaataacaggtggattacaccgatggctgcattctccccacagcggccacaggatatttaaaaatgtaaatcatgtcccataacctgccttcccattgcacttcagatatccaggttcctcatccaggccttcgagggcctttgggatcctgctgtgctccctttacatgcctggcttgaagctcctcccctgccagccttgctcttcccct

SEQ ID NO: 95481 - DNA, 553 bp, Homo sapiens
aaagaaaagtatccaggaatctgggttcccagctacctgctctaagtctttttaaccatactcttcctcccatgaaggagagcaggggggaaggtactgtattctaggagcttaaaagaactgaaaatcatgcaggaaagtaatgataaatgattctatgataagttgttaaaattaattaatactttgtaattaaatgagtttagggtcataatgattttaaaaattgctgttagcttaaaaactctaggcctctcataaataaaaccttatctaaatttgactaccacagaacttccttataaagaatgtgccaaatcatgaaagaaagaccacgataagaataggaaactacaaggcacatctcccacattctctttggcctttgccactaactccttttaaaagatttccccaactgaaaaataatcaaacaaataaaaacctttattttcaatgttaaatgggcaaagttatacttaccacctacaatttaggggcattgtaagggggctgatcggttgatatcttaaccttctaacattcttttatc

SEQ ID NO: 95482 - DNA, 263 bp, Homo sapiens
caagcctacccaccccaccttggcttctgctgttagtgtactgtgggcttcgaaagcagaaaagaatgcttgttaaaagtagaacgtttgataacgggagtttgggtgacttccttgggcctggcttcagggttcaggctttttagggagctgttgcacaatttgagacccaggggggggaaaaccacagaacaaaacagcaagtcgggcttgggccgccggcttccagggcgcccaggacagtgggcgggcgagtgtgtggt

SEQ ID NO: 95483 - DNA, 202 bp, Homo sapiens
agacagagaccaagaaatccccacaaacgtagctaagaaatagctttcatttcctgtgttcagtcgttttcaaaccagatgcacctacctgggaagatttttaagtgccaatgcctgggtcacatccccaggtgactctgcttctttgatctgatggtggggtgaggtatctgtattttatttacttatttttatttttttg

SEQ ID NO: 95484 - DNA, 584 bp, Homo sapiens
ccagggttcggcccatactacttctagcagatctaagaagatgaaaggaatctaggaaaaataaagggagaagacaagacaagaagtgatagcatattaccagttagttcctggtgtgcccctctggttggaggactctgctgagcatcttgctcattttatgcaaagggaattgagccctttgggcaaagggtgttgcttctttggatttcaagaatctctagctaatagagcttaacctctgtttgcatttttgcttctgtgatttagggctaatttccaatgggttgtacaagataatagaaaaatgtatcatttatctcattcttgcagttagtggaggacctttattaggagaggaggctttcttttctgactaggctccaaatttacagcccctgacccacttcagggggttgtgagcaggaaaagctgatgttgctgtcttgacctctttgccgccaggatttggcttctgtgcaattcctagtggttgtcctctcattctctagggaaacggggaactttgctcccagcacctgattaaactgcctctttgtagggtggagtccgctgcctttgtt

SEQ ID NO: 95485 - DNA, 309 bp, Homo sapiens
atgcctgtgtgcatgcatgtcccacatcgtgtgtatgtgtgtcggtgtgtgtgcatgcatgtgcatgcaggttcagctctatgcctgtgtgcatgcatgtctcacatcgtgtgtgtgtgtgtgtcggtgtgtgtgcatgcctgtgtatgcaggttcagctctatgcctgtgtgcacgcatgtcccacatcgtgtgtgtgtgtcggtgtgtgcatgcatgtgtatgcaggtgcagctgtgcctgcgtgcgtcacatcgtgtgtgtgtgtgcctgcgtgtgtacatgcacgtgtctgttggttcacgttgc

SEQ ID NO: 95486 - DNA, 425 bp, Homo sapiens
agccatggtttgggccctttctccccaggaagcctcactgcaccctcattaattagttggccaccttttcttctcaactctcacaggtcttgatctgagacacccatgtactaccttgagttatgttcattgttttctccaagcagaacatgtgtttttagggcagagcctacgagtccgctttgccatatacccccattgcagccagctcggcacatggctcaccactcggtgaatactcattaatcgatttgtgtggacaaaagttaacaataactattccactggcctgtgcttatgagtcgattactactggaccagatccttctgtctttgaaatcaactctctcgggctttttaacatagctgaagaccagtcagagttgtttttgttttgttttgttttgttttgttttgttttgttt

SEQ ID NO: 95487 - DNA, 448 bp, Homo sapiens
agattctgcctttcctgaatagctaataaaagcccctcaataagataccatacactaatcaaactaagaaacacaaaagagcatctatttgtatctatcattctattaatttacatcaaacattatatctatctatcacgtttcaattctccgccttgtatgagtttcttcttgatttccctatcactcttctttttaaaaatacattgacatttctttagttaaatggttgctattatctttataaagcataatggtaaagactgacttgtgtaaccattctttagcagtgggagttatgaaccttaagcggtgaagaaatcattcttggggagataggaggcaaaacggacaggatagaagaactgcacttgatgacttgtcctgggtggtattaatagtttcatagacatttgcttactaatagattattgaattatacattttg

SEQ ID NO: 95488 - DNA, 944 bp, Homo sapiens
catggggttcatgaagcctctgaaactcagcttaagagtccataccaaccaaggtccttataggaagagcttgtgtttttgttttgttttggctttctgcagtctcttaataatgtttattgaatgagagaatttaactaatttccggtttccataatcactttaaactcggtatttgatttccttttccctgggacctgtgacagtgccagcttcatagcctagtctaggcatgccagttgcccactgtggcaatcaatatctgagcctgtggtttttgccttaggtaaactgtagagatggactcatggaatgcttggaaaatttttcagtttatgataatgtgtaaatgtcgagagccaattattgaggaatggcacctcaaagtatttgggtactctagatcagacatgaccatcttggtgtgtgaaattttgctaatgcatctttcctaatagaatatacaatctcagggctagaaagtcttagagatcatttaatttaattcctccagattgattaagtggtttgtccaaggtcattcaactggtatagtggcagagctcaggctgtacaaatcaggtgagtattcttcagctcctcagaagccagtaacttccactcacttgtgtgtgtctgaaattcattaaaccttcgacacaaagtgcagccattttaatgctgaatgatattcatcactgtctgaaatgggcttatttatgtacgaatgtttattcctatctcttcctccattctcccaaaatgtaaaccccataagaacaggaatcttgtctgtcttagtcacactcagtatccttagagccttgtgtgtagtaggtgtgtagtgaattttggttgaatgagtggcagttctaataatgtcagaagaattggaatttctttacagaaatctttatcagtaatttaacaaacatcgattgaac

SEQ ID NO: 95489 - DNA, 385 bp, Homo sapiens
agaacagttatcatattcagataccattttagagtgctgggcacacaacagtaaaacaaaacaaatcccactctactaaaactaaagacttatttatatgaaaactggagttcatagcttttggaaggcttactaaaggtcatttcctcagtagctcacgcctgcaataccagtaccttgggaggccaaggtgggaggatcacctgagcccaggagttctagaccagcctaggcaacatagggagatcctgtctcaatacaaaaaattagccaggttatggtggtgcttgcctgtagtcccagctacttgggaggctgaggtgacaggatcacctgcccaggagctgtgactgcgccactgcactccaggctgagcaacagaggc

SEQ ID NO: 95490 - DNA, 482 bp, Homo sapiens
ctaggttccccaagactgtctcatatttgaaccccaataaaaaaaaaaaaaagaatcacaactggaaacatttcatttagtacccaccacattttcaaggacctggaaggttcatgttccaatatatacaaacagagaatatgcctagcacatagatgatcaataagtttatttattttttcttttttttcttttattattatactttaagttttagggtacatgtgcacattgtgcaggttagttacatatgtatacatgtgccatgctggtgcgttgcacccactaactcatcatctagcattaggtatatctcccaatgctatccctcccccctctccccaccccacaaccgtccccagagtgtgatgttccccttcctgtgtccatgtgatctcattgttcaattcccacctatgagtgagaatatgtggtgtttggttttttgttcttgcgatagtttactgagaatgatttccaat

SEQ ID NO: 95491 - DNA, 276 bp, Homo sapiens
tcatcagacctcactgtgtctgcagtagaaaacatccctttagtgattatttttgtgggtcctacagcttcgttgcccttttttcctgaacagtactgaatgcatattgtaagtttgccctcaatcctttatttttaggtttaccaccttctttctgttgaggtattattgttactattacacgtgttaatggattaaactacttcttacttatttttcctaggcctgaaaaatttcagattcttctctttgtgtgtaaatttaattagcttaacc

SEQ ID NO: 95492 - DNA, 385 bp, Homo sapiens
gtccttacataggcctcgagagctataaaaaaacagatgcagaatctggagtcttgtgaaatattccagaccagcttcttgacttatagtgggcaaaattgcacgtcagtattttaatcaaataaagcactcatttcctctgacattaaatgcagtctggattttctgtttctcaggtggatattttatatagttatgaaggctatttttgaagaattaattttcctcacatttaaacttgttttcttattagagatacaacctaaccagctacccagttctttgtgccatgaaactccttcagaatgtctggtttattgtactgagagtgactattgcatctaaatcacttctccaaagttaccaggagaggactctaaggtca

SEQ ID NO: 95493 - DNA, 303 bp, Homo sapiens
gctttttgcccgttgaccagataaatagaactatctgcattatctatgcagcatgggatttttattatttttacctaaagacgtctctttttggtaataacaaacgtgttttttaaaaaagcctggtttttttcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtcaaaaaaaaaaaa

SEQ ID NO: 95494 - DNA, 824 bp, Homo sapiens
agaatgagacggcaagggatgtgtagctttttcaatcctggccataacattcttcttcatgctcttctcaatgtcctttctcctttcattaggtaaaatggagatgatccccagggccatcttggaaacagtttttgaagttggtagagtctcgggcccgcttaactgctgaaagagtaggaaggggtccgtttcattagcgcgttcaaccaaagagcgctgttaggtgagcaaaaacaaaccagttgtgtctgagccaacacccgtttgtctatgggttgtagcagttggtccacctaatcaaggaagtgccgagagcacaggacatgaaaagacacagcgctaaggtttcctgcaccacaaggttcctttcacttaaaaaaaattttttttatattacaccatctttatttgtaccttaccgtctaaggctatcaatcaaacttcagtaagaacagtttcagcatcaactaacgaacagtagccaaaccagagagcagtcaaaagtgttttaaagggagcagcatcagctgatgttctgccaagtctctgggtgttcaggaccatggtcccccggcacttccaggcccctgtgggctgcaggtggatccccaggagccaaagggccgctcaggaaagggtggaacttggcctcgcaatcagctggcttctgcctattatggtcatcttctttccagaggtcttgctatctcagtggacgtggctgtcatccagccgtcctgggctgttttctcatagaagaggatctccctctgaaaactgtgtcatccttcaattcctgggccaagtctggggacacatct

SEQ ID NO: 95495 - DNA, 703 bp, Homo sapiens
agaatgagacggcaagggatgtgtagctttttcaatcctggccataacattcttcttcatgctcttctcaatgtcctttctcctttcattaggtaaaatggagatgatccccagggccatcttggaaacagtttttgaagttggtagagtctcgggcccgcttaactgctgaaagagtaggaaggggtccgtttcattagcgcgttcaaccaaagagcgctgttaggtttcctgcaccacaaggttcctttcacttaaaaaaaattttttttatattacaccatctttatttgtaccttaccgtctaaggctatcaatcaaacttcagtaagaacagtttcagcatcaactaacgaacagtagccaaaccagagagcagtcaaaagtgttttaaagggagcagcatcagctgatgttctgccaagtctctgggtgttcaggaccatggtcccccggcacttccaggcccctgtgggctgcaggtggatccccaggagccaaagggccgctcaggaaagggtggaacttggcctcgcaatcagctggcttctgcctattatggtcatcttctttccagaggtcttgctatctcagtggacgtggctgtcatccagccgtcctgggctgttttctcatagaagaggatctccctctgaaaactgtgtcatccttcaattcctgggccaagtctggggacacatct

SEQ ID NO: 95496 - DNA, 368 bp, Homo sapiens
taggatcttccagctaccaggaggcaagagagacaaatgaagacaccacagagaacaggaaagcaaaagaaaaggagaaaatacaggagaattggtagaagaaattataggtaacataaatgtgaggaactgaatgtgggaggctacagagtgccaaaagaaattagcttaaatagccaggcaaggtggtgtgtgcctgtagtcccagctactcaggaggcggaagtgggagcatccccttgagcccaggattagagaccagcctcagcaacatagtggaaaccccatctcaggaaaaaaaagaggaaagaaaagaaatttttgcctaagccaataatactaaggttttctttttttttttctttgag

SEQ ID NO: 95497 - DNA, 499 bp, Homo sapiens
cagaagagagaattttcagaggtcctgaatctgccgtttcgctagtgtcaccttatgagagctttttaagagagaaaaaaaaggatggcagcatgaactcagctgggccccgtggtcctcagcccagccctcggcagaagcagtgaattcagccataactacagcagagtctgatcattctcctgatgaaattacactgatctaatttgcacgctgtgaagacatttggcactggctggatctgagccttgacatcttcattggaactaaaagtacactaagaactgacattacgtttcacattcttttctgccaggctgtggcatttcatcctctttaaaggcattatttcaagaacatttaatttggctttgatatgcctgccattttgctgggtggaacatactgcgccagaaaagctcagctgtaataaagtttggcaccaacagctcaccatatacctgcaccatcctgtgcaatttaattggcattcagtggg

SEQ ID NO: 95498 - DNA, 275 bp, Homo sapiens
gtgtgtatcctagcggggagagcaagagacagtgggacaaaaataataacagtaatagcagcaatgcttcttgaggactttccgcatggcaggccctattctaagcacctcatgtagcatattttaccctcaaacagtcctgaggtaggttctgttattgcgattttataaatgaggaaactgaagcacagacaagtttaaataactcgttcaaagtcatacagctcatacatggaggccagcatgcaggccaggtgtgtggggtatgggcattg

SEQ ID NO: 95499 - DNA, 327 bp, Homo sapiens
gccgctcttgaggatccacccgcggcgagttcatgcaggtgaggaatagggtcccaggcagactgatccagcctcccagctgcttattatcttcactggattctgctcaagtctgcttcttcaagctccctgtttattctgagttctatcctatattcttttgatggattccttttcctgcttatgtcaatccatcatttctattgtttgcaaatcacagcccttgatcactctagaaactaaagtacagaaagtgccctgactttgctagaagtttaggtgtaaaattagtagtaaagttagtaaggaaaaaccaaaggggaagat

SEQ ID NO: 95500 - DNA, 661 bp, Homo sapiens
aagaatggtctccaacttatgtgtatccactatagccaaagagtgtcagggcaattgtccatcttaattcagggctattaataagccttattttcatattgggcatcccaaacctaaggtttcttctccagtctctcccaggaagctagattcatgcttctttttgcatatattgttcctgcttgaaacaggtgttagttattgctctctgaaacgtacctttacaagagtgtaaagaccccgagggtacatatgtttttggttgattcccagctatgcttaatatctgggtcctctcattagaatttaagttccacaaaagcgtaaaatctcatgcctagaacagtgcctagcgcatagtaagtgcttgataattatttgttgaaataatgaatgaataatgatggatagttattctttaagacccaattccaatgccacctgtcccctcccaaagcagctatgtgtctctcctctgatcctttagtactgtttgcatttctctataataatacttacaggatactctcttaattgtttatatctgttttcccaattaagctggggaatattttatggccggaactatgttttataatgccatatgctttgtgcctaaaacaatagaagttcaataaatgcttattgcttgaacggctga

SEQ ID NO: 95501 - DNA, 522 bp, Homo sapiens
aactgtggaactctatttccatgcacaaatgatctctggaatatgcttaatatgacatctgacgacactccatcatcctggtcccttttctttctccaattttttccgctgttgggaataccatttcctcttcttgacacatttgtaatgtttagtcttgcgactttctgtaacttttcatggaaaaacaatcttcatatttttctctgaatcctatccttttaatttttctttccctatctggctcataggcatagaaggtagtgaagatggccaggcacggtggctcacggtgtaatcccagcacttttggaggccaaggtgggaggatcacttgaggtcaggagtttgagaccagcctgaccaacatggtgaagccctatctctactaaaaatacaaaaataaaaattagccaggcttggtggcaggtgcctgtaatcccagttactcgggaggctgaggcaggagaatcacttgaacccaggaagtggaggttgcagtgagctgagatcgagccactg

SEQ ID NO: 95502 - DNA, 385 bp, Homo sapiens
ttagttgtattaaatgcatttcaacttacaatattttaaatttatgatgggtttattaggacacaacctgatagtcaaggagcatctgtacttcttacaggtaagaccagataaagatatgttttttacactctttctgcaatgctctttactactggagcgtttgtctctataaaggatatagagctagtccatggtcatcagcaacttgtgatatcaaaagtgaccaaggtcattagtgagtatattaaagattcccaaagaaagcaatttcactctttgatacaatgggtaaaattgaaggagtttatacatatttgcttctgtatagtattcctagttccagaaaggattttaaagcagctatttttcctttttcctaatc

SEQ ID NO: 95503 - DNA, 440 bp, Homo sapiens
agcccaccaaccaaatccattttgtttcatgatgacatcacctttccaacttgcaagtaactcagcttctcccattctgtgggtcctgtctgcaacctcagcctcgtcaggctaacaggcccactagaatctgtggccattccccaaaatttatttagtgaggctgtgaaagcaaactcctaagcccccaacctccaacctgcctgctctgatggaaaactggaagatcacatgatgtggtaaaataaacaatttttaagtcatgtttaagtaagactctctggctttcacttataatttagtctttgaaacatctatgaggccaggccaagtggctcacacctgtaatcccaacactttgggaggccaaggcaggaggatcacttgagcccaggagttcaagaccagcctgggcaaaatagtgagaccctgcctctgca

SEQ ID NO: 95504 - DNA, 461 bp, Homo sapiens
aatgaagacccaccccaggaagctgctaggatcctgccctgcaatatttgaagtttgcatgctcgtggccacacgattctcagattcccttgcagatttgattatttatagtagcagattgagtaatcagttgaaaagaattcctttcttcatgactacagggaatatttttcttgaaattattttgaaatccttttgctaagcaagataagtctgaacctgtattagaggttgaaaagtgaaagaatagagaatgtgaaatggattatgttaaacttctgaaaattatatactgttacaggtggctaattctttatttgagagagttattaaagaattgggccgggcgcagtggctcacgcctgtaatcccagcactttgggaggccgaggctagcggatcatgaggtcaggagatggagaccatcctagctaacacggtgaaaccctgtttctactaaa

SEQ ID NO: 95505 - DNA, 495 bp, Homo sapiens
cagtcggtctcccctggtgcactcatatgcatcatttgctgtgctcttattgttttttttttttttttttttgagatggaatcttgccctgttgcccaggctggagtgcagtggcacgatcttggctcgccgcaacctccacctcctgggttcaagcgattctcctgcctcagcctcctgagtagctgggattacaagcatgcaccaccacatccagctaattttgtatttttagtagagactgggtttcaccatgttggtcaggctggtcttaaactcccgacctcaggtgatccacctgcctccacctcccaaagtgccgggattataggcgtgagtcactgcgcccggcctaggctgcaggttttattccaggcaaggatgtggctggcatggtatctagtgggatgttatgaaagctggctttgttctgcaggatggcaacagtcaatacccgcatgaatagcaggctctcccagctctcagagcaagctc

SEQ ID NO: 95506 - DNA, 708 bp, Homo sapiens
gaacttcctgataaatcccccagtatttgccaagtagccacctctttaattgtgtggttaccctcttcaccctgttaaaatgctgcatgccagattgcacccttccatggatgcctttctgacattctgcttgggctccaacacatctgtgtcaggctgccactcttcataaatgcccttattacgatgcttgggccaggtctccccaagcacatgaaaaactgcactgttttcgtgggtttggataccaaagaaaattgaatgactgaaaagtactgaagagtttaccttaaagggaggaaactagagcagaagttctccaaatgtgatctctagactcagaacatcagcaccccctggggaacttcttgggaaatgcagattcttagggctccatctcagatctgaatcagaaactctggttatgggggcccagcaatttgtgctttaacaagctttctagggaattctggcacatactagtgtttgagaccctctatccaaaggagagatagagtctcaacttagtattctatcctgcatctaggttatctctggcataatgaagactccctggttgtcaaggtcttggtacaattttttagggctttggagccatcctagaaatgaagtcctcccatatggatcaagactggaataattatccagttcaacccaccatccgtggaaaacccaatcctctaggga

SEQ ID NO: 95507 - DNA, 659 bp, Homo sapiens
aaagattttctcctatgttttcttctaggaaattcataattttagcttttgtgtctaggtgtatgcctattttgagttaatttataatacggtgtgaagagttaaggatcattgttttgcaatggatgtccaattcttctagcaccacttattgaaaatactttccttttcccactgaactgcctttccatctttgttgaaaaccagttgacaatatgcatttctatttctggactcttctgttccagctatttatatgcctatttttaaggcagtgacacattatcttgattactatagaatttgagtaaattttgaaatcacagaatataaatccttaaattttattctttttaaaattgttttgattttgtaagtcatttgtatttccatatacaaaggcattattctcatagaagatgatagctccatgtccctgaagaccttccagtgggacaagatgtagaggtggaagacagtgatattgtgatactgactctgtgtaagcctaatgtgcatgtttgtgttttaggtttttttttttttttttagtttcaagtaaaaaaataatttctaagatagaagaaagttgtagaataaggatacaaagaaaaaaattttttgtatattcatacaacatgtgttttaaactaagtgtt

SEQ ID NO: 95508 - DNA, 462 bp, Homo sapiens
tctccaaacagtgcctggcagaaagtaagcattcaataacatcagctattggccaggcaaggtggcttactcctatattcccagcactttgggaagctgaggcagaaggattacttgaggccaggaattcaagaccatcctgagccacatactgagaccccatgtctataaaaaccaaattaggccaggcgtggtggttcacacctgtaatcccagcactttgggaggccaaggcaggtggatcatctgaggtcaggagttcgagaccaccctggccaatatggtgaaaccccgtctctactaaaaatacaaaaattagccaggtgtgatgggtgcctgtaatcccagctactcaggaggctgaggcaggagaatcacttgaacccaggaggtggaggttgcagtaagccaagatcatgccactgcactccagcctgggcaacaagagcaaaactccatctc

SEQ ID NO: 95509 - DNA, 329 bp, Homo sapiens
ttttttttgagacagagttttgctctgttgcccaggctagagtgtggtggtgcgatctcggctcactgcaagctccgcctcccaggttcacgccattctactgccttagcctcccgagcagctgggactataggcacccgccaccgtgcccggctaattttttgtattttcagtagagacggggtttcatctaagaatctcaaagagtggaacacatgctaaagctttacaaggacagttaatcacctgaatagataggaactctgcttaaaactcaaatattataggaagaacaaagagaaaaggaggccagggtaataaatactacc

SEQ ID NO: 95510 - DNA, 713 bp, Homo sapiens
agagattattatgccaaattaaaaatttttaattaaagtcaagctaaatttcatatatcaatatatcactccacctgctagtctagtctctgttataaaggattggtttgaaagtgcattagtctgtgcaggctgctataacaaaataccataaaacaggtagcttttaagctgcagtaatttagttttggcagttttggaggctggaaaatccaaaataaaaacaccaacaggctgggcgtgtggctcacacctatatcccagcactttgggaagctgaggtgggtggatcacttgaggtcaagagttgagaccagcctggccaacatggtgaaaccccatctctacaaaaaatacaaaacaaattagctgggcatggtggtgggcgcctgtaatgccagctgctcaggagactgaagcaggagaatcgcttgaacctgggaggtagaggttgcagtgagccaagatcatgccactgcactccagcctgggctacagagtgagactccatctcaaagaaaaaaaaaaaaaaacaccaacagattcagtgtctgatgagggcccttgttctgatacataaattgtgccttcttgatgtaccctcacatggcagaaggagcaaacaagcacctcgggcctctttcatgagataattaatcccattgatgagggttctgtcctcaggatttaattacctcccactaagggccccc

SEQ ID NO: 95511 - DNA, 617 bp, Homo sapiens
ggcgccaggtacagccggcgggacgtccagtgccagcgcaggagccgggcgaggccgtggcctccagggttcctgggcggaggacaaggcgcgcagccgcgttggcgcgagttttaaatcggtgccttctcagctttgcaagttcttatcaattgctgcatgccagaggaagtttttaaaaaatggcccccagctctattgcggtgtaattgatggatagaaattgtatttatttaaggtgaacagctggatgatgtgatggaggcacgcagggtggaggggttaccacagtctaggtactctacacatccagagcctcccacagttgacaaatggattttcctaatcagtttcgtcgtgttttgtacttaagttgaggattccacaccgtgtggtactttcagaagagatgtagtggtgaataaatcgcaacggttgtgatgttttcctaattaggtattgagaattaccattggtatttggaattagattgcggacgatttaggaaccgttctcgctatgttgcccaggctggtcttgaactcctcagctgaaatgagcctcccacctcggcctcccaaagtgctgggattacaggcgtcccctctgccccagta

SEQ ID NO: 95512 - DNA, 463 bp, Homo sapiens
attggacttgcagaagtcccagcaacatcagctggcttcacagtaaatgtttctggtgtgttctatgtctagtctaatgggcaaagacagagaagttaatttctgaaatgtgaagcttccctttttgcccttaaaaaaaaattttttttttgagatggagtttcgctcattgcccaagctagagtgcaatggcgtaatctcggctcactgcaacctcctcctcccatgttcaaactattctcctgcctcagcctcccaagtagctgtgattgcaggcatgtgccacacacccagctaattttgtattgttagtagagacagggtttcactgtgttggccaggctggtttcgaactcctgaccttaggagatccacctgccttggcctcccaaagtgctgggattacaggtgtgaaccactgtgcctggctggccctttaaaattaattcttgcactggaaaga

SEQ ID NO: 95513 - DNA, 147 bp, Homo sapiens
ctggcatacaccattcttttattcaagacaaatatgcgagagaatcagcaggagtccattctgacttctagagagtgccctggagcggtccacaggaaggtgctggaaaaggcagccgcagatagtccaggtacacgattatttcag

SEQ ID NO: 95514 - DNA, 390 bp, Homo sapiens
gacactcgcctggtctggaggccctggactccaaagtccccacctgagaatgggtccatgtcctgcccccacataggggtttctgggcaggcagagagctcagaggtcatgggaatggcagtggtatttttccactctctgtcccaagtcatggatactgacttgtttctttgtctacacagagtgcctctgagcccctccagggagggacaggagaagtggtttggggggtgagtgactggggcctcgactgttctcaccttaccgccagccagtcttcccggtcccctgccagtgagagccacttgtgtcttcactgccttcccaccctcagacccctggagatggagaaagtttgggggctcagtagggcagacccagggtcttcac

SEQ ID NO: 95515 - DNA, 510 bp, Homo sapiens
ccaggggacgcatctgacacagccttttgcttgcttgtgacaaacagaacattgcagaagtgatgctgcgtgacctccaggataaagctataaaaggcaatgcagcttgcacattgtttgctagaaccctcactcttgaagctttcagctaccacttaataagcagtaagctcagctcccctgaggatgccacactgtgaggaagccgaaagtagcccacatgaagagaccacgtggagaggccctgagagagagagagagagagagagactgatcagccctcatgaactccaattccttgggattctacttccagccatcattggactaagaccacacgagagaccctaagcctaactcatcctgaattcctgatccactgagaccctgagagacaaaatattgttgttttaagtcactaagttttgggctgattggttaccgagcaataaatagctggcctcgttggctcaagcggtggagtactgcggccggaatttttttatcaat

SEQ ID NO: 95516 - DNA, 355 bp, Homo sapiens
aaaaaaaagtaccatctatttactaccccattgagataataaaacttttagaattagaatagaacctagggctgggcatagtggttcacgcctgtaatcccagcactttgggaggctgaggtgggtggatcgcctgagttcaggagtttgagaccagcctggccaatatggtgaaaccccttgtctactaaagatacaaaaaattggccgggcgtggtggtgggcacctgtaattccagctactcgggaggctgaggcaggagaatcacttgaacccgggaggtggaggtagcagtaagccgagattgtgccactgccctcctgcctgggcaataagagggaaactctgtcttac

SEQ ID NO: 95517 - DNA, 619 bp, Homo sapiens
gtggcacatacctgtaatcccagcttctcgggaggccgagtcaggggaattgcttgaaactgggaggcggaagttgcagtgagccaagatggcaccactgcactccaacctgggcaacagagcgagactctgtctcaaaataaataataaataaataaatattaggaaaataaaaatggtactgatagttcctacttatctggctgccacaaaatgtgggtaaaaggtcctcttgaaaataaaccagctactcacggttgaaatttctataaaggtatcttttcctttctcatgtgcagtgctctcctctttgaactgctgttgagtgctttgcatgctttactcatgagtagtggtcccagctacattgggcactgctggccacttcccccttatggaactttctcttctcttgactcgttagacaccacactctcctggttcttctcctacctctccggtaggtcctgccccagctctttaactacttccttctcctttgcctttttttttttttttttttttttttgtcagatagggtctcactttgttgcccaggctgaagtgcagtggcgtgatcacagctcactgcagcctcgtcctcccctggctcaggtga

SEQ ID NO: 95518 - DNA, 454 bp, Homo sapiens
aaaaaaaaaggctccaaattctagtaggagctatggaagatgaaaagtatcgtattaatatccacgatttattgagtggatatagtctagcccttaatcctcataccaaccctgtgggatgtgttattggcgtaattgctaataccacatacattgttactgtcaggcctctgtgcccaagccaagccatcgcatcccctgtgacttgcacgtatacgcccagatggcctgaagtaactgaagaatcagaaaagaagtgaaaatgccctgccctgccttaactgatgacattccaccacaaaagaagtgaaaatggccggcccttgccttaagtgatgacattaccttgtgaaagtccttttcctggctcttcctggctcatcctggctcaaaaagctcccccactgagcacctcacgacccccacccctgcccgccagagaacaacccccctt

SEQ ID NO: 95519 - DNA, 479 bp, Homo sapiens
gagcccctcccagtcatcctagatgaatacaaagaagaaaaaagtgagataagatagaaagcaagagcaatatcctatcatggcacacaagtttttatacaggttacttctccttttgcttatgcatgaaataaagcagcagcacactaggtagctactactgacatttaagaattctaagcagcctcccatgtaactcacagttaccagaggtctgagaaaatcttcagagcagatcttcaagtataaacaaacaaaaaacaagcagaaaacatacggggctactagagagaagctgaactacagtaagtcagatatcaacaaagcaagttaccactagacataggtctgcaggtggatttcagatttactctctgataaaaaactagcaaagtctgtccttccagctgttcttgtatacgagaagtggaatactccagtggttatgaactataagctctttagtaagatggtgaaag

SEQ ID NO: 95520 - DNA, 897 bp, Homo sapiens
ggccattcaaaatctagttcaatcagaaaacaggaatcccatactgataacaaaaagcattcagaagattgggagaaagacactcatgagcaattaggatctaggcatgggaagttagagttcaatacaataggtatacatggatctagccagcaacatttcggagatacaacttttcatgggcaggtaagatccagcacaggttttgccagataggtattaagtcatgggccatcaagagatgcctagggtcagtctggattcagtaccaatgaaagacaagtatacagccatggccaatcaaatgatagttatgagtagtcaaatgacagcaaaagtcaaagatacattttcagtcactttcttgacagccaagaccctgcaggaattgaagagtataggtatagatattcatcaagcagtgcaaccatatgcagtgggggagacaaaggcaagagtcagagtcaagtctgtcaggaggtatcagaatatacggtgaggatgtgggcaaaaaacaaagaggctctgaggccagcggttaccatacaaaggaaagaacaggctctggttccttctgcttagatagcaacaccccactctatgaatatgtccaagaacaaaggagttattactttgaataagaagccaacataaactagcccaagataagaactaacccagagaagaaatgagacacatacatgaaattaaggtatttaacatgatctcctcttttggtagtaagggtatatgtctgttctttcattttaactatagttctgtactatattactttagtttggtgccaggtgttcttgtaaggctccacattcattgaactccttggttagaaaatagtgaatgaggccgggcgcggtggctcacgcctgtaatccc

SEQ ID NO: 95521 - DNA, 902 bp, Homo sapiens
aatactactcagtattgaaaactttaactgcattctgaaaggtcattgcgccgattggcttacctaagatgtcatttagcttccttttctcatgatttacataaatgttgttaccttaaatgcagaaagatgtgatattctttggaggataaaaaacctaagtgaatgaagctagacacaaaaggctacatattatatgatttcatttatatgaaatatgcagaataggtaaattcatagagataaatcagattcatggttgctgggggaatgggagtgactgcttcatgggtatggggttttcttttggattgatgaaaatattgtagaacaagatagtggggatagttgcacattgtgaatgtgccaaaatgccagtgaattgtatactttaaaatggtgtatttgatgtgtattttattacaattaaaaagaaaagaatttgatatttgcaatcattaccaaagccaaaaactagtgttctcaacgtttgtgaaatgcccaaaccgtggtttagaattaatttatagcattagtaacatgacaaatctattcagcttaaagttctagtaaaatttgtgaatcccatcatagaagtactcctgacagcagcagaaataaagctgtaattcatcaaaatttccttatatttaaaacttctgtgactgagtgattgacttctgtgtcaatgtttattttttatcttttgaaatttattatgattccttgtggcacatcccaatcacgctttttaaagatgtgtttttaaaaccatgctttgaaaaaaatttgtataattttcaaggtttttttttatagttttatactttgtttcttttaaagaacaaatgcaacttgttgtattagagtaagactaaataaattgtactgatgtgtacatt

SEQ ID NO: 95522 - DNA, 748 bp, Homo sapiens
ggccatgtgactagatgtcacccacagaagtgagaggaagtgatttgttccatgtcggagtcaagcttcttagaaatggacgtgcttcttccgggatctctttctccttccaccagctaaatgcagatagcaacaaccacacagtggggacacagagaagtgaagcctggggccctgaatgatcacatggaagagactcacccttctggtttcaatatttgacttatagtggtactgtcccacactgctggcaaccccagaagtgccatcagtgaccccgaaccctgctgaaggcctacacctgctgaagaagctcatgcccagtttgaacccactcatgactgagcccaaggacagtcttgtctgtgccaagggtcctggcggctgcgttgaaggactgaaggtgaggcggatgctgtcaccgttgctggtgatgtcgtttgttgtaggttgaattgtgtcttccaaaagatctgctggagtcgtaaccccaggtccctgtgaatgtgaccttatttggaaatggggtctttgcaaatgtaaccaaggtgtaagttaagatgaggtcatactggagtagggtgggcctttaatcaatgtgactagtgtcactctaagaagaggtaaagagacacagacaggcacgcagagggaacataacatctccgcctcagaccgaggcagagattggaaaaatgtgtctcgaagctaatggattccaaagattaaacaactggaagcctggggg

SEQ ID NO: 95523 - DNA, 116 bp, Homo sapiens
acctaaggaagtcagcaggcagtggaggcagaactggaaggacagaggtgaaattgcctttgcaaagattataacagtgagaaaattatgacagtgacacagatctgacttaactg

SEQ ID NO: 95524 - DNA, 517 bp, Homo sapiens
ctaccagtccctcttttttttcactcactcaaaatatatgtatcgatggtcaaatgtgtcccagacattgtgcaaatctctgacaaaggtaacacaagaaaatgtgtactctgagaacttcttattctgccccagtttaggagattcatgcaactgccaagcaacaataataagagctagcagttattggagtacctcattcctcacaactcgtcataaggcaggtgttatcattagatattccccatgtgtatgcaggatgaggaaataggttcagagaggtcaagtggctcacccaaggggcacagctaagtgaaaggcactgcaggcatctcaaactacccccttcccacaagactccactgcagagcaggacagtcaccctgacaccagcccaatgggttcatcttgcccattacccagatggggctaatttatcaagacaagggaattgcaatagagaaagagtttaatacacatagagccagctaaacaggagaccagagttttattatta

SEQ ID NO: 95525 - DNA, 241 bp, Homo sapiens
ccaggctgctgcctccagagtgttctgtgaggtgtcggctttggaagtcggtcagcctcgtgggaacacatatttgagcaaagggtgattctgctccaaatgctgaatgctggccaaggcctttcctcttactccttttctacaggtatattgtgactgtttgcattttagtctgcagtaggtggccaagacattttttctcccctttcttttctttcttacttttttttttttttttttg

SEQ ID NO: 95526 - DNA, 590 bp, Homo sapiens
aggcaaggtgccacagcaacccccaaatcttgggagagggtctttgggggctttggactttgatcacactgaaactccaagtgaacgtgacttttctacagtcactactcatttttcctgttcatctcccacttgattatgggcaacttaatttatcttagtgccgcagtggacactggcaagtagtagacagtcaatgaatacggacagaagaaaggaagggaggatgggaaggaaaggagagagggaagggatagagggagagaggagcttagcgtgttgaaagcatgtgtacagaaacaaatgaaacaaaaatcaaatgaacagcaggacccggctcaagagacagccgaaatgccagaaaattgtgtggaatctctgaagaatgcaatgggctcagctcaatggtgaagaggtctcctatgtcccttgtggccaagacaaaccaggcaaacctgaggctggacacacagaacagatatttttctcctctttttcttgcatctccaaaatttctaacttcctcttgtatgaaggcacctagacttagtgagtttccctttgtgacttggaagttgtgggaagggaga

SEQ ID NO: 95527 - DNA, 389 bp, Homo sapiens
aggcgatggtgacaattatgttccatgtaatctgttcttcttcgaagggcattgggggcggtgggagtgcttagctctctttacaggcaatgagagagttcactgtctgtaggaaatttaggaacaatagaccccgcatggtggctcatgcctgtaatcccagcactttcggaagccgaggtgggtggatgacgaagtcagcctgaccaacatagtgaaaccctgtctctactaaaaatacaaaaattagccgggaatgatggtccatgcctgtagtcccagctactgaggaggctgaggcaggagaatcacttgaaccctggaggcagagtttgcagtgagcctgagattgggctccagcctgggtgacagagcgaaactcagtctca

SEQ ID NO: 95528 - DNA, 272 bp, Homo sapiens
ccgcacaccctccctcaaaatcacgtgttggtcagggctaaggaagagtacaactgcacccccagcctgatgcagacgcacaacacctcgccaaagggaagggatgtttctttattataaagttccctctgtgcgcaccactcctcacgtactcgaagttggagaacgttttagctgcaatttgattctctccactgcccctcaacttccacaaaacccccgacctcgaagaaggtaaggaaaatagtgcagcagtgcagcagctgggggag

SEQ ID NO: 95529 - DNA, 170 bp, Homo sapiens
aaaaggtaccccattaaaaatagttggtcttttcaagtggcagtcttcatttttcaatttagagtagattattttgtaaaagggaatgtgaacagtcatttttaaagactttcctatatgccagtctctgtgctcaaagtcttatcttctctaatttaataactacaacc

SEQ ID NO: 95530 - DNA, 349 bp, Homo sapiens
tagcaattactaatagaatgacaaagtggattcctttctatgggctggaaatcatataggattgcttacagttggagtggataaatgcagttgtttataactaaaaggtcacttaccataaatatatagctggctctatcttggtgaatgcagacttacatgttaataaatataatcaatgtaagtcaaccaagactctagggttatatatttttattgatcgctttttttaaaaaagaagattttgatcacagttctataatattgggccacataccaatgttttcatagtgttcaagttggcttatgaggccactctttaggcttggtgagtgtttgacagatggct

SEQ ID NO: 95531 - DNA, 182 bp, Homo sapiens
gagccgaagaagagcactagtaacaaccaccacagccccctccccgcccgacaccctccctcggcacccactcactcccccgccccgtttgccgacaccgaccaaccccacctcgttcctttgaacggcgtcggctgcagtcgctgcaccagcccgtctggccaccaacgccgcggagaaag

SEQ ID NO: 95532 - DNA, 473 bp, Homo sapiens
aactttggaaagtacatacaccagcataaaccaaccccctttcaagatctacattattttatttatttatttatttattgagacagtttctcccttgttgcccaggctggagtgcaatggggcaatatcagctcaccgcaacctctgcttcccaggttcgagcgattctcctgcctcagcctcccgagtggctgggattacagacatgtggcaccactcccagctaattttgtatttttagtagagatagggtttctccatgttggtcaggctggttttgaactcccgacctcaggtaatcccagcactttgggaggccgaggtaggcagatcgcctgtcaggagttcaaggccagactggccaacgtggtgaaacctcatctctactaaaaatacaaaaatgagtcgggcatggtggcagagacctgtaatctcagctactcgggaggctgaggcaggagaatggcttgagc

SEQ ID NO: 95533 - DNA, 217 bp, Homo sapiens
aacacagagaaggaggcagatattgagtgatgctgccacaagccgaggggcaccagggattgttgggagtcacggggaagttagaggcaggaagactccttttctagagccttctgagggagcatgtcctgctgactcttttttttttcttttttttttttttgagacggagtctctctctgtagtccagattggagtgcagtggcatgatccagct

SEQ ID NO: 95534 - DNA, 650 bp, Homo sapiens
acctatatttgattccctcttgcaatatgtgcttttgatcatgaaactgctgagaaaaggctccttctaaaccacaaaacaaggttgctgctggtgctggggcccgaggaggtccgcgccggaggagggccacagggactgagcgagtgacagacgcaccacccgtcaatgctgcaaccctgtaaggcctccatggactctctacgtgagtgtagaatgaatcaagccgactcaaacacagcagctattccacatgcagtggaagatattcaaggagacgacagatggatatctcagcacaacagatttgtcctggatggagagggctctgcaaagatctgcagagccctctatgaactgatcatgcagctgatggaggaacacccaaggagagaaacaaaccaccattgcctgactggctcccatcagcgttaatctcttcccagcttccttgatcagttatgccactggcactacagaatccatctctttctcaaagcactttgcattgcaaaatgttcctggatgttcagctctagtgtttgaaagggtggagggatttacactggccttgcacgtagaaggtttattagacacaggagaaaaaatagcctaggaagattgttgtttaaatttatctgaaaccagaa

SEQ ID NO: 95535 - DNA, 680 bp, Homo sapiens
agcatcagagtgcatggaatcatgatttacagctcccctgggcctcacggggaagagagggatgctggatgaagaggagggtgagttaccgagcttctctggacgtcaacgtcctgttctgtgaaacggagattacagcagtgcccacttcccaggctggttgtgcaggttacataaaacaatgtgcttgtcactctacctggcatggagtaagtttcattaactgttagttttgaggacagccacaatagtcatacctactagggttaagtaaatctgattaatataaaggcattttacctgggcatggttgccctgtagccctgtagcttttgaaatgggaggagagtcaccaagtggcattccgaatgtcttcctagaaatgttggaaaatccctaatcctccctgtgcactgtgcctggcacaaggcaagagcctctttcccttctttcatttttatcttttcctagtcttcaggcccctcctgatctctgccctgtagctacttttttacccacctgtaattatcagcagctaccaattacccagccacccaactgtggggaaataagggtaactgtgggttcctggggctcgatcactccctcccagaggtgcatgcccaatcagagggtagcaggaatggacgaaatccttccctcgggcacctaagaaggtg

SEQ ID NO: 95536 - DNA, 462 bp, Homo sapiens
gggagaaaccttcaagctgccagccaccaaataagcccacaaggctcacttccattgtcttctcctctgcaatgccctttgtccctaccagcctgaggcaaacatcagtccctattgtccccttcggaggttaaccctacctccaaaacctcttaagagtatcctttcaaagcatgttggcagagtggcctgctgagtgtccgatttctcagtgtgtgggttgggcctgttgttttgtatgcatagcttggggtgttgatttttgttcatttgttggttggtgtgtttttctgccaaaaaaaaactgttaatccaccctacaagaaaggaaggttagggaaaggggggacacagttggaaaaaggaatcacatttttccgtttcctaaatagaccccagacccacatctgcctctaatattggcaaaagtataaatgaaggcagttggtcagcaccccacct

SEQ ID NO: 95537 - DNA, 569 bp, Homo sapiens
actgtataatctggtggaatgagactaagacataaggaatatatatgtatctgtccaggtgtatatactatatatgtagctacttatatcctacgaaggtagacacatatgtagatatgtatatgctatgtatgtcgatatttatgtgttatccaattaataaatcagaagaagggtaccagagaataccaggaaagaatgagtttcttgactacctaagagacaatgaggactagggtcctgaccgaaggcacctcggggtggcgagctgtgagtgttggtggggcctggcaggattcagccaaacctgctgggctcctctagtcactcttgtcaatgggaaggtggtagccaagaagggcccggccgtgtctgttgcttcctctggactcctagagctcaaggtgttaacattcctggcaaacactcaacaaacatcagtgtgacagtttgtgctggatagtgatggggatatacagtcagggtctctgccatcataaagctgaccatctagtagggctaaaagacaattagctgaacagctatcatatggggtgatgactattgtg

SEQ ID NO: 95538 - DNA, 952 bp, Homo sapiens
cagcctcccaaagtgctgagattacaggcatgaggcactgagccaggccaagatctgtgtttgaatgttagtgctggtcagctgtacctgaattccagagggagggggtataacaaggcctgtgtgacccttcttcccatcatgacctgagctcgtttttcaggttaactttggaatatccctttggccaataggaggggtcccttcagtcagttagggggcttagaattttatttttggtgtacgtgctcaaactgcagctgctacaaaaccaaggccacggtgaccctggggccagtccagctttgtccctgtgctctcgagctgctggaggccaatgcaggattctgcccacagctcacatgtgtggcttcagagcctgggagttcttggggctgtgtcttcacctggtaccgtgtaggggccctgtgagctgagtcaactggaagagcccagagcctctgcagaaggcctgagcagggcccgggcactgtccctggagctctgagtccctcaagctgtgtggcccgcagccaggcgcttgacttctctggcgtttgcttcagagctgggagcctggggtggcgtaggtctttggcaggggtcaggtaggggaggggccagccaggaatcaaacatccctgacaggtgagggggcaggtgaggagggcagggcaggagcccctgtagcacttgtgcagcagcatctggaccggtgcaagccctgagatggcttcaggtcctgctcagagctaagggctcctgtcaccagggattcttccatcactgcacctgcagagcccattgggattggggagaggccctggccttagcttggaacagctgtatccgcctgtcgggtgtgcaggctgtgcactggttaagcctgagcgcagagtctgttcaacgagttcattgtgtggtatttgcttccgcttgctgttgagttgga

SEQ ID NO: 95539 - DNA, 3268 bp, Homo sapiens
  misc_feature (893)..(893): n is a, c, g, or t
  misc_feature (915)..(915): n is a, c, g, or t
  misc_feature (917)..(917): n is a, c, g, or t
  misc_feature (1553)..(1553): n is a, c, g, or t
gagatgggactgcaatagaaatccgggcagcccgaagaggcacccagcgctccagccaccagctgggccgcccgggagtccctggctctagaccagccgcgaggaggcgccgcgagagagctggtccctgcccgcggccggaggagggctagagcccctgggccagccccccgagccggctgggcgggcgggcgggtgggagcagacgccgggcactgtcaccacgggtgcgccgagcgcaccgacccgggacacgggcagctggggaccgccagattccaccagccccccttgccccgcaggggtcctcggctcgcgctcctgggtagcagccacccaccggggcggagggagatgtcgcccggggccagccgcggtccccggggaagccaggcgccgctgatcgcgcccctctgctgcgccgcggccgcgctggggatgttgctgtggtcccccgcctgtcaggcgttcaacctggacgtggaaaagctcacagtgtacagcggccccaagggcagctacttcggctacgccgtggacttccacatacccgacgcccgcacagcgagtgtcttggtgggggcgcccaaagccaacaccagccagcccgatatcgtggaagggggagccgtctattactgtccttggcccgcggaggggtctgcgcagtgcaggcagataccgtttgacaccaccaacaacagaaagatcagagttaatggaaccaaagaacctatcgagttcaaatccaatcagtggtttggagcaacagtgaaagctcacaaaggaaaagttgtggcctgtgctcctttatatcactggagaactcttaaaccgacaccagaaaaggaccagttggcacctgctatgtagcaattcagaacttcagcgcntatgccgagttctctccttgcngnaacagcaatgctgatccggaaggccagggttactgccaagcaggatttagtctggatttttataagaatggagaccttattgtgggaggacctgggagtttctactggcaaggacaagtgatcactgccagtgttgcagatatcattgcaaattactcattcaaggatatcctcaggaaactggcaggagaaaagcagacggaagtggctccagcttcctatgatgacagttaccttggatactcagttgctgctggggagtttactggggattctcagcaagaattggttgctggaattccaagaggagcacagaattttggatatgtttccatcattaactctacggatatgacgtttattcagaatttcacgggagaacagatggcatcttattttggatataccgttgtcgtatcagatgttaacagtgatggactggatgatgtcctggttggggcacctctctttatggaacgtgaatttgagagcaaccccagagaagtagggcaaatctacctgtatttgcaagtgagctctctcctcttcagagacccccagatcctcactggcaccgagacgtttgggagattcggtagtgctatggcacacttaggagacctgaaccaagatggntacaatgacattgccatcggagtgccttttgcaggcaaggatcaaagaggcaaagtgctcatttataatgggaacaaagatggcttaaacaccaagccttcccaagttctgcaaggagtgtgggcctcacatgctgtcccttccggatttggctttactttaagaggagattcagacatagacaagaatgattacccagatttgattgtgggtgcatttggaacaggaaaagtcgctgtttacagagcaagaccggttgtgactgtagatgcccagcttctgctgcacccaatgattatcaatcttgaaaataaaacttgccaggttccagactctatgacatctgctgcctgcttttctttaagagtatgtgcatctgtcacaggccagagcattgcaaacacaatagtcttgatggcagaggtgcaattagattccctgaaacagaaaggagctattaaacggacgctcttccttgataaccatcaggctcatcgcgtcttccctcttgtgataaaaaggcagaaatcccaccagtgccaggatttcatcgtttaccttcgagatgaaactgaattccgagataaattatctccaatcaacattagtttgaattacagtttggacgaatccacctttaaagaaggcctggaagtgaaaccaatattgaactactacagagaaaacattgttagtgaacaggctcacattctggtggactgtggagaagacaatctgtgtgttcctgacttgaagctgtcggctagaccagataagcatcaggtaatcattggagatgaaaatcaccttatgctcataataaatgcaagaaatgaaggggaaggagcatatgaagctgaactctttgtaatgataccagaagaggcagattatgttggaatcgaacgcaacaacaagggatttcgaccactgagctgtgagtacaagatggaaaatgtaaccaggatggtggtgtgtgaccttgggaaccctatggtgtctggaacaaatgtaagagagaaccagaaatactgactgatttccttctaactggacttcacagggaacaaatggaaagctctccagttaccactcagcaactcagcacctagcagcaacaacaaattaggcaggaaattgccagagtagtgggatttcacattataacctacacagagtgaatcgtctcaagctaaaaacacagaaagatgcatgctcttctatgctttctctttatacattactcttgcctgtcttttagttacaacaattttatacagactttgtttttactatagatattttctttaaatactttttctttgaattcaaaaagaaatgcaatgtaagttaaagactctaaaaataaccaaattaggacaaagattttagcaatggcaattaaaggaaggacatgacattcaacagtgaccatagaattcccttttcaagggagattcaggtacgtatttgcattttaaagatgctgataagtctttcagttaataaaccttttagcctgatgtttcatacttttgcttgagcatttgaaacttttctcaagttagaatattatgctagaatgatatttttgctcttttatgctataatgttgcgttgatcttgggtattcaaaaatgtgctgaaactacagtaagctcacttcttggggcaaaaataaataaatatttcaatggcaagtacaaaaaatgaca

SEQ ID NO: 95540 - DNA, 1497 bp, Homo sapiens
  misc_feature (893)..(893): n is a, c, g, or t
  misc_feature (915)..(915): n is a, c, g, or t
  misc_feature (917)..(917): n is a, c, g, or t
gagatgggactgcaatagaaatccgggcagcccgaagaggcacccagcgctccagccaccagctgggccgcccgggagtccctggctctagaccagccgcgaggaggcgccgcgagagagctggtccctgcccgcggccggaggagggctagagcccctgggccagccccccgagccggctgggcgggcgggcgggtgggagcagacgccgggcactgtcaccacgggtgcgccgagcgcaccgacccgggacacgggcagctggggaccgccagattccaccagccccccttgccccgcaggggtcctcggctcgcgctcctgggtagcagccacccaccggggcggagggagatgtcgcccggggccagccgcggtccccggggaagccaggcgccgctgatcgcgcccctctgctgcgccgcggccgcgctggggatgttgctgtggtcccccgcctgtcaggcgttcaacctggacgtggaaaagctcacagtgtacagcggccccaagggcagctacttcggctacgccgtggacttccacatacccgacgcccgcacagcgagtgtcttggtgggggcgcccaaagccaacaccagccagcccgatatcgtggaagggggagccgtctattactgtccttggcccgcggaggggtctgcgcagtgcaggcagataccgtttgacaccaccaacaacagaaagatcagagttaatggaaccaaagaacctatcgagttcaaatccaatcagtggtttggagcaacagtgaaagctcacaaaggaaaagttgtggcctgtgctcctttatatcactggagaactcttaaaccgacaccagaaaaggaccagttggcacctgctatgtagcaattcagaacttcagcgcntatgccgagttctctccttgcngnaacagcaatgctgatccggaaggccagggttactgccaagcaggatttagtctggatttttataagaatggagaccttattgtgggaggacctgggagtttctactggcaaggacaagtgatcactgccagtgttgcagatatcattgcaaattactcattcaaggatatcctcaggaaactggcaggagaaaagcagacggaagtggctccagcttcctatgatgacagttaccttggatactcagttgctgctggggagtttactggggattctcagcaagaattggttgctggaattccaagaggagcacagaattttggatatgtttccatcattaactctacggatatgacgtttattcagaatttcacgggagaacaggtagagacattttaatatcaaataaataaaatcactctgggttaccagtagactataatattcatatcagttattcatccatttgacaaatatttaatgagcagctactacgtactggaaactgtcctaggcaccggggatgcaatcatgcatcagacagacagatcccatccagctctcaggcagcagtgaggtg

SEQ ID NO: 95541 - DNA, 3616 bp, Homo sapiens
  misc_feature (893)..(893): n is a, c, g, or t
  misc_feature (915)..(915): n is a, c, g, or t
  misc_feature (917)..(917): n is a, c, g, or t
  misc_feature (1553)..(1553): n is a, c, g, or t
  misc_feature (3574)..(3574): n is a, c, g, or t
  misc_feature (3615)..(3616): n is a, c, g, or t
gagatgggactgcaatagaaatccgggcagcccgaagaggcacccagcgctccagccaccagctgggccgcccgggagtccctggctctagaccagccgcgaggaggcgccgcgagagagctggtccctgcccgcggccggaggagggctagagcccctgggccagccccccgagccggctgggcgggcgggcgggtgggagcagacgccgggcactgtcaccacgggtgcgccgagcgcaccgacccgggacacgggcagctggggaccgccagattccaccagccccccttgccccgcaggggtcctcggctcgcgctcctgggtagcagccacccaccggggcggagggagatgtcgcccggggccagccgcggtccccggggaagccaggcgccgctgatcgcgcccctctgctgcgccgcggccgcgctggggatgttgctgtggtcccccgcctgtcaggcgttcaacctggacgtggaaaagctcacagtgtacagcggccccaagggcagctacttcggctacgccgtggacttccacatacccgacgcccgcacagcgagtgtcttggtgggggcgcccaaagccaacaccagccagcccgatatcgtggaagggggagccgtctattactgtccttggcccgcggaggggtctgcgcagtgcaggcagataccgtttgacaccaccaacaacagaaagatcagagttaatggaaccaaagaacctatcgagttcaaatccaatcagtggtttggagcaacagtgaaagctcacaaaggaaaagttgtggcctgtgctcctttatatcactggagaactcttaaaccgacaccagaaaaggaccagttggcacctgctatgtagcaattcagaacttcagcgcntatgccgagttctctccttgcngnaacagcaatgctgatccggaaggccagggttactgccaagcaggatttagtctggatttttataagaatggagaccttattgtgggaggacctgggagtttctactggcaaggacaagtgatcactgccagtgttgcagatatcattgcaaattactcattcaaggatatcctcaggaaactggcaggagaaaagcagacggaagtggctccagcttcctatgatgacagttaccttggatactcagttgctgctggggagtttactggggattctcagcaagaattggttgctggaattccaagaggagcacagaattttggatatgtttccatcattaactctacggatatgacgtttattcagaatttcacgggagaacagatggcatcttattttggatataccgttgtcgtatcagatgttaacagtgatggactggatgatgtcctggttggggcacctctctttatggaacgtgaatttgagagcaaccccagagaagtagggcaaatctacctgtatttgcaagtgagctctctcctcttcagagacccccagatcctcactggcaccgagacgtttgggagattcggtagtgctatggcacacttaggagacctgaaccaagatggntacaatgacattgccatcggagtgccttttgcaggcaaggatcaaagaggcaaagtgctcatttataatgggaacaaagatggcttaaacaccaagccttcccaagttctgcaaggagtgtgggcctcacatgctgtcccttccggatttggctttactttaagaggagattcagacatagacaagaatgattacccagatttgattgtgggtgcatttggaacaggaaaagtcgctgtttacagagcaagaccggttgtgactgtagatgcccagcttctgctgcacccaatgattatcaatcttgaaaataaaacttgccaggttccagactctatgacatctgctgcctgcttttctttaagagtatgtgcatctgtcacaggccagagcattgcaaacacaatagtcttgatggcagaggtgcaattagattccctgaaacagaaaggagctattaaacggacgctcttccttgataaccatcaggctcatcgcgtcttccctcttgtgataaaaaggcagaaatcccaccagtgccaggatttcatcgtttaccttcgagatgaaactgaattccgagataaattatctccaatcaacattagtttgaattacagtttggacgaatccacctttaaagaaggcctggaagtgaaaccaatattgaactactacagagaaaacattgttagtgaacaggctcacattctggtggactgtggagaagacaatctgtgtgttcctgacttgaagctgtcggctagaccagataagcatcaggtaatcattggagatgaaaatcaccttatgctcataataaatgcaagaaatgaaggggaaggagcatatgaagctgaactctttgtaatgataccagaagaggcagattatgttggaatcgaacgcaacaacaagggatttcgaccactgagctgtgagtacaagatggaaaatgtaaccaggatggtggtgtgtgaccttgggaaccctatggtgtctggaacaaattattccctgggcctccgatttgcagttccacgtcttgagaaaacaaacatgagcattaacttcgatctccaaatcagaagttccaacaaggacaatccagacagcaattttgtgagcctgcaaatcaacatcactgctgtagcgcaggtggaaataagaggagtgtcacaccctccgcagattgttctgcccattcataactgggaaccagaagaggagccccacaaagaggaggaggttggaccattggtggaacatatttatgagctgcacaatattggaccaagtaccatcagtgacaccatcctggaggtgggctggcctttctctgcccgggatgaatttcttctctatattttccatattcaaactctgggacctctgcagtgccaaccaaatcctaatatcaatccacaggatataaagcctgctgcctccccagaggacacccctgagctcagcgcctttttgcgaaactctactattcctcatcttgtcaggaagagggatgtacatgtggtcgaattccacagacagagccctgcaaaaatactgaattgtacaaatatcgagtgtttacaaatctcctgtgcagtgggacgactcgaaggaggagaaagcgcagtcctgaaagtcaggtcacgattatgggcccacaccttcctccagagaaaaaatgatccctatgctcttgcatccctggtgtcctttgaagttaagaagatgccttatacagatcagccagcaaaactcccagaaggaagcatagcaattaagacatcagttatttgggcaactccgaatgtttccttctcaatcccattatgggtaataatactagcaatacttcttggattgttggttctcgccattttaaccttagctttatggaagtgtggattctttgacagagccagacctcctcaggaggacatgaccgacagggaacagctgacaaatgacaagacccctgaggcatgacaagaaaaaaaaagaagaccaaagacctnaaacactggtcctgttcaaagaaaaagaaagaacatgaggnn

SEQ ID NO: 95542 - DNA, 1980 bp, Homo sapiens
  misc_feature (893)..(893): n is a, c, g, or t
  misc_feature (915)..(915): n is a, c, g, or t
  misc_feature (917)..(917): n is a, c, g, or t
  misc_feature (1553)..(1553): n is a, c, g, or t
gagatgggactgcaatagaaatccgggcagcccgaagaggcacccagcgctccagccaccagctgggccgcccgggagtccctggctctagaccagccgcgaggaggcgccgcgagagagctggtccctgcccgcggccggaggagggctagagcccctgggccagccccccgagccggctgggcgggcgggcgggtgggagcagacgccgggcactgtcaccacgggtgcgccgagcgcaccgacccgggacacgggcagctggggaccgccagattccaccagccccccttgccccgcaggggtcctcggctcgcgctcctgggtagcagccacccaccggggcggagggagatgtcgcccggggccagccgcggtccccggggaagccaggcgccgctgatcgcgcccctctgctgcgccgcggccgcgctggggatgttgctgtggtcccccgcctgtcaggcgttcaacctggacgtggaaaagctcacagtgtacagcggccccaagggcagctacttcggctacgccgtggacttccacatacccgacgcccgcacagcgagtgtcttggtgggggcgcccaaagccaacaccagccagcccgatatcgtggaagggggagccgtctattactgtccttggcccgcggaggggtctgcgcagtgcaggcagataccgtttgacaccaccaacaacagaaagatcagagttaatggaaccaaagaacctatcgagttcaaatccaatcagtggtttggagcaacagtgaaagctcacaaaggaaaagttgtggcctgtgctcctttatatcactggagaactcttaaaccgacaccagaaaaggaccagttggcacctgctatgtagcaattcagaacttcagcgcntatgccgagttctctccttgcngnaacagcaatgctgatccggaaggccagggttactgccaagcaggatttagtctggatttttataagaatggagaccttattgtgggaggacctgggagtttctactggcaaggacaagtgatcactgccagtgttgcagatatcattgcaaattactcattcaaggatatcctcaggaaactggcaggagaaaagcagacggaagtggctccagcttcctatgatgacagttaccttggatactcagttgctgctggggagtttactggggattctcagcaagaattggttgctggaattccaagaggagcacagaattttggatatgtttccatcattaactctacggatatgacgtttattcagaatttcacgggagaacagatggcatcttattttggatataccgttgtcgtatcagatgttaacagtgatggactggatgatgtcctggttggggcacctctctttatggaacgtgaatttgagagcaaccccagagaagtagggcaaatctacctgtatttgcaagtgagctctctcctcttcagagacccccagatcctcactggcaccgagacgtttgggagattcggtagtgctatggcacacttaggagacctgaaccaagatggntacaatgacattgccatcggagtgccttttgcaggcaaggatcaaagaggcaaagtgctcatttataatgggaacaaagatggcttaaacaccaagccttcccaagttctgcaaggagtgtgggcctcacatgctgtcccttccggatttggctttactttaagaggagattcagacatagacaagaatgattacccagatttgattgtgggtgcatttggaacaggaaaagtcgctgtttacagagcaagaccggttgtgactgtagatgcccagcttctgctgcacccaatgattatcaatcttgaaaataaaacttgccaggttccagactctatgacatctgctgcctggtgagttagtccggtgcttctcaaactccaatgtgaattcacatcacctgggtgacagagggagactctgtctc

SEQ ID NO: 95543 - DNA, 507 bp, Homo sapiens
gaatacatttccacaagtaagtgtagcaaataaattggtgaattacagagattcaccaaaacatcaattcctctgctttgcagggtggcaaacttgtgacagtggataactgttctcttcctgttatctagacatcagagtttaatgcgaagtcctagtaggacaggacttggtaactcctagaagtgttccaatatgatttagtacatgatttgttaccatagaaagaataaataacatgtttattgtctgaagaggatggatacttttacttttcctgttaaggtatgaaatataagtgccttacaatttccttccttgctataaacagtgaatttgagtgattttactggaatcttcaaaccctgggtattttctcattgaaaattaaatgcataaccttgactgggaaacagagacagcagactagtgacttgaaactaagaccaatcttgagccttcaaagagaggacattacaggcccagtggttcttgctgaggagcctc

SEQ ID NO: 95544 - DNA, 478 bp, Homo sapiens
cactgaagagagggccagggactgccacgagtccagagacactaggagagaaggcaacggacagtcacatgcagttgtcacctggtgagtaacaaagacagccgtgtattacccaatatccccaaaggcagccttaggggcatcctcctcttggtctccattcctgtgcaaccttatagcttgatccatctttccattctacaagtatttattgaattatttatgagccagattctgtgctcaagcctaggaatacaaaggttgaaaacagaacgaaacaaacagaaagcatggctgtttctattaagcagctcatagtagaatgggagagaagttgagaagaaagaaaaacatcatgatataattgttacaaagcaacagttaaaataatatgaggtaatgatactaacagacatatcaggttaatcatgtggtactatgctcaggtctttacagacactacaccagttgctatcag

SEQ ID NO: 95545 - DNA, 590 bp, Homo sapiens
ctcagtgatacaagaaacaaggcaaaggaaaaaagatgggaccttagaagcaatgccctagagtaaaaagcatacattggcactcagtaaccacagagatagaaacaactgactcagcctctccagaaataacagtagatgtagaatttgttcttaaatatatgtttcgttgaaatgaaatgcagtcatcaaatgcgaggaggggtgctagacctgataagtctaggaagaccagtcagcttgatagccagttgttaaactaaaggaccacaaaggtgtgtttagtagttctgatatgggattactatcagtttatacatatgtatagattttcttttaattataaacagccagatagccagcaattaaggtgttttttcatctttgtgaaattcatggacaaattctgactctaaaatgcacagtctacatgaaatctttgatctcaatctgtatatatatatattgtacatgactgctagtaggtatgaaatgcatttcagagttgaaaactcatgcaacataatcatgtgtttgcataaggaatgttaaaattctttctactacaatttattaacaggggaaaagat

SEQ ID NO: 95546 - DNA, 447 bp, Homo sapiens
taattagatgctaaaaattcccttaaaagttaatattgcattttggtagattttataaacctaccaaatcagatctggaaattgaatttaaaagtttaaggaagaactaggttttaaaaattgcaataggtaaaatatgaattaaaaagaacaaactggtctctgaataatttttctgtgtgcaaaaaattgccattaaatgcataaagtacccacattgacaatttgatgagaattggatgtttttattgagaaattcccatatgacagtatatgtgggtcatttctctagattgtccagtttccaagaacagtccttcaatcccttgcttgtgcaagaataacctgcagcagggctggcttcatgggccagcatcccatgcagtctcacagggccctgctcttagaaggacctcacacttgttctaatgctctgctcaaaaaaaa

SEQ ID NO: 95547 - DNA, 331 bp, Homo sapiens
gggtacagaagccctcctggcccctgggatggtccatagataagtatcagaggagtccatgtaccccaggaaaacgtatgcacaattttactaatgtatttgcagtgttttgggggcagggcctatggtttttagcacgtaagagtgtgagaggatcccaggaagattaagaattgctatagtcaaatgcagaaagtacagttttacaaagggccattctgtgtcacctagcaaatgatctctttcatcctgccctcttgctacttcctaatcacgattcattccatttttccatctttttcatttgatatcaatctattagtgaatgctt

SEQ ID NO: 95548 - DNA, 165 bp, Homo sapiens
aaatgaggctaatgtacaattcttcacctagtaacataagggggtggagaggcagagatgggccgggacgggacattctcccaacctctgtgcaacctcaccgggagggccaggacaccaggggaggggtcacttgtcctgaccccagagtcccccttggtccat

SEQ ID NO: 95549 - DNA, 546 bp, Homo sapiens
ggaaacggcatttttaataataatggttcccaaagtgattgtctcctgtgtcacacctctaatttggattgcttaaccttggtgacatggctgtcattggatctattttactatcttcctgaggtttcaccttgtttctcctcttgggtttgttgtttgccatatctcacattgctttctcggtttgttagtaccttcttggaagagtacaagggagctaaattattttaagacatgtcatgactgaaaacgactattctacctttatgccggatagtttgggtgtaggatagtaagatgggatcatttttcttcagaattttgaaggcattgctccattgtcaccttgcttccagtgttgctgtgttgaagttcagagtcattgtaactaaccatttgtgtgtgataattaagaaatatgtacatttacactatatatacatttctggaagctactctggcttcagagttctgaaattttcacattattatttttttctcttaatgttacatattcagtggtggaccctttcagtgcagcaattc

SEQ ID NO: 95550 - DNA, 425 bp, Homo sapiens
cctaacctgagctaatgctaaaatgttttcttggtcttgctttgccttttctgtgcctagttctctcaagtatttctccacaaagcaacctgaaggctggatggaagaacaattaaaatgtttccaagctccctgaccaaatactatgattacaacatctaaagctatgcattttcaacaccaaaaacaaatttttaaaaaaataataagattggcaaaatgttttggtataaaaaagaagcttctgaaagttcttatctgattattactcatgttgactccctacttcaccatgcaagaaacagtgatttttcttttctttttttttttgtttttaaagatccttgaaagcttttgccttgatgaaacagtgattttatattggcatagcactctgtacttactaaagttatatacttgccatc

SEQ ID NO: 95551 - DNA, 743 bp, Homo sapiens
ttcactttttgaaacgaagagagcgcgataggaagtaggaaagggtgggcgaggggccctgggcggctgctttcgctctgcgcgagttgggtctttgtgatataaaattcgccgagcgccgcgagccgtgctttgccaatggcgcgctcggcgcggggcgcgggctccgggttggggcgagccaacgccggggtttctttgtgtttctgcgagagcgactctcccggtccggagtcagataacagcctgggcccgagcctcgccggctttccccggcccttacaggccctgcccaggctccgctagtgccggccgcctgctccctgcctctcccggcttcctctctctttagccggcctctctctctccgccctctccctccgtctctttctccgagcacactgattagacagacgccagacctccgctctctgcttgtctctcactgggggggttccccgccgggctggggctggggcttcggggtttgtgggagagtcgttccggagtggccacaggccgtctggggtggaccctcgtgccttttgcaaaagcgcctcaccctccccccagactcgcccctcccgctccctctcctccaatcaataagaaatatcagctgtttagcagtaaagaagaaagatgccctcagaatgctacatcccgcccacagcgccggggaccccgaggcaaggtggccaattctgggtcctcggcggaccagccccgagcgggcctcggag

SEQ ID NO: 95552 - DNA, 171 bp, Homo sapiens
ctgggatctaatggatgtgtaggaactgaccaggcaaaggagtagtgtctacatgatgggagtagcatgtgcaaaagcccagagctggagaaggcgttcaggggaccatcactggcgtctgagtgctatttcagctggtttacattatgctgcaagtaactgaagacccaa

SEQ ID NO: 95553 - DNA, 453 bp, Homo sapiens
ttttttttttaaagacagagtctcactcagttgcccaggctggaatgcagtggtgcaatctcaacgcactgcaacctccacctcccaggtcaaatgattctcatgcctcagcctcccgagtagctgggattacaggcgtgtatgaccatgcctggctaatttttgtatttttagtagaaagaggtttttaccatgttgaccaggctggtgtcgaactcctaacctcaagggatccacctgcctgcaccttccaaagtggtgggattatggacatgaaccactgcacccttttcaacaatcttaatgatgtcttttgatgaatggatgttcttaattttaataaaatctaatttatcagtcttttcctttaaagcttatgctttttgtgctccacttaaaaaatctttgcctacaccaaggtcataaggttatttttcttatgttatctttaga

SEQ ID NO: 95554 - DNA, 706 bp, Homo sapiens
tatatgggaaggatttattgagactgaacttgcagcaaatttagtggatatgaaacaaaaaaaaatctggtaggagtttttgttattttcttatctctaccaacaagattatatggcttagaaaacacaagttataaaggaatatctctgttacaggtattacagatgtaacacagatgtaagcaacatctagaattattgcaaaactgggtttgacataagtaattctcatttagaatgagaattctagatatttctaaaggtatttgtttaaaacctgaagaaatatcactataacctgcattccaaatattatagcaattctggttgtacttgtgcatgcaagaaaatctctgatacgttgagaaatctgacatatttcctggccattcttggccctgaatttcttgagctgaactaataatatctgttaataactaatctaccttttctctatagtattgacctgcacaaaatgttttctcaatatcttccctctacaaagctctgtataagatagagggaaattggagagagttgtgattgcactgtaagacctgttaacactcagaattagctattcttgttctggcaagcctgttgattattaccagaaaattttcacttgttctgtttctccctggtgttctctctcctctgtctcctctttcaaacattctccataagtggacagaggccataatga

SEQ ID NO: 95555 - DNA, 597 bp, Homo sapiens
acttcagaaagagtgatggcactgctgaggcgcactgagcatcccactgcaggaaacactgaggtgtgcccttagcaacagaaacacccctctcaggcgcccaccctcaattttggaagcctcttgttacatatgtgtgatgaggaatagcttttgaagtaaatccaagatatgtgcatatcgcaagtacaatatctgagtacttaatatatatcaagtttcaagcttggctgttgctgattgatgtttagctctagacttaaagttgctttcaagtgataactgtcttcattttaggcttgggaagatacacatgcaaaatgggaacaagcaacaaaactaatccttagctatccaaaagcccaagtggaagatggccaggtaagtttgtaaagttgccttttgtctattaactgatctaaatatatgtacttcactttggtaatctttcacgagtcactcagtaaaataagcatatagttgtctgaagactgttatttagttgtggtttgtctagacctgtactttgtaatatgatagccactagctacgtgtgactatttaacttaaattttaacataattaaaattaaataca

SEQ ID NO: 95556 - DNA, 156 bp, Homo sapiens
aattctccggcctcagcctcccatgtatatgcacctttactgctgaatattatatattttcttatgctttcatgtgattgattagcattctttttttttttctttttgagacagagtgttgctgtcgcccaggctggagggcagtggtgtgatctc

SEQ ID NO: 95557 - DNA, 1381 bp, Homo sapiens
agggcgatggagggtcaatgagagctcgcggggtgacgccattctgctggggttctggagaggccaaagctggagacggtcccgtttgtggtcagcacggccttttactttctggccgtgactggcaactgcaccaacgtcctcctctccctcccactgcacactcccacttcctcagcgaccgggcccttctccacctcctgccacagcactcgcagcttctcccaagtgctagttaaccgcgggggctcaggcaaatccatggcccgcgtgggtgtgcggtgcggccctctgaggcctctggctcctggtctggcctggccgcgccggctccgggagctgccattccgccctgacgtcgccgcgtacacgtacctggggcggtgcagtcaccgctgcctctgccagttcgtgtgtgggacgccggccatcaccgcatttccgcgtggacgccggcagggtggaacgcctggctttccccggccaccccagccgccctggcgcctctcgcgcgacttggcctcggcccctcgggggcagtgcactgctgcgcatgcggtctcagcgcccggccttcccgcgcggctgccgccctttccacggtgacgccgtctgcactagcgccgcacccgcttcaactgcctgcaaccgccgctgaattccctcatccccacgctgagaggacgagaaaggcgccctggggaaggctctcgggaaagcccgcagccgctggacgcgggaggacatggaggtaggcgggaacactcaccccgcgatttcgtgtggtccgcgaagctttttctcttcaggacaacactgcacaatggcatccattaataatacgatggggaacgggggccgcggcgctcgcctgcagtcccagcgctttggcaggccaaggcgggcagatcgcttgagctcaacagttccagaccagcctgggcaatacagcgagaacccatcgctaccagaaatgtaaaaaattagccgggctagtggcgcctgcctttagtcctagttacttgggaggctgaagcgggaggatcgcttgagaccaggagtttgaggcttcagtgagctctaatcacaccactgcactccagcctgggcaactgagcaaaaccctatctctaaaaaaagaaaaaagcgccgagattgtgccactgcactccagcctggacgacagagcaagactcagtctcaaaacaaaaacaaaaacaaacaaacaaacaaacaaaaagcggcagggatgtgaatgtgaatggagcaaggcgttctctctttcaggggtctcagactttgtatctttgcttgcaggtggactgactgccccatgtccttcaaagttaattgcaaaagagttcattgcaagagatgatgt

SEQ ID NO: 95558 - DNA, 225 bp, Homo sapiens
agtaggaatctgaaatcaaatatagaatggaaaactaatgtagccaaaccatctgagagccaatagtagagacagacattaaatcacagcacttgttcactagcagtttgggtacctacagtatgctatattgaatgataattgttaacagctagaaacttgcttataaaatgtggtgatgtttctttatgatagatgcctgaccagtgtcctcttccctcagta

SEQ ID NO: 95559 - DNA, 255 bp, Homo sapiens
ctccagtctctgcctgtgtcttcacgtagcctttttcaatgtccctctgtgtctatatccaaatctccgtctctttcatgaagacaccattttagctttgcgcaatggcaatattttagccagggctgttcatctgaggcatgattattgctaattgaaaacttttcacaataccctgccatgatgactggaaatacagtcagcattgacaatttttgacagtctctatggagagtgaactgtaaaaaaaaagaa

SEQ ID NO: 95560 - DNA, 395 bp, Homo sapiens
agggctgctcaggtaaaattcaacattgtcaccgtgcttaacactttatctgatattttattcttcataatgaccctgaaatgtaatgacttttataagccacacctggtaaatgtgaaactgaaaactagaaatgctgagaaacctctgtgttcacattgctgataagatgagggcactgtatgatgacaccccttcagaacccatagcaagtgggacatcaggaggtgttatgggactaatggcaaagaagacaactatgccgctttcgttgtttattatttatatcatccagaaagtccaaaatacatactcagtccatctattagttaggccttttcttgttgcgaataccgactatgactagcttgaaggattttttctttaaaaaaagg

SEQ ID NO: 95561 - DNA, 397 bp, Homo sapiens
gttaggatcgctgggcaggttaattagtgtcgctagcagcccgagtgaggctctgacagacttggatgtttagaccgtctgctgtaccgctaaattaaatgagcacagagaacgtaagacatcagggaacccaagctaatgctcttggtggggcagccccaaagcagaatgttagcaagaaccaaagtgagagacccaaaagccgtacttcagaccctgggcagagatgccctgggcacagcaaacagctaagatgtttgttgctggttaaggcagcctctagtcaggcctggtggggaacagcctatttgtccccagtttttttcagacacctctgcacacgaggtgagaaaacctgtgggcaccagcacttttggacacaaaggacagccttcta

SEQ ID NO: 95562 - DNA, 828 bp, Homo sapiens
caaggaacccagccctcttctccttccttcagggaaaggctggaaaccatgtctggcaggggcaggggttgggtgcccactcaggtaaaggcacgatgtcctgctggtttctgcctctcctgtactcctgcatggagggcatctcgaaacccaagctggaaggacagggcactccagagacctcctgtgagtgtgggccagcacggcctgggctcaaaccccatcctgtcatcccatattgcatgtccacaggcaccgccccaccctgttccatgttccacaggactggagagagatggcagtcatgttctggcagggacatggcacaagcatgcggctgatggcatctcacaggaccccaggctccggagggcccatgcccaggagagccccataagggctctgtgcctaaaagggtgcatgcccaggtgggcccatgcccaggaaggtccatgcccaggatggtccatgagcaggagggcctcattcccaggagggtcccgtgcccaggagggctctatgcccaaaagggtcccatgtccaggagggtccatacgcaagggtgtccatgcctggttgggggggggtctatgtccaggagggtcccatgcctggaagggtccatgctcaggagggttcatgcccaggagagtttatgccctggagggccccatgcccgggagagtcacgtgcacagagggccctgtgctcaggaggatacatgtccaggagtgtccctgtccaggaggctccatgcccaggaggctccatgtcaagaaagattcatgcctaggagggttcatgcccaggagtgtccctgcctaggaa

SEQ ID NO: 95563 - DNA, 440 bp, Homo sapiens
tccctttatgtagcaggtaaacagactgcaggaaaatgtattcagaatgctgtagggtggtgatttcagtcattgtttaactccttttccttctgggtggaactatttttcctggggcctggcaagtatttagcacttgttttgctaacatttagtttgcacagctaaaccaagatttttgcagaatctcagtgggcgggaattacattccctgtagcaatcaaatcatggagacatacgatgtctattcccgtgctccacacctgcttggttttgagatgggcagagtatctcccaacattttcaagctttcaactcagcttgaacatttcaacaaacttcagggaggcagagaggaactggccatattctatggaagcctcagtttgccttctgggaaataccatgagctctcccccgggtgcctcctcctgcttacg

SEQ ID NO: 95564 - DNA, 385 bp, Homo sapiens
gctgagattggcagaaagaacacagaattggaagtcagaagatttgggttttcattcctattagatatcgtataaccttaaataagtcattgatttctgtccagaaatgtttcacatctgtaaagttaagataataccatgccatcactggttgggaagataaaatgagaacctatatggaagtctttgggatagctaaaagtatcttataaatcttaggaactgtgttagtataattcaataggagaattttcaaagatttggagaattgggtagaggctttgactgaacctgagaataagaggatggaaaaaaaatgagactgacttgtgaaataaagtatgaccttgtcctgtggttggaatgtgaggcttttcctatagcc

SEQ ID NO: 95565 - DNA, 940 bp, Homo sapiens
ttctcgccctgtggcgcctctgggccccacggcttgtcggcctccggcgcgcagggctccccagcatcctgggcgccggcccgctgcctgcacaaagtcaactcagacaggatgaacttcggttgccttgtctggctgggctgccaggcggggcagctgacctgctgatggggtgactttcttcatcttcttgcccacaggacagcgggctgggaagccagggccgccgggacctggggctggaaaccacatctgcccacagccgcagcctcctgcacctgtcatcctggcggcgccctgacgtcggagaagcagcaggcgcggagctcctgcagcgggcaccgctgcagcaacccgacccggcgcaggcggcagtggaaggcggcctgctagcacggctcccgcggccccaggaccaggggtgcggccagcaccgccctcactccccgcgtctcgtggatattgccctccctggaggcggctggacctaagcgaggctcgcagcgatcggccccgcgaagactcgcatgcagggctcaggatcccgcattctggcgccgcggcaccgcacctttcagcagccctgctcctcttcttgttggtaaacttttgtcactctgccatgaaaagcatccaggcgtccttgatttcgacattgcgtgcacgctcagccgagctcatcagacgggcggttgtccccagagcccgcgggtagcttgttcccgggcggcggctcctgctggatgcagctccttgtgggcctaccaggcttggtggagccacagcagacctgtggagaggaagagtaaggcgggctctgcagggcagtgggccgggaccatgagagaggcgggtcagtctgggctccaagctcagcctctcggattccccgggacccacggcttataatgcgcttaaatcccacgcctcgcccgagaga

SEQ ID NO: 95566 - DNA, 727 bp, Homo sapiens
ctcctgggctcccgcgggacgtcccggaatcccaggagtgcatcccttcccgcctgagggcctgcctggccctgactcccgacccgctcctcctccgaagagagatcggggccgctgacaggggccctccgcagccaccggggatgggactggggggtcggttcctgtcccggtgcagccgccgccgggtagaccgcctggcttggccgcagccaggcgacatgtagccccggttctgccaggctgggagcgccagccatcttgggagttgccaggcagctgtcgccagcaggtagagggcgcctgcagcttgggcgcccaggtggtggagcacggcctaggcggcctctggatcgcgagtgcacctggcctgagagcccgccaggccctgcccctgctcggctcctcgtctgctgaagctcgggacctctagccagtggccctctgcagccacggggaatggggctgagagccggttcccgctgcagggcagaccacctagctcagccgcagccacagggacatctggccccggttctgagatgtggggagtgctggcgggctcgggggttgcctggaggctgctgcctgcacacagaaggcggatgcagcttggatgcccaggcgggctggaggtgcatggcctggtcggcctcgggatcgccagcgcgcccagcctgagggcccccaggccgtgcctcccgcccattcctccaccggaggggga

SEQ ID NO: 95567 - DNA, 1032 bp, Homo sapiens
ctcctgggctcccgcgggacgtcccggaatcccaggagtgcatcccttcccgcctgagggcctgcctggccctgactcccgacccgctcctcctccgaagagagatcggggccgctgacaggggccctccgcagccaccggggatgggactggggggtcggttcctgtcccggtgcagccgccgccgggtagaccgcctggcttggccgcagccaggcgacatgtagccccggttctgccaggctgggagcgccagccatcttgggagttgccaggcagctgtcgccagcaggacagcgggctgggaagccagggccgccgggacctggggctggaaaccacatctgcccacagccgcagcctcctgcacctgtcatcctggcggcgccctgacgtcggagaagcagcaggcgcggagctcctgcagcgggcaccgctgcagcaacccgacccggcgcaggcggcagtggaaggcggcctgctagcacggctcccgcggccccaggaccaggggtgcggccagcaccgccctcactccccgcgtctcgtggatattgccctccctggaggcggctggacctaagcgaggctcgcagcgatcggccccgcgaagactcgcatgcagggctcaggatcccgcattctggcgccgcggcaccgcacctttcagcagccctgctcctcttcttgttggtaaacttttgtcactctgccatgaaaagcatccaggcgtccttgatttcgacattgcgtgcacgctcagccgagctcatcagacgggcggttgtccccagagcccgcgggtagcttgttcccgggcggcggctcctgctggatgcagctccttgtgggcctaccaggcttggtggagccacagcagacctgtggagaggaagagtaaggcgggctctgcagggcagtgggccgggaccatgagagaggcgggtcagtctgggctccaagctcagcctctcggattccccgggacccacggcttataatgcgcttaaatcccacgcctcgcccgagaga

SEQ ID NO: 95568 - DNA, 1375 bp, Homo sapiens
ctcctgggctcccgcgggacgtcccggaatcccaggagtgcatcccttcccgcctgagggcctgcctggccctgactcccgacccgctcctcctccgaagagagatcggggccgctgacaggggccctccgcagccaccggggatgggactggggggtcggttcctgtcccggtgcagccgccgccgggtagaccgcctggcttggccgcagccaggcgacatgtagccccggttctgccaggctgggagcgccagccatcttgggagttgccaggcagctgtcgccagcaggtagagggcgcctgcagcttgggcgcccaggtggtggagcacggcctaggcggcctctggatcgcgagtgcacctggcctgagagcccgccaggccctgcccctgctcggctcctcgtctgctgaagctcgggacctctagccagtggccctctgcagccacggggaatggggctgagagccggttcccgctgcagggcagaccacctagctcagccgcagccacagggacatctggccccggttctgagatgtggggagtgctggcgggctcgggggttgcctggaggctgctgcctgcacacagaaggcggatgcagcttggatgcccaggcgggctggaggacagcgggctgggaagccagggccgccgggacctggggctggaaaccacatctgcccacagccgcagcctcctgcacctgtcatcctggcggcgccctgacgtcggagaagcagcaggcgcggagctcctgcagcgggcaccgctgcagcaacccgacccggcgcaggcggcagtggaaggcggcctgctagcacggctcccgcggccccaggaccaggggtgcggccagcaccgccctcactccccgcgtctcgtggatattgccctccctggaggcggctggacctaagcgaggctcgcagcgatcggccccgcgaagactcgcatgcagggctcaggatcccgcattctggcgccgcggcaccgcacctttcagcagccctgctcctcttcttgttggtaaacttttgtcactctgccatgaaaagcatccaggcgtccttgatttcgacattgcgtgcacgctcagccgagctcatcagacgggcggttgtccccagagcccgcgggtagcttgttcccgggcggcggctcctgctggatgcagctccttgtgggcctaccaggcttggtggagccacagcagacctgtggagaggaagagtaaggcgggctctgcagggcagtgggccgggaccatgagagaggcgggtcagtctgggctccaagctcagcctctcggattccccgggacccacggcttataatgcgcttaaatcccacgcctcgcccgagaga

SEQ ID NO: 95569 - DNA, 520 bp, Homo sapiens
gacactgaccatctgggggcagttgttttgcttttgcttatttttctataggcattttgttctagatcagtctttttagaaatggatattgttatctgttgatagggaaaatgggcgagagaatagtccaacatctgtacacatatagcaccaccactgaaaaacagcaaaacaaaaccaagagcttaatgattatgccctatagacagttgaaacagcaatagtatctcttaatttaaaggatggcatcttgacctgatatgtgctgggaaaacaatcctcctcctgacttaagtggttctccattatatatccaggaattatatatccaggaatatttggtacagatgctggcagctgtattgaccagagaggcataacagggaagctgcagcagcccccagaagataggagattgggaggtggtgcttacaaagaagccaccctttgcccttaatcaatcgtactagatggggatttgtattttgcaaacatcaatgagatcaatgagatcttgaat

SEQ ID NO: 95570 - DNA, 768 bp, Homo sapiens
ctgccttgcgcccccaggctggcgttggaacttctttagagccagcgctgcggagccccagcaccaggaacgtagagaggctgtggaggcatggggcaaattgtgcccgcagcctggggcctagagctgcatctgtgcacggggcctccaggagcccggctcagtggacgaaatctggcatgctcggacgtcaccccacaggcctcacgcctcagaggcaccccgaaagagacggggatctcactatgttggccagtttggtctttgaactcctggcttcaaaggatcctctcacctaggcctcccaaagtgctgggattacaggagtgagccaccttgctggtcgcgcaccccattttttaaggaaacctgtacggaaggtggattggaagtctcactttaggagcctggctcagaagttccgcaacttcaactggtgtcatgtgacgtgcttggcagtcaccacccccatccttacagcaaagaatagcagggcagcctttcatgggcccatcagagaactaaggctgccagacaaactggcaccctgctctgaagagacaggcacatccagggagagacagcacctgagagctgctcacccagagcagaaactcctggataaactggctttagcagaaaaattagacaacatgcaagaccagataggtgatatcagcagaaagatggaaacaataataaaaaaaaaatgctagaagtcaaaaacacaatagaaataaagaatgctcattagttgactagacagaa

SEQ ID NO: 95571 - DNA, 512 bp, Homo sapiens
ctgccttgcgcccccaggctggcgttggaacttctttagagccagcgctgcggagccccagcaccaggaacgtagagaggctgtggaggcatggggcaaattgtgcccgcagcctggggcctagagctgcatctgtgcacggggcctccaggagcccggctcagtggacgaaatctggcatgctcggacgtcaccccacaggcctcacgcctcagaggcaccccgaaagagatggggtttcaccatgttgaccaggctggtctcaaactcctgacctcttgatccacccacctcggcctcccaaagtgctgcgattataggcatgagccaccgcgcccgcctgagatctgtttttctttaaagtgtctggcacctacccacaccctcactctctctctctcttgctcctgcttttaccgtgtgaaatgcctgctcccactttgccttccgccatgagtaaaagttccctgaggcccccaagaagctgagcagatgctggtgccatgctggta

SEQ ID NO: 95572 - DNA, 492 bp, Homo sapiens
tgacggttcaagttactgatgtatatcataacttaacaagggttcttgagctgggaatgcacatttaggcattatcgccgagcttgctgcatctccactccttcctcaactaagcatcagaggccacagaccacaccttgggaaactgggcctccgtctccctcccctctcttggagacttacaaaagcattaatacagcagacactccaaaaaagtcttgaaagaagctgttgaacttcatgttcaggccagcctatggtttcccaaatttaactggctatggaacctccccttcggtttcttgcactcattaacatcttgaggaacttagggttccatgaacagactttggaacatgctgctttgggagagattcctagaattaggattactgagtccaaaggtgtgtactttttgatggctttgaatccataatactaatttgatggaaatccagctttaacagacacggatgatttacaaatccaaca

SEQ ID NO: 95573 - DNA, 750 bp, Homo sapiens
ggaggccgaggtgggtggatcacttgaggtcaggagttcaagaccaatgtggtaaaccccgtctctactaaaaatacaaaaattagccaggcatggtggcaggcacttgtaatcccagctactcgggaggctgaggctggagaatcgcttgaacctgggaggtggaggttacaatgagccaagatcgcactgttgcaactccagcctgggtgacgagtgaaaccccatctcgaaaaaaacccaaaaaaacaaaaaaggaagtctcttaaccaatggccccttttccctaagttgcctagcactgaatctccagtccaccatacttggagcatgttcaacatgtagttatcaaggcagtgtgtttccttatttttatagatataaaggtttagatgaaaaagttctaccattttgcaacagtaatccaaataaaagggttatatggtcaaacagatcacgggcaagtacatagtatggttgtagatttttggagggcatatattcatatataggcatattttcagccaattcagcttaattcaaacataacttctgtgtaaaatctccatgcagtgttgtggctataaagatgatgaaagatagtctatgttgccaagattcttacatgtcattttcctaaatagttgttatctttggcttatttgtctgattattgaattaagaaggactgatttgttccagaatgcattgaataaactgtcttttgaggtgaaattttggcattgataa

SEQ ID NO: 95574 - DNA, 584 bp, Homo sapiens
  misc_feature (1)..(1): n is a, c, g, or t
ncactgctaacatttttatttataaaaatatcggccagatgcggtggcttgcacctgtattcccagtactttgggaggctgaggcaggtggatcacgaggtcaggagatcgagaccatccgggctaacacagtgaaaccccatctctactaaaaatacaaaaaattagcatggtggcaggcgcctgtagtcccagctactcaggaggctgaggcaggagaatggtgtgaacccgggaggcggagcttgcagtgagctgagattgcaccactgcactctggcctgggtgacagagcgaaactccgtctaaaaaaaaaaaatcacaccgtgcctgctgtttgaatctgcttttttcatgtaacccaactgttattgatagcacaccatgttatatcattgttttgaagctgctttctattctatttcatattactagttgctacaagattgcacagcatagaactagactattgggtaacgcaggaaattggaaactacctaaatgtttaatgtaattttctatatccaatggtatagttgtctgctgtgcaatgttgtagcactagccatgtggactacctaaat

SEQ ID NO: 95575 - DNA, 286 bp, Homo sapiens
tccattgtccaaaagtccaacccactcggctcattgaggagggccttgtgtagattttgaagtacacactagttcatcatctgtgtggtatgccctttcaaaggactggaagacagtcaaaattaaaattagaaccctactaaccagagtttattttgttattatttcttttctgaaacttcttggggacttgtagctcagagctgtgttacaacccccattaccacacccagagatatgtggcctgggagttagtagagtcaggtgcctttatgccatgttttgc

SEQ ID NO: 95576 - DNA, 865 bp, Homo sapiens
cttgagctgaaaaattcactacaaaaattacataatataattggaagtattaacagcagaatagaccaagctgaggaaagaatctgagagctcaaagagcaattctttcaattaacacagtcagacaaaaatacagaaaagagaattgagaaagatgaagagcagagagtgggccgagacctccaattagaagtagctatggtgcatggcactcataaagaggaagaaaagcagtgagtaaatacagcaccttcaactgaaatatccaggttttcgcactgggactgatcagggaaataaccaatccacagaaaacagagaaaagtagggcaggatgatagcccacctggaagtgacgcaaagccaagggaacccccaccccagccaaggaagtggtaagtgaatgtgccaccctgggaaaccacatttctcccatggatctttgcaaccctcagatcaggagatcccctcataaacccactccaccaggaccttgggtcagatacacagagctgtgtggagtctcagcagggcagccactcaggtatgcacagagacccaggagatttacataccccagccacaggatccctggcaaaggtgactacaactcagtcaaggcgggaggtccatacatacccctaggaagggggccgaatccagggagctgaacagcgtccatctgtgggccccatttccaaggcacctcacaaaataagacccactggcttggaacttcagccagccaccagcaacagggtagtgcctgcctgagatggaatggagctgccagggaaaggggtgggctgtcacctttgttatttggacaactcagctgttcaagtctgtgggctttggagagtcc

SEQ ID NO: 95577 - DNA, 377 bp, Homo sapiens
tataggaagtaaggatggaagaggccaaaaaatgtaattccatggctcatgttttgcctgaatcctgtcttttcctctctccactttttggttaattagcaatggttcctataaaggcacagagctggggataacggcagccgggagctggggatgaaagcagtcaatagattcttgtttggtgggaagaatcttttaaggaaaaaagttggaaactagagagtatgagttccttaaggtagaaggctccaagttgattcaagaagataaagaagagagaaaaatgcaaaggaagataagaaactccaccacataggtagtgtgtaatcaacaagaggctgtggtttcctctctttcaaagatacatgggcagcgag

SEQ ID NO: 95578 - DNA, 212 bp, Homo sapiens
ctgtgatgccatgtggctctactgaatccaagccttcaagacttattatcagcacatgtcgtgtcagcagaactagaagtccggccacattaactgtgccttgcgttaccaggcgagacagatgactgcctaagatttctgttccatggtacatcatggcctggttttgagattcacaaatgcacattttgaatgaccattcctcttcccct

SEQ ID NO: 95579 - DNA, 640 bp, Homo sapiens
tttcctctttattgcttcacccttattttcagaataccatggttttagagacttacttaataaaattattttattaattaaattaatgagtagatatatatgtcaaaaatccagctcccaattttatattagactatactggcagtatttacagtgtattaggttcataatgctataagagaatgtgaatttatttttgattcacaaaataaattatatgagcttttaatactaaccataagttttatacagtacatatttgaaaatcagtcatccatatgtaaaataaatacgaagaacaattaactacaatattccactagctgaaatagccagtgccccagacacgtggataaaatgatatttgtacttgtgaaatagtatctttcaaattgcagtttgcccatattggaacaaaaactaaatcattttgacctgcagcctcacatttctcttatgttttgtaataatataactttcttctcaacatgcatagtttttcagaaattaatctttttgctcttgtgcaagttgctgtgtccctagattttcgctgcccccaacaaacaatccatcagtttttctatagtcagatgagcaaagtttcaagggattatatgtaactatcataatctctttg

SEQ ID NO: 95580 - DNA, 2344 bp, Homo sapiens
gcagtggcgcgatcttggctcactgcaagctctacctcctgggttcacaccattctcctgcctcagcctcccaagtagctgggactacaggcgcctgccaccatgcctggctaatttttagtagagacggggtttcgcagtgttagccaggaaggtctcaatctcctgacctcctgatccgcccgcctcggcctcccaaagtgctgggattacaggcgtgagccaccgcgcccagttgtgcatttctggtttctaagaatcaaaccacttggctgtttttaggagttacttcccatgttataaagctgaggaagctttttttttttttttttgagacagagtctctgtcacccaggctggagtgcagtggtgcaatctcagctcccgggttcaagcaattctcctgcctcagccttctgagtagctaagattacaggtgtgcgccaacacgtctggcttatttttttgtatttttagtagagatggagtttcaccatgttggtcaggtgggtctcaaactcctgacctcaagtgatccgcccatctcctcccaaagtgctggattgcaggcatgagcgcctagccaggaagctatcttttcttgagttatgaaactttgcaacagttgttcaaattggtgtttgtccttcctatagctttcatattttcaaattaattctgtatggctatataatttatgttttaaaaggcaattctcttgactttggaaatatggaagtctctcctttaacctattcttgttcccattcccagtctcatttgaaatcattccttttattgttagtgtgtgtatttttgttggtgtgcttttaatgcatccaagtatgcatcattttggataaaaaatacatccaaattaagatgttttaacacataggacaaacttgtgcactttttatgccaaaaaaaaaaaaaattgggttttccttcatgggatttctagaaacactgcctacactttatgaaaactacatagtattcacctgtgacaggtagagtttatcactattaattttatgaggctatttattactttccagtgcatccacttagaacaagctaagagtaaggctgctaactttaattccttgcctgattttattgtacagtgtgcacaagcacaatggtatgcttgtatatagaaactaaaaatactatgaagtacataagttccctatggcttatggagagttatttattaattaactttatggtagggctagtatgaatacctttttaacaattgtgtgctattacaacaatgaagattcaaatgactccgctttgaaggatgttttctctatatggtaaaatatatatgaagaagtcttgattacgtgaagatcacttgactcagaatacttcaatgtattttgttcacattaccactaagcatattatcagtaaactattaactgactgcacattatgtaatacgttgtactttttgttgaattcaccgaagttcttccatttatatactatttttaatggcattccggctttaacattctgtgagtcttacaaatttgactcttgaatggcaaaataatgttagtatgtagaaggttaactttcatttataatataagtggtgcaggggttcaaccattttaagtaaaaatatttttacacactacctctctctctttttttttttaaagttttaacatcagaacttttgggggaaaaactacttcagggcttgactttttgtacaaattttaactgtaaaatacagatttatcttgtacgcattcatggaaatggaaatcaaagctgctattgctttttattttaattatcctgttaagggtatctatcaatggtattttcaagtagatctctgtttcttaaattattggtgaaataattgattactagatatatggtaaaaccaatagatcctggttatacgataaaatatcagctcatgggtaggctgaatcaattatttcaaggtgcaccttattaacaaaagtatcagtggatccaacataaaattttatagtactaaatgtcaagcctaactgtgaattttgttctgtatcttaagtaaatttatgataatgttctcgagctatcaacaaaatatatgtacttttgtgagctatgaattttctaattaaattttacatgctataacatgatttttacatgaatgatactttgtttataactatcaaatgtcagtattttactacaattttattataaagtgtacattatcactaaatgaacttcgattttaaaaatcaaattagctttagttgtatattattttttacaaataaagatagacttgtataaaggctactttctt

SEQ ID NO: 95581 - DNA, 1112 bp, Homo sapiens
aggaccctcacactatcgcctctttttaacaattgtgtgctattacaacaatgaagattcaaatgactccgctttgaaggatgttttctctatatggtaaaatatatatgaagaagtcttgattacgtgaagatcacttgactcagaatacttcaatgtattttgttcacattaccactaagcatattatcagtaaactattaactgactgcacattatgtaatacgttgtactttttgttgaattcaccgaagttcttccatttatatactatttttaatggcattccggctttaacattctgtgagtcttacaaatttgactcttgaatggcaaaataatgttagtatgtagaaggttaactttcatttataatataagtggtgcaggggttcaaccattttaagtaaaaatatttttacacactacctctctctctttttttttttaaagttttaacatcagaacttttgggggaaaaactacttcagggcttgactttttgtacaaattttaactgtaaaatacagatttatcttgtacgcattcatggaaatggaaatcaaagctgctattgctttttattttaattatcctgttaagggtatctatcaatggtattttcaagtagatctctgtttcttaaattattggtgaaataattgattactagatatatggtaaaaccaatagatcctggttatacgataaaatatcagctcatgggtaggctgaatcaattatttcaaggtgcaccttattaacaaaagtatcagtggatccaacataaaattttatagtactaaatgtcaagcctaactgtgaattttgttctgtatcttaagtaaatttatgataatgttctcgagctatcaacaaaatatatgtacttttgtgagctatgaattttctaattaaattttacatgctataacatgatttttacatgaatgatactttgtttataactatcaaatgtcagtattttactacaattttattataaagtgtacattatcactaaatgaacttcgattttaaaaatcaaattagctttagttgtatattattttttacaaataaagatagacttgtataaaggctactttctt

SEQ ID NO: 95582 - DNA, 683 bp, Homo sapiens
gaacctgaactattggaacttttctgaacacagtgtattcttttatgctctatgtgtttgtgtttggaggtagtatgtatatacatattataaatagatgattacgtagttgatcctttctaaggtaaatgtattactatactgttattttataaaaagaggtaatgaagctaagaaaagtagtagtttatccaaagtaatacttagttcccgatttctagataagaacagcttataagagcaactacagaaagtagttctaaaaaacaaatgagttaagaatcactgccgtaaggataacagaggtcagggtcctgggcaacagctagcatgtgccttcaatgtagtaagcagtcagtaaatatttattaagaatgatacttggagctcttctgattaacccttgaacctaaaaattgactacagtaattctacagcattggtattttcaccgaagaattctttcttaggtaaaatattatacagtcatgtgttgcttgacaaaggagatacattctgagaaatatgtcaccaggtgatttcatcgtcacgtgaccatcatagagtgtacttacataagcctagatggcatagcctactactgcacctactacacacttcccttagtagaccttggtgccagaggaatgacacagtgatgatttcccttggttttctttttg

SEQ ID NO: 95583 - DNA, 450 bp, Homo sapiens
ccagcctgggtgacagagcgagactccgtctcaaaaaaaaaaaaccaaagaacaagtggggactgaacttcccaacctcctccttgctgtcttccctctctgctcagagctcctggcatgcgtcatcttacccttggtcatgtcttcccatctctgtactcctggcatgtttgacagtctgagggtcctcaaacttttccactccccttcctagccccaaactgtagttactgcctgacttcttgcctcaccacattcccccggccaaactacatgccccgtgaccacattccacacccttcatgcctcacatcattgtcctccagcacccactctccacatagacccacattacctctgttattatataggaaagaatgtgaaatacagtggaaagagtatggattttggagtcaagcctggggtgaaattccagctctgacatctacc

SEQ ID NO: 95584 - DNA, 616 bp, Homo sapiens
aaatttaatcatgttgaatctgagatgattggaaattatgcagttcggtttagactgtatggtgtacatcgcatgaaaaaagaaaagattgtgggggaaaagattttttatttaacaaaattgaatcttcaagggaaaatgtcattgcctgtgatattggaaccttcttacaatcattctgtgagtatctcatcaaatggcctgaatacagtttatgttcatggtttatagtatgcacaattttaaaaatctttaatcaagccaacaagtttgtcagtctatttttttacatagtaatcatgcctttacaaaaatatctaagccctggatagatagatatactttttcttacctaaaaaagttgcccttgaagataatttgtgatttatgtcttttattttatccttcacagagttttggcccagggttttacatgttttttgttgttgttgttgaacatttattaaatgtttgattatgaagtcatccaaactccttatagaatttattattttttttccaggttaaaactaggcaatacattaagaagtatcagccccatatgttatttgctgtatggcagaaaggatttgcccttacagaatatatataccgc

SEQ ID NO: 95585 - DNA, 492 bp, Homo sapiens
tctcatgagagactgcgcatgatgcttgatctgtgagtatgtaaccatgagatgaatgtaacttacatttacagtatgagagctaaaacaagaaggcagagcatcaccttgtttgacctcagcttagaatgaatgctttgggtaactgaaatctctcaccagtctatgcatgtgcatgtctgtgaatacctgcaaaagcgcttcaagtattgacttgggggttgcaaggaagttttagcaattaggcaaattcataaatatggaatccataaataatgaggactgattatagttgttttcttatccctaacactagttttaagccataaagctagttttaaaatatttaacagctttatctccctgaaattataatacagacattactgatttctttttttgctaattaacatcactttgtgtgatttaacaaaaaagaaataaagtgcaggttaatagaagtaactttggtgaataatactgcaattcaaa

SEQ ID NO: 95586 - DNA, 233 bp, Homo sapiens
ctacttattatctgtgatgctcaggcctcagttacctcatctgtgaaatgggagcaatcataactgcctaaaaatgtgttgtgagattcagaaataaaatgtcaaattaacaccgctacctgacccctaagagagtcaccgtataaatggcagcacaattatcatcttccgacaaggcagggtaagggctgcaagatgtgaggcagattctcctgaccattcttgcctctgca

SEQ ID NO: 95587 - DNA, 269 bp, Homo sapiens
tattactgtgtgaccttgatgactacagcctcttttaacagtttctcctaatgaaatggtaagacaataagatctactatggccctttggggaatacatttattttatcatctctttttctgttttccttatgtgtcaagactaaggtcaaggaaacaaaaaattgatggacttccaaaacacaccctttgggggtatattttccgagcaaagcaatggggttaggataaatgtagcatctctctgttctttccacagacactgagttg

SEQ ID NO: 95588 - DNA, 516 bp, Homo sapiens
tagaaatagagattctgctaccagtatagagtttacaaaagaccaggaaataaaataatacagcccttcctttctctgtcttcaacagacatgtttctcaactctcctcattaattcctgctaattgattacacttagatttgctttcgtataacttctcataattagatttggttgctggtatgttagagttaggaaactgaggccaagttgtaaatgtctttaacccccagactgcttttggaacttgtgacagggctcttctaacttaacccatcctgacctggtcttgaccttagcattactaataaggtacttacctcatcatttcgtttctcacttactgaacgtgactataaatcctcctgttactcaagatcttggttttccacacttttgcaaaccttcttttgtagttccctgggagcccagttgaaggggagtaaatctttaattctgataaggccctggagccacagacttctgtgtagccacatctagacaactgaatttcac

SEQ ID NO: 95589 - DNA, 223 bp, Homo sapiens
ctttcataactttgaccttctgggggtttcatgcaccgttcttcctaagctgggctaacatttcactgtggtctgtgtttgctgtgggaagaagccaccgatgttgaaatgtaagggcctgctgtttatgcactgttcattcagggctgcacgtgcctatgtgacttgaattctttattgatggctgagctgcaggattgagcatgacttcttgcctggggtc

SEQ ID NO: 95590 - DNA, 1763 bp, Homo sapiens
gaaataattatccttggctacaaatatcaataacaaaggtcacaccagtccgaggttggacaggcagttgctaggcagatgtctttgcagaagtaatttttgtgtgaggttgcagcagcctatgtgcaaggttgtaatttttgcagaatcttttgtgatcatttttggtattaggcatacaagcatgagaatcccctcttcatggcctccccagctctatttgtcatggtttgtttttttaaaacactagtgactctatttgaattctaacaactttcacattcccaacacaaatgatagacatttaagggattaatatgctaattaccctgatcattacacattgtatacatgtatcaaaataacacactgtaccccataaatacatacaattatgtgtcaattaaagatcattatttttaaaaataggaccagaaaaaaagatgcagaccctctagtaaggagatgggatcaggagtgattccatggttaatttaacccacataaacaactaatcgtaagtatggtatgagcgtttatgtaaagactgtgacaacaggaaatgtctgtctttgaacccaaggttatctaaccagcacaccaatggtgaaagattaactttgtcagaaaccaggaaccatgaagcagaggtcactgtttccaacctgtgtgttttccacggtaattggcagcctccccaagggaaattaaaacatatgtccacacagaaatttgaatgcaaatgttcatagcagcattactcataatagcccaaagctgaaacagccccaatgttccacagtggatgaatcgatgaacaaaatatggcgcatccacagaatggaatacaaagaaagaaagcgtggacacatgctgcaacatggatgaaccttgaaaatattgtgccaggggaaagaaaccagagacaaagagccacatgttgtaggattccatgtatatgaaaggtcctaataagcaaactcataaagacaaaaagcagattggtggtcacttagggctagggtgaggagtgacggttagtgggcactgagtttctccggggggaactgaattagatggtggtgattgcacaattctgtgaatagactaaaaaccactggactgtaagagggtgaattttttggtatatgaattacatctcaataaagctgttacttaaaacgtggaaaaaataataagcagtcactagctattctcaataaaacagaaaccacataggtaagaccaatattgtcacattttggttttggctgataatggggcaagtgagcatagtcaccgttgccagaggatttaccatttacaaataaaagtttctgtggagtgacaaccttttactgtgtgccaggtactgtgctaagcactttgtatataccgattcatgtaatccttgtgacagccccgtgatgccccatttttagatggggagattgaggttaggagagttgaataacttgcccatagctgcacagcttccaagttgcagagacaggattttcaccgagtcttattacaaactgcctcatattgtgtggactggaaattctatgttgaggttaatttattcatttgttgtttagttcttttcatcattgttgagttaccaatggcagttccagaggatttatcatttaccccaaagctactgcaaatctaagagaaaacaatgttcttgctgctaaagtttaatgtacaaaaaggtaaaatcatgactgtcttgcaaataaaacatgaacatgtat

SEQ ID NO: 95591 - DNA, 443 bp, Homo sapiens
aaaaaagtagagtaggagggaacatttcctgacttactctatggggccagtattatcctgtgagcaaagtcagacaaaactatcacaagagaaaactacagaacaataacacttgcaaatacaaatggaaaaaaaattctaagcaaaatactgaaaaactgcccagcagcatataaaaatgtttatgtcaaagccaaattggatttatttgaggaatacaaaggtggctcaacatattaaaatcaataaatttattataccacattaatataataaagagaaaataaaatcccatggtcatctcaataggtgcagaaaaagatagtacctttcatgatttaaaaaacaaacatgcatcaagctaggaataaaaaaagagctttctcattttgataaataacacctatgaaaaagccacagctaacacatcatactcacttatt

SEQ ID NO: 95592 - DNA, 704 bp, Homo sapiens
agcggaacccgctcgggtccctttccactctgtggaagcttgttctttgcttttgcaataaacctgctacgctcacttttgggttaacactgcttttatgagttgtaacactcaccgcaaaggtctgcagcttcactcctgagccagctctgagaccgtgaacccaccagaaagaagaaactccgaacacatccgaacatcagaaggaataaactccagacgcgccaccttaagagctgtaacactcaccgcgaggatccgcggcttcattctgaagtcaggagaccaagaacccaccaattccagagacactactgtgtgggtttctgtggacagcagttctgccaaactgttttccagtgtggctgtaccatttgcattcccgccagcaatgaaacgaagtttctaatgcttcaccttgtcaccagcatttgatattatcagtgtcctggctactcaaataggaaaagcttaagggaaagatttttctgtgagctggtgctgatgttgtatgttccagcagatcttcaaagaaatgtaagataatttattgaaataaggaataaacttttttctgagttctacttgattgcctaaaagttacatttttataaagataaaatttgtacaattcaaatatatttaaataacttttcattgatcaagagctatcatcaaaccctcgattacactgtgtgaatgac

SEQ ID NO: 95593 - DNA, 957 bp, Homo sapiens
tgctgggattacaggtgtgaatcactgcacccggcctcactttgaaaattagaaagcaggttaccctccttgaggatgctggcatgtgtcagagagaatacctccaaccaatccattaaaaagcagttattgctgcggccaggcctggcccggctgcgctaggctaggctctggcaggatcgcaggggcgggggtggtaggggcacgggtggcagccccgcgggtcgcaggccgccgccgccgccgccgcccatgaatggtgctgcccctggcctgccatcaccgccgcgtcgctcagcgcccgacctccctgcttttgcttgcagagccgctcccgaggccccggcgcggcgcgagggcgcggggcgggggtccacaggctccgaggctgcccccgacgccccgccctcgaggatggcggcggagctctacgtccccgccagcgccgcggccgcggtcctagcccacagcaacgccggcgccgccgtgggcaggaaggccgggcagcgcagcctgcaccgcgcccccgcgcccgcgcccgcgcggcccacacttggcaacaaccacccggagagccccaaatggcgcggtcccccacgctgcgcgagaggaacgcgctcatgttcaacaacgagctcgtggccgacgtgcactttgtcgtgggacccccgggggcgaccaggacggtgcccgcccacaagtacgtcctggctgcctgcagctccgtcttctatgccatgttctactgggacctggcggaagtcaaatctgaaattcacattccagacttggagcccgcagcctttctgatcctattaaagtacgtgtacagtgatgagatcgatctggaagcggatacggtgctggccactctgtaggctgctaagaagtacatcgtcccagcattggcaaaagcctgcgtcaactttctggggacaagtctgaaagccaagaacg

SEQ ID NO: 95594 - DNA, 878 bp, Homo sapiens
gcccagtattaaggatgcagaaacaggacaaggtcccttgtgcttaagagttcccagtgtggaagaggaggggaacagtgagaacagagggctgaatcagacaagcgagtagaaaattgaaatgcagaatgttaaagacttgatagagatcatcacagtaccacgggtaacacacagagggatgcctaatgaagacttggtgaatggaggattcctaaagaagttgatgtctaaactgagctttgaagaatgggttggaattcattaggcaaagaagagtgggcagagtgtccgaagcagaataagtagtagcttgtataatcataaaagaaggctgaagcccagtgtgcatgcttgggtttggatggggcagtgcaagaaatgaggttgactgggctggcagaggcagggtcatgggaaaccatatatacatatgagattatatatatcactctaagacatatggagttttatcctgaaggcacctcctactcctctccccctagttcattctgattttgtcacactggcctcctcactgttgctcaaacatgagtaggcacattcctctctcagcaagcactaactcttccctcatctgaactaccttttccccatgggtccctccttcacctttaagtgtttgctcaaatatcaccttctcaataatacttatcctgaccactccagttatattgcaacaccctcatcctgcactggatgctcctcactctgcttaatttttctccatagcattctcacattctaacatactgtatagtttgctgcagtgagctgtgatcacaccactgcactgcagcctgggcaatagagtgagaccctgtctcaaacaagaaaaacaaactgaaacaaaaaac

SEQ ID NO: 95595 - DNA, 547 bp, Homo sapiens
ctgtccagagggacatcctctggaaaaatggctagaactttcctatctgaactcaaggtccagaaactgagactctcaggcacatatctacagcattttgtttgtttgtctatttatttatttatttatttatttagtttttgtagtgacaggatcttgttatgttgcccaggctggtctcaaactcctgggctcaagcgatcctcccaccttgacctcccaaagtgctggtattacaggcatgagccaccatggtgcccggcctccaaagcattttggtgtggagcctgtcccctccagtcatccttaagggcttcctggaggaagcgaatttcagggagagcttaaataccctttgggtcaagagttatcttccatccttcatcattccttactttggctggcctgtgaaagtgggaccatctttctctaaagaaatgttggggctgggcacggtggctcacgtctgtaatcccagcactttgggaggctgaggtaggcggatcacgaggtaaagagatcaagaccatctggccaacacggtgaa

SEQ ID NO: 95596 - DNA, 854 bp, Homo sapiens
gtaacctctacagctccttgcacttattagggcgtcagcttcttcctttgcttgttcgtctcacacagctagcactgtacttataagctgtgaggggctcgctagccttcctgcttactcctgcttcccatagatttcatttaatcctcacagccacctctgaattaggcttccctcatgtattcagtcaacaaacatttgttacagttgtggttggcagacatgatgatccctgctcttgtggagtttataactcagtttagtaaaccaggtagttaacagatacagtgatgggagagtaccagagaactgagcctaggtgaggagggaggcttcctaggagaagtgccgtctttgccatgacctgaggggtgactaggcacaagccagactgcaggtggggccgtgccatggagctgaggtagcatcccacaccttggagtcaggaacacttggtttgagtcccagatttgccactctgtagacattggaaggcaaatcacatcccctctctcaccacttttcttacctgtaaaatcgtagggaattgacagaaatacaggagataatgcacctggggtacctgggccataaggtgagcttaaatgtcagctattattatgaatagtaatattagtgtttaaaaaaccatatgcttatgatttctttataaactctaaacaaattgtaccttaataaactgtcagtaggagaaaaatcactatggcttgaacagagggtgaggtgtaggggccagggaggcatgaaactgggcagtaagccacctggacccttttacaggtgagcaaagcaagtgtctgagggataagcatcacctaccttggcaggaggta

SEQ ID NO: 95597 - DNA, 410 bp, Homo sapiens
ctccatttatctgttgatggacagttgggttgtttccacctgtcagccattgtggatagtgctgtgtggacatgggtaagtaactgttcaaggccctgctttcaattcgtttgggtatattcctaagagcagaattgctgggttatatggtcattgttttagttttttgagggaccatccaactgttttccatagcagctacaccattttacatttccaccagcaagtatgagggctctaatttccctatatcttcagcaatacttgttttccactttttatttaacttttgttatagtcattttagtgggtgtgaagtgacatctccttggggtttcatctgcatttccctaggcactaatgatgctgatttgtcatgtccttattggccattcgtgtatcttctttgg

SEQ ID NO: 95598 - DNA, 780 bp, Homo sapiens
agctgtgaagttgtgatgcaaccctcctccttctcctaatgtttttcaggtctcagcacagatgcacacctgagggagtaacttctttggaaatgaaggacaaatagctgtgtaataataagtccaccttacaaagcacaactggaaatggaaacaagattatttctaaggccttttctactctaagagtaacttagtagcaagctgagaggtgaggatggggggatgttcatccacacgcaatgagtaccatgaggctctaccatgaagcatatagtcctcagtgtgaatcagagccctaagaagaataatgccctttacattgctttgccctctgccatcctaaacccatcccacccataattaagcagccatggaaatgaagggagccagaaggaatcaaaccctgctgcttggttcagtagacagagggacctgggggcagggtgttggctgggtctaggagaagatgatgagctcagaaaatagacaaggagaaaccccaggggaaagcttgtaaaatcctggaggaatcacaagatatattatttgagctcctttttatttattactaaattaatggcaggaatcccatataaagggatattccttatgaaacatgacatctaaagtacaaacagaggattcttccttaccctaaatcctgccctctctccctgagtctcttacgcatcaggccacctttgtgcccataagtcatgggcaacgcagtgtggtcaccttcatccacacctagaggacagtcagcaaagtgaggtg

SEQ ID NO: 95599 - DNA, 288 bp, Homo sapiens
ccacctcagcctcctgcgtaggtgggactataaggcgactgccaacaacctggactttttttattgttgtattttttgtagagatggggttttgccacgttgcccaggctggtcttgaattcctggacttaagcaatctgtccctcttggcctcccaaagtgctgggattacaggcatgagtccactgcccctggctgcctttgatttttaaaaaggtaacgctgattggccccaagcaggggaactggaaacactttcaccctattcccgtttataccttttgattc

SEQ ID NO: 95600 - DNA, 458 bp, Homo sapiens
cgcggtaggagtaggcgggcctgtgagtgctgagacctgggagccagctggggccagtgttgcttcctgcacatcagccctgtgactagggtgagtcacttgggcagtctgagcctctgtttccttgctgtaaaatggggatagtaaatgtaccgacctatgtggggttcctgagagctgcaggtgggcgctacctgcagggcccttcaaatacaatagaatctcacaaataaaaggaaaagacgattttttcggcagaaggaaatgatgtaagtcacaaacttggatctttcctaaagaatcgaagagcatggagaaaaatacacgtgaagatttttttttttttcaagacagagtcttgctctgttgcccaggctggagtgcagtgagctgaggtcacgccattgtactccagcctgggtggcgacaagagcaagactttgtctcaaaaacaaaac

SEQ ID NO: 95601 - DNA, 204 bp, Homo sapiens
gacagatcctgaaactttcctggggaaggtcagcctcagatactgacaagacaccaagggactgcagctgcttactatggaaagagcatgaccctatgaagaaaggagatgaagagaaaaagtcataagatcagcaagaagagaaactgtagatttgcctcaactcaacatgttaagtaatcgcctgacatctacataagacca

SEQ ID NO: 95602 - DNA, 912 bp, Homo sapiens
ccacaatgaggcagatcaaaatccaaacatttttataaatatgtgatgtaaatatatgcacagatatattctgtacatagtatgatggtgtgagcgcttactaaacgtgtacttctgttctaggatgcaggacttcaagaaaggttttttctgcgctgctgctgcttctgctgggaactcatgtttttgtcgagcatttagtgtttgaactcttcccatccttgactacctcttctctcccttaccccaccttctgttcactactattatttccaattgttgactgaggcagagaccactcggtttttcaattatccaggcccataaaccagcaaataggttttttttatttgtttggttggttggttgatgttttttttttttgaaagagcaacagaaagttcagcacaatctacagtattaaaattagccaaaagtcccatatctttattagctaaaaattccatctcaacagggttcatgcatgttttagccttcaagatccaatactttggggactcaagtatagagctaatgtgtttgaatacataattccccaggtgtttactgtgttaatgtagccaagggtccaatttcacagagctttcattcaatcaactgcctcaattggggttctttctttccatctcattagcatgactccatatatcacttcagtgcttgtttattaatgaaagaaaaataaaaattgactgagtttcaccagaatgatcctctgaagtacaccgaatatgtacatgtactgtatgtattaccgtagagattggaatcaacttactgtatgtaaagttttatgaatggttattttataatttatgtatttaatataggaatcgatgaactctggtgttttagtttatataaaaataaaacaagctgcattttttaaaa

SEQ ID NO: 95603 - DNA, 667 bp, Homo sapiens
agcacctggtatttccagaactagaaggtaaagaaattatttgtgcttgaacttgcagaaaactgccttttcccttcttctcttgcatcttaacctggagcttcccttttcttgagcctcagtgtgcttcccaactcaacttataattgacttcctgcagtttctccttaggacagggctttgttttgggggtggtcaatttgtagggttcataggaaacagaccactcacagcacctgctttatgccatcctcactctcagcaatgagttgaggcccaggaagccttctgccagcctcagctgctgttctcagattaatctgctgagttctttttgcctactaagaatctctgaatttaggaacatagatgttagcgcttgtatatctaggttttccagttcccagggccattaaacatttttttcctttcctttccttcttccaaaaaaattggtgattcccctgggtccctgtggtttaacctcacaaaaggtccatgatgacaccctgttacattgttttgtcgtagttaataccttgttatcctagttgctcagtccgtttttgtgagagattcagggatattaataaaactgtgctgctactgctactaacatcttgcataaaagccctattaattaaaatgtttattttgcatgtgattt

SEQ ID NO: 95604 - DNA, 469 bp, Homo sapiens
tatcacctctgctatctttctcttcttctttcagaacgccagtggcacaaatgttaggtcttttttttacagtcccagaggtccccctgaggctttgtcctttgcttttccccccagtctattttccctctgttgttcaaattgggtgatttctattgttatgtcttcaagttcactgattctttcctctgtcttcttcattcttctgtttagcttatctgttgagttttttattttggttatttatatttttaagttctaaaatttatatttgattcttctttataacttttttcctttggtgagagtttcttttgcagagactttcttgtttttttgtttcaaacatattcataattgttcattgcattattcacaatagcaaagacatggaatcaacttaaatggccatcaatcgcagactggataaagaaaatgcagtacatacatgccatggaatactagccgt

SEQ ID NO: 95605 - DNA, 186 bp, Homo sapiens
gcaacctctactgcctgattagagtcctaattttaccctctccctccctgatgcataggtaaaggcccctctgtggagtaaggagatcttcagagctgttagtgtaactaattgagaagtattgtttccattgcgtgttccactcatgttgcttctcttgtgaaccattaactttaattggatatt

SEQ ID NO: 95606 - DNA, 296 bp, Homo sapiens
caaaaaccaggaggaaggcatgtgcctgacctgttggaggagtggctggaagtcaaggtgcccggggtgggggtgacaacgaaagagaaggttctctggctcgctgtgcccaaggcccggcttgtcacaggaaaggcctctgggtgtctggggtcctctccctcctgtgatgacagcattctcaggcttccttgggcttgacaggcacactatggaaaacttccctcaaactactgcatggcctcttcatgccttggcctggaagaggcagaactattgatgctacattgcaggag

SEQ ID NO: 95607 - DNA, 502 bp, Homo sapiens
taaatatgccccaagctaggatttttcttcattctttagccttagagagaagttttgatgtatctcagcatctgtccttagcattacaacttgtttcctctgttaggctgttgacagtcatgaaagggcaatccacccaaggtaatgtaattatttgccctcactaaatgttaaaagcatgaccgtctttactcatggtcatttactcagaaatgagaaagctctgtctcagctgcttgatgcagagtcagtgtggtagagagtgacattcaacagatccagaaaggtgggtgcaggaaaacactgtaacatttgctaggccctctgggcagatgtgacttttctttccagcatggcatttcaaacatggattcttcggctgttcccaacccatgcggcagcaggcgcctgcatcgccctgacctttatttttactggatcttttcctttttctgttgatggtcactgtactccaccatctgggctgggacaagaaatcaaa

SEQ ID NO: 95608 - DNA, 425 bp, Homo sapiens
tgttgttgaacgagaagaagaccagacaagtagacacacgttcactaatcataggggtgacttcctttccagtgttcagcaagggatggggtataaggcaatgccaaacttcaacctgcccatcaggtgaaagagtgaagaatgtctaatgtagagttgttcttgaaactaggccagatgatgtcacatactggcttaattttttctattggatgcttaattatttgaggattctgcaggaaaagtccgggttgagttggcttgttcaatactaaaatatttttctcctgctaaagcacacacattcgctcacagcagtgtatatggaacttatagatgtttatttttacctctttttttcttttcccttcctttcttactctcactacctaagttcaaggtctgtggactgtgtacttgtggag

SEQ ID NO: 95609 - DNA, 333 bp, Homo sapiens
atatttgtaaaatggggtcaacacctacactagacttttgagagtcctcaattgcagccagtttttataacctaatcctgccctgtctcctaccagatcagcatgaaataaatgtgacctcatgacataaactaagccctggaatctggagtagcatcatgaaaactctaatcagttttatttggatgcctatactggggagtcacataacacaggaagtcgatagcgatgaatggcttatgtgcaaattaggcagggcaaaacagtttaaagagagcaatagagtagagggaagctcaagaaggaggttgatgaggtatcccataattatgg

SEQ ID NO: 95610 - DNA, 506 bp, Homo sapiens
agtcaccacaaagctaccattgatttataatgcacattaccacatcaagcctggcccaaggactctgggcccagaaggaaaaacagccatggcagaaatataatgaaaacatatctgtattcacagaaaacaattaggcttaatgtaattagagtgaacattcaggttcattttattcaaaggtaatgtttctgcccttgaagttccatgtagaaaagggtccttggagttagaacactgtgggaaggtgatataatttcacttggccctcggctatgtaaggtaaacattttacattattgcacagtaacaaaaatttacagccatagataacacaggatctgatcaacgttaacacacctgctgtttaagggcttacccacattggaaagcaatcatttccaggatggagatcaaatatcttaacacagtgtcacctgtgtgagttgctagaaaagacctctcatttaaaaatctgttcatagaacgtgctttcacatttttca

SEQ ID NO: 95611 - DNA, 1480 bp, Homo sapiens
gagcccgctgcggtcacgctgcgcccggcgccgcagggtgggcggcgaggcactcacgagggggacgctgagggcttccgcgcgggccacccgggtcaagcgcgctccgccgggaaacttctgcgggcgccgggctgaagctccgggcagggctgggaaggaaaggaaataccaaaatatttgcagactggatccaaatcaggagcccagatgaacttaaagaagcgagcatgggattcttagtttttcaagatccgtacacacgaagcctttaatcagcatcaactccagtgtccgttttctctggttttgtgaagactgcacaaaactctcatgatggagaaccaaaggacttagttacctgtttcagtgtcatctaaagtcaactgaaaagtgaagcaggcagtaatacagccatggaaagaaattcaagtttatggaagaacctaatagatgaacacccagtctgcacaacctggaagcaagaggccgaaggagccatttatcatcttgccagtattttatttgtagtaggtttcatgggtggcagtggattcttcgggctcctttatgtcttcagtttgctggggttgggttttctctgttctgctgtctgggcttgggtagatgtctgtgcagctgacatattttcctggaattttgtactgtttgtcatctgcttcatgcaatttgttcatattgcatatcaagttcgcagcataacctttgcccgagaattccaagtgttgtacagctcccttttccagcccctggggatctctttgcctgtcttcagaacgattgctttgagctctgaagtggttactttggaaaaggaacactgttatgccatgcaggggaaaacttccattgataaactctccttgcttgtttcaggaaggatcagagtgacagttgatggcgaatttctgcattacattttcccccttcagttcctggattctcctgagtgggattcactgagacccacagaggaaggcatttttcaggtaaccctcactgcagaaactgattgtcgatatgtgtcttggaggagaaagaaattatatctgctctttgctcagcatcgctacatctcccgccttttttcagtgctaattggcagtgacattgcagataaactctatgccttgaatgacagggtatatataggaaaaagatatcactatgatattcggctacccaacttctatcaaatgtcaactccagaaatacgcagatcacccctgacacaacattttcagaattccagacgatactgtgataaatgacatcaaagtctgaaatttataagtataaaaaaagactctctcttcatcattccccagtgaaatagcaaaatacaaaaaaagagctccctaatgtttttataaatcaaattcagaagcgagatgccattgccaactgttttattcctttcaacaactgcattgtgaataaactttacaaatttttcttg

SEQ ID NO: 95612 - DNA, 1454 bp, Homo sapiens
gagcccgctgcggtcacgctgcgcccggcgccgcagggtgggcggcgaggcactcacgagggggacgctgagggcttccgcgcgggccacccgggtcaagcgcgctccgccgggaaacttctgcgggcgccgggctgaagctccgggcagggctgggaaggaaaggaaataccaaaatatttgcagactggatccaaatcaggagcccagatgaacttaaagaagcgagcatgggattcttagtttttcaagatccgtacacacgaagcctttaatcagcatcaactccagtgtccgttttctctggttttgtgaagactgcacaaaactctcatgatggagaaccaaaggacttagttacctgtttcagtgtcatctaaagtcaactgaaaagtgaagcaggcagtaatacagccatggaaagaaattcaagtttatggaagaacctaatagatgaacacccagtctgcacaacctggaagcaagaggccgaaggagccatttatcatcttgccagtattttatttgtagatcagagtgacagttgatggcgaatttctgcattacattttcccccttcagttcctggattctcctgagtgggattcactgagacccacagaggaaggcatttttcaggtaaccctcactgcagaaactgattgtcgatatgtgtcttggaggagaaagaaattatatctgctctttgctcagcatcgctacatctcccgccttttttcagtgctaattggcagtgacattgcagataaactctatgccttgaatgacagggtatatataggaaaaagatatcactatgatattcggctacccaacttctatcaaatgtcaactccagaaatacgcagatcacccctgacacaacattttcagaattccagacgatactgtgataaatgacatcaaagtctgaaatttataagtataaaaaaagactctctcttcatcattccccagtgaaatagcaaaatacaaaaaaagagctccctaatgtttttataaatcaaattcagaagcgagatgccattgccaactgttttattcctttcaacaactgcattgtgaataaactttacaaatttttcttgtatttctcattgttataattggggagggggtggataactatgggcagtttgcccttttctgcatcaaaactgggagaatgaaattccactttctcaattcttttctcacatttactcaaatgcattgtcttgccctatggactcaggagttgcttctcaagaaacagccagcaagtattctcagcctgagggtgggttgctactgtccacataggcatttccggaattcacttttttgctacaacctccagtgaaagcaattattttaaatgtgcagttacttgatgtgactaaaaagtagaataaatgcaagagataataatatgtgaatcttgaagcctattt

SEQ ID NO: 95613 - DNA, 1825 bp, Homo sapiens
gagcccgctgcggtcacgctgcgcccggcgccgcagggtgggcggcgaggcactcacgagggggacgctgagggcttccgcgcgggccacccgggtcaagcgcgctccgccgggaaacttctgcgggcgccgggctgaagctccgggcagggctgggaaggaaaggaaataccaaaatatttgcagactggatccaaatcaggagcccagatgaacttaaagaagcgagcatgggattcttagtttttcaagatccgtacacacgaagcctttaatcagcatcaactccagtgtccgttttctctggttttgtgaagactgcacaaaactctcatgatggagaaccaaaggacttagttacctgtttcagtgtcatctaaagtcaactgaaaagtgaagcaggcagtaatacagccatggaaagaaattcaagtttatggaagaacctaatagatgaacacccagtctgcacaacctggaagcaagaggccgaaggagccatttatcatcttgccagtattttatttgtagtaggtttcatgggtggcagtggattcttcgggctcctttatgtcttcagtttgctggggttgggttttctctgttctgctgtctgggcttgggtagatgtctgtgcagctgacatattttcctggaattttgtactgtttgtcatctgcttcatgcaatttgttcatattgcatatcaagttcgcagcataacctttgcccgagaattccaagtgttgtacagctcccttttccagcccctggggatctctttgcctgtcttcagaacgattgctttgagctctgaagtggttactttggaaaaggaacactgttatgccatgcaggggaaaacttccattgataaactctccttgcttgtttcaggaaggatcagagtgacagttgatggcgaatttctgcattacattttcccccttcagttcctggattctcctgagtgggattcactgagacccacagaggaaggcatttttcaggtaaccctcactgcagaaactgattgtcgatatgtgtcttggaggagaaagaaattatatctgctctttgctcagcatcgctacatctcccgccttttttcagtgctaattggcagtgacattgcagataaactctatgccttgaatgacagggtatatataggaaaaagatatcactatgatattcggctacccaacttctatcaaatgtcaactccagaaatacgcagatcacccctgacacaacattttcagaattccagacgatactgtgataaatgacatcaaagtctgaaatttataagtataaaaaaagactctctcttcatcattccccagtgaaatagcaaaatacaaaaaaagagctccctaatgtttttataaatcaaattcagaagcgagatgccattgccaactgttttattcctttcaacaactgcattgtgaataaactttacaaatttttcttgtatttctcattgttataattggggagggggtggataactatgggcagtttgcccttttctgcatcaaaactgggagaatgaaattccactttctcaattcttttctcacatttactcaaatgcattgtcttgccctatggactcaggagttgcttctcaagaaacagccagcaagtattctcagcctgagggtgggttgctactgtccacataggcatttccggaattcacttttttgctacaacctccagtgaaagcaattattttaaatgtgcagttacttgatgtgactaaaaagtagaataaatgcaagagataataatatgtgaatcttgaagcctattt

SEQ ID NO: 95614 - DNA, 435 bp, Homo sapiens
ttcactcaatattggaatcctgactgtataacggaacgtgataacatgaatcttacaggacattatgtcacttattataatgtatgaatttaatattttgcctttcaaaatcataaagggcaagagtcatcagggatctgaaatacacttcctctaccccccacccctccccaattatgtgctctctttctccttcccttataaatgttgttcttgtgttttgataggatcagagtgacagttgatggcgaatttctgcattacattttcccccttcagttcctggattctcctgagtgggattcactgagacccacagaggaaggcatttttcaggtaagggataccagaacacacagttagcactccctctttcaaacagatgtttgtttaaaaataagtaaacaaataaacaacagtggataagacaagaat

SEQ ID NO: 95615 - DNA, 1121 bp, Homo sapiens
  misc_feature (958)..(958): n is a, c, g, or t
  misc_feature (1025)..(1025): n is a, c, g, or t
aacgacatctctaatattcatgctgatgcattttgatgctttgtgcattcatttctttctgtgctttgttggaatctggctatctgcttacagctattgaggaaactcagctttttaggagtgtttacagcctttttcatacctaaataggatgaacagtagatataaacttgccaaggcagaaatgtgttgataaatcaaaatgtgtatttgtggagggttgtgcatctcttggttgcagcttgctaaataggccatttaggaatcttctttcaatgcttttttcttgagcactgcctggggtggtgaaaaagcagagggcaagcctttgtctgacgccaaaaatgtcttcagtgaagaggccaagaggaaggcctccatcttccaagaagagcgatggttctgggacatatactaagttgcagaatacccaggtgagggtcatgtctgagaagaagcagagaaaaaaggtggaatcagaaagcaagcaagaaaaggctaatcgtataatatcagaggccatagcaaaagcaaaggagcgtggggaacgcaatattccacgagtaatgagccctgaaaactttcctactgcttcagttgaaggaaaagaggaaaagaaaggtagaaggatgaaatccaagccaaaggacaaagacagcaaaaaaacaaaaacatgttctaagttaaaagagaagacaaaaattggcaaactcattattacattgggtaagaaacaaaaaagaaagaatgagtcttcagatgaaatatctgatgcagaacagatgccacagcatacattaaaagatcaagactctcaaaaaagaagatcaaatcgacaaattaaaagaaaaaaatacgcagaagatatagaagggaagcaatctgaagaagaggttaaaggttctatgaaaataaaaaagaattcagctcctttacctggtgaacagcctttacaatngtttgtggagatccgagtgaagaagatgctgcaattgtagacaaaatctatcttctagaccgtaaanaaggaaatatcacctggagtgatgattgatacagaagaatttttcgtaaaatacaagaattactcctatcttcactgtgagtgggccacagaagag

SEQ ID NO: 95616 - DNA, 2409 bp, Homo sapiens
  misc_feature (2246)..(2246): n is a, c, g, or t
  misc_feature (2313)..(2313): n is a, c, g, or t
tgagtcccaggattccggggactggagggcagcgccggcagccaaggattttgacacttcatgacatgtcattatttagagcaataatgaatattgacctgttttggattagttgatgaccttcggaaatgatccaataatatctactatagagaagctgaatatactccatttggagtgaacagcccggattgttacagaattttcaagatgacagatccaatgatggacttttttgatgatgccaatctttttggtgagaccttagaaggtttgtcagatgatgcatttgtacaaccaggacctgtttcactagttgatgaattgaatttgggtgcagaatttgaaccgttgcacatagattcactgaaccatgttcaaggtactccaacacatcagaagatgactgattttgaacagttaaatcaatttgattcaataaaatttcaccatgttaatcaatcttttggtagcccagctgaacatgtgttatctccacactctcagtttaattgttctccaatccatccccaaaaccaacccaatggtttgtttccagatgtatcagatggcagtccaatgtggggccatcagacagctactaccatttcaaatcaaaatggatctccttttcaccaacaaggacattcacactctatgcatcaaaataaaagctttgtggcacaccatgactttgccttatttcaggccaatgaacaacaaacacagtgtacttcactacgctcacaacaaaacagaaataatctcaacccagggcagaattctcttagccagtctaaaaattttatgaatgtttctggtccacatagagtcaatgttaaccacccaccacagatgactaatgcatctaattcacaacagtctatttcaatgcagcaattttctcaaacgtcaaatccttcagcacacttccacaagtgtagcagtcatcaagaaggaaattttaatggaccttccccaaatatgacttcttgttctgtcagtaattcacagcaattttcttcacattattccttttccagtaatcatatatcaccaaacagtctacttcagtcctctgcagttcttgcatctaatcatacaaatcagactttatctgattttactggaagtaattccttttcacctcatagaggaatcaagcaagaatctactcagcatatcctaaaccccaatacatcattgaattcaaataatttccaaatattgcattcatcacatcctcagggtaattatagcaattcaaaattatctcctgtgcacatgaacttcccagatcctgttgactcaggaactcaaatgggccatttcaatgatcatgtagaaactaatggcttttcatctttagaagagaatttacttcatcaagtggaatctcaaactgagccattcacaggacttgaccccgaggacctccttcaggagggtcttcttcctcactttgatgagtcaacattcggacaagataattcaagtcacattttagatcatgaccttgatcggcagtttacttcgcatctggtaacacggccttctgatatggctcagactcagttgcaaagtcaggctcggagttggcattcatcattttctaatcatcagcatttacatgacagaaatcacctatgtttacagcgacagcctccatcttccaagaagagcgatggttctgggacatatactaagttgcagaatacccaggtgagggtcatgtctgagaagaagcagagaaaaaaggtggaatcagaaagcaagcaagaaaaggctaatcgtataatatcagaggccatagcaaaagcaaaggagcgtggggaacgcaatattccacgagtaatgagccctgaaaactttcctactgcttcagttgaaggaaaagaggaaaagaaaggtagaaggatgaaatccaagccaaaggacaaagacagcaaaaaaacaaaaacatgttctaagttaaaagagaagacaaaaattggcaaactcattattacattgggtaagaaacaaaaaagaaagaatgagtcttcagatgaaatatctgatgcagaacagatgccacagcatacattaaaagatcaagactctcaaaaaagaagatcaaatcgacaaattaaaagaaaaaaatacgcagaagatatagaagggaagcaatctgaagaagaggttaaaggttctatgaaaataaaaaagaattcagctcctttacctggtgaacagcctttacaatngtttgtggagatccgagtgaagaagatgctgcaattgtagacaaaatctatcttctagaccgtaaanaaggaaatatcacctggagtgatgattgatacagaagaatttttcgtaaaatacaagaattactcctatcttcactgtgagtgggccacagaagag

SEQ ID NO: 95617 - DNA, 2528 bp, Homo sapiens
  misc_feature (2365)..(2365): n is a, c, g, or t
  misc_feature (2432)..(2432): n is a, c, g, or t
gcggccgctgctcaactggtggggagatgcgggggcgggtcgtgtcagacgggtggtcgcctgaggccgcccccgcccggccagccgcgagtgtcagtctcagtcgaggcggggggcggcgggggcgcctcagtcatggcgaagcgcgagagtcagcgagcggcggattttgacacttcatgacatgtcattatttagagcaataatgaatattgacctgttttggattagttgatgaccttcggaaatgatccaataatatctactatagagaagctgaatatactccatttggagtgaacagcccggattgttacagaattttcaagatgacagatccaatgatggacttttttgatgatgccaatctttttggtgagaccttagaaggtttgtcagatgatgcatttgtacaaccaggacctgtttcactagttgatgaattgaatttgggtgcagaatttgaaccgttgcacatagattcactgaaccatgttcaaggtactccaacacatcagaagatgactgattttgaacagttaaatcaatttgattcaataaaatttcaccatgttaatcaatcttttggtagcccagctgaacatgtgttatctccacactctcagtttaattgttctccaatccatccccaaaaccaacccaatggtttgtttccagatgtatcagatggcagtccaatgtggggccatcagacagctactaccatttcaaatcaaaatggatctccttttcaccaacaaggacattcacactctatgcatcaaaataaaagctttgtggcacaccatgactttgccttatttcaggccaatgaacaacaaacacagtgtacttcactacgctcacaacaaaacagaaataatctcaacccagggcagaattctcttagccagtctaaaaattttatgaatgtttctggtccacatagagtcaatgttaaccacccaccacagatgactaatgcatctaattcacaacagtctatttcaatgcagcaattttctcaaacgtcaaatccttcagcacacttccacaagtgtagcagtcatcaagaaggaaattttaatggaccttccccaaatatgacttcttgttctgtcagtaattcacagcaattttcttcacattattccttttccagtaatcatatatcaccaaacagtctacttcagtcctctgcagttcttgcatctaatcatacaaatcagactttatctgattttactggaagtaattccttttcacctcatagaggaatcaagcaagaatctactcagcatatcctaaaccccaatacatcattgaattcaaataatttccaaatattgcattcatcacatcctcagggtaattatagcaattcaaaattatctcctgtgcacatgaacttcccagatcctgttgactcaggaactcaaatgggccatttcaatgatcatgtagaaactaatggcttttcatctttagaagagaatttacttcatcaagtggaatctcaaactgagccattcacaggacttgaccccgaggacctccttcaggagggtcttcttcctcactttgatgagtcaacattcggacaagataattcaagtcacattttagatcatgaccttgatcggcagtttacttcgcatctggtaacacggccttctgatatggctcagactcagttgcaaagtcaggctcggagttggcattcatcattttctaatcatcagcatttacatgacagaaatcacctatgtttacagcgacagcctccatcttccaagaagagcgatggttctgggacatatactaagttgcagaatacccaggtgagggtcatgtctgagaagaagcagagaaaaaaggtggaatcagaaagcaagcaagaaaaggctaatcgtataatatcagaggccatagcaaaagcaaaggagcgtggggaacgcaatattccacgagtaatgagccctgaaaactttcctactgcttcagttgaaggaaaagaggaaaagaaaggtagaaggatgaaatccaagccaaaggacaaagacagcaaaaaaacaaaaacatgttctaagttaaaagagaagacaaaaattggcaaactcattattacattgggtaagaaacaaaaaagaaagaatgagtcttcagatgaaatatctgatgcagaacagatgccacagcatacattaaaagatcaagactctcaaaaaagaagatcaaatcgacaaattaaaagaaaaaaatacgcagaagatatagaagggaagcaatctgaagaagaggttaaaggttctatgaaaataaaaaagaattcagctcctttacctggtgaacagcctttacaatngtttgtggagatccgagtgaagaagatgctgcaattgtagacaaaatctatcttctagaccgtaaanaaggaaatatcacctggagtgatgattgatacagaagaatttttcgtaaaatacaagaattactcctatcttcactgtgagtgggccacagaagag

SEQ ID NO: 95618 - DNA, 2407 bp, Homo sapiens
  misc_feature (2244)..(2244): n is a, c, g, or t
  misc_feature (2311)..(2311): n is a, c, g, or t
cttgaaaggaggcccctgccgtgtggacccgtaaaataaaatgggattttgacacttcatgacatgtcattatttagagcaataatgaatattgacctgttttggattagttgatgaccttcggaaatgatccaataatatctactatagagaagctgaatatactccatttggagtgaacagcccggattgttacagaattttcaagatgacagatccaatgatggacttttttgatgatgccaatctttttggtgagaccttagaaggtttgtcagatgatgcatttgtacaaccaggacctgtttcactagttgatgaattgaatttgggtgcagaatttgaaccgttgcacatagattcactgaaccatgttcaaggtactccaacacatcagaagatgactgattttgaacagttaaatcaatttgattcaataaaatttcaccatgttaatcaatcttttggtagcccagctgaacatgtgttatctccacactctcagtttaattgttctccaatccatccccaaaaccaacccaatggtttgtttccagatgtatcagatggcagtccaatgtggggccatcagacagctactaccatttcaaatcaaaatggatctccttttcaccaacaaggacattcacactctatgcatcaaaataaaagctttgtggcacaccatgactttgccttatttcaggccaatgaacaacaaacacagtgtacttcactacgctcacaacaaaacagaaataatctcaacccagggcagaattctcttagccagtctaaaaattttatgaatgtttctggtccacatagagtcaatgttaaccacccaccacagatgactaatgcatctaattcacaacagtctatttcaatgcagcaattttctcaaacgtcaaatccttcagcacacttccacaagtgtagcagtcatcaagaaggaaattttaatggaccttccccaaatatgacttcttgttctgtcagtaattcacagcaattttcttcacattattccttttccagtaatcatatatcaccaaacagtctacttcagtcctctgcagttcttgcatctaatcatacaaatcagactttatctgattttactggaagtaattccttttcacctcatagaggaatcaagcaagaatctactcagcatatcctaaaccccaatacatcattgaattcaaataatttccaaatattgcattcatcacatcctcagggtaattatagcaattcaaaattatctcctgtgcacatgaacttcccagatcctgttgactcaggaactcaaatgggccatttcaatgatcatgtagaaactaatggcttttcatctttagaagagaatttacttcatcaagtggaatctcaaactgagccattcacaggacttgaccccgaggacctccttcaggagggtcttcttcctcactttgatgagtcaacattcggacaagataattcaagtcacattttagatcatgaccttgatcggcagtttacttcgcatctggtaacacggccttctgatatggctcagactcagttgcaaagtcaggctcggagttggcattcatcattttctaatcatcagcatttacatgacagaaatcacctatgtttacagcgacagcctccatcttccaagaagagcgatggttctgggacatatactaagttgcagaatacccaggtgagggtcatgtctgagaagaagcagagaaaaaaggtggaatcagaaagcaagcaagaaaaggctaatcgtataatatcagaggccatagcaaaagcaaaggagcgtggggaacgcaatattccacgagtaatgagccctgaaaactttcctactgcttcagttgaaggaaaagaggaaaagaaaggtagaaggatgaaatccaagccaaaggacaaagacagcaaaaaaacaaaaacatgttctaagttaaaagagaagacaaaaattggcaaactcattattacattgggtaagaaacaaaaaagaaagaatgagtcttcagatgaaatatctgatgcagaacagatgccacagcatacattaaaagatcaagactctcaaaaaagaagatcaaatcgacaaattaaaagaaaaaaatacgcagaagatatagaagggaagcaatctgaagaagaggttaaaggttctatgaaaataaaaaagaattcagctcctttacctggtgaacagcctttacaatngtttgtggagatccgagtgaagaagatgctgcaattgtagacaaaatctatcttctagaccgtaaanaaggaaatatcacctggagtgatgattgatacagaagaatttttcgtaaaatacaagaattactcctatcttcactgtgagtgggccacagaagag

SEQ ID NO: 95619 - DNA, 2721 bp, Homo sapiens
  misc_feature (2558)..(2558): n is a, c, g, or t
  misc_feature (2625)..(2625): n is a, c, g, or t
gcggccgctgctcaactggtggggagatgcgggggcgggtcgtgtcagacgggtggtcgcctgaggccgcccccgcccggccagccgcgagtgtcagtctcagtcgaggcggggggcggcgggggcgcctcagtcatggcgaagcgcgagagtcagcgagcggcgtcattttttgagaccagtactgttataatccctatttacagatgaagaaactgagcttcaaaatgattaagtgtcttgcctaggattacatagctggtccctaatattaaggagctttgtggatgatactatgcatcttctagagaagcagtcctcaacctttttggcaccagggaccggtttcgtggatggggattttgacacttcatgacatgtcattatttagagcaataatgaatattgacctgttttggattagttgatgaccttcggaaatgatccaataatatctactatagagaagctgaatatactccatttggagtgaacagcccggattgttacagaattttcaagatgacagatccaatgatggacttttttgatgatgccaatctttttggtgagaccttagaaggtttgtcagatgatgcatttgtacaaccaggacctgtttcactagttgatgaattgaatttgggtgcagaatttgaaccgttgcacatagattcactgaaccatgttcaaggtactccaacacatcagaagatgactgattttgaacagttaaatcaatttgattcaataaaatttcaccatgttaatcaatcttttggtagcccagctgaacatgtgttatctccacactctcagtttaattgttctccaatccatccccaaaaccaacccaatggtttgtttccagatgtatcagatggcagtccaatgtggggccatcagacagctactaccatttcaaatcaaaatggatctccttttcaccaacaaggacattcacactctatgcatcaaaataaaagctttgtggcacaccatgactttgccttatttcaggccaatgaacaacaaacacagtgtacttcactacgctcacaacaaaacagaaataatctcaacccagggcagaattctcttagccagtctaaaaattttatgaatgtttctggtccacatagagtcaatgttaaccacccaccacagatgactaatgcatctaattcacaacagtctatttcaatgcagcaattttctcaaacgtcaaatccttcagcacacttccacaagtgtagcagtcatcaagaaggaaattttaatggaccttccccaaatatgacttcttgttctgtcagtaattcacagcaattttcttcacattattccttttccagtaatcatatatcaccaaacagtctacttcagtcctctgcagttcttgcatctaatcatacaaatcagactttatctgattttactggaagtaattccttttcacctcatagaggaatcaagcaagaatctactcagcatatcctaaaccccaatacatcattgaattcaaataatttccaaatattgcattcatcacatcctcagggtaattatagcaattcaaaattatctcctgtgcacatgaacttcccagatcctgttgactcaggaactcaaatgggccatttcaatgatcatgtagaaactaatggcttttcatctttagaagagaatttacttcatcaagtggaatctcaaactgagccattcacaggacttgaccccgaggacctccttcaggagggtcttcttcctcactttgatgagtcaacattcggacaagataattcaagtcacattttagatcatgaccttgatcggcagtttacttcgcatctggtaacacggccttctgatatggctcagactcagttgcaaagtcaggctcggagttggcattcatcattttctaatcatcagcatttacatgacagaaatcacctatgtttacagcgacagcctccatcttccaagaagagcgatggttctgggacatatactaagttgcagaatacccaggtgagggtcatgtctgagaagaagcagagaaaaaaggtggaatcagaaagcaagcaagaaaaggctaatcgtataatatcagaggccatagcaaaagcaaaggagcgtggggaacgcaatattccacgagtaatgagccctgaaaactttcctactgcttcagttgaaggaaaagaggaaaagaaaggtagaaggatgaaatccaagccaaaggacaaagacagcaaaaaaacaaaaacatgttctaagttaaaagagaagacaaaaattggcaaactcattattacattgggtaagaaacaaaaaagaaagaatgagtcttcagatgaaatatctgatgcagaacagatgccacagcatacattaaaagatcaagactctcaaaaaagaagatcaaatcgacaaattaaaagaaaaaaatacgcagaagatatagaagggaagcaatctgaagaagaggttaaaggttctatgaaaataaaaaagaattcagctcctttacctggtgaacagcctttacaatngtttgtggagatccgagtgaagaagatgctgcaattgtagacaaaatctatcttctagaccgtaaanaaggaaatatcacctggagtgatgattgatacagaagaatttttcgtaaaatacaagaattactcctatcttcactgtgagtgggccacagaagag

SEQ ID NO: 95620 - DNA, 1623 bp, Homo sapiens
  misc_feature (1460)..(1460): n is a, c, g, or t
  misc_feature (1527)..(1527): n is a, c, g, or t
gcggccgctgctcaactggtggggagatgcgggggcgggtcgtgtcagacgggtggtcgcctgaggccgcccccgcccggccagccgcgagtgtcagtctcagtcgaggcggggggcggcgggggcgcctcagtcatggcgaagcgcgagagtcagcgagcggcgtcattttttgagaccagtactgttataatccctatttacagatgaagaaactgagcttcaaaatgattaagtgtcttgcctaggattacatagctggtccctaatattaaggagctttgtggatgatactatgcatcttctagagaagcagtcctcaacctttttggcaccagggaccggtttcgtggatggggattttgacacttcatgacatgtcattatttagagcaataatgaatattgacctgttttggattagttgatgaccttcggaaatgatccaataatatctactatagagaagctgaatatactccatttggagtgaacagcccggattgttacagaattttcaagatgacagatccaatgatggacttttttgatgatgccaatctttttggtgagaccttagaagaagagaatttacttcatcaagtggaatctcaaactgagccattcacaggacttgaccccgaggacctccttcaggagggtcttcttcctcactttgatgagtcaacattcggacaagataattcaagtcacattttagatcatgaccttgatcggcagtttacttcgcatctggtaacacggccttctgatatggctcagactcagttgcaaagtcaggctcggagttggcattcatcattttctaatcatcagcatttacatgacagaaatcacctatgtttacagcgacagcctccatcttccaagaagagcgatggttctgggacatatactaagttgcagaatacccaggtgagggtcatgtctgagaagaagcagagaaaaaaggtggaatcagaaagcaagcaagaaaaggctaatcgtataatatcagaggccatagcaaaagcaaaggagcgtggggaacgcaatattccacgagtaatgagccctgaaaactttcctactgcttcagttgaaggaaaagaggaaaagaaaggtagaaggatgaaatccaagccaaaggacaaagacagcaaaaaaacaaaaacatgttctaagttaaaagagaagacaaaaattggcaaactcattattacattgggtaagaaacaaaaaagaaagaatgagtcttcagatgaaatatctgatgcagaacagatgccacagcatacattaaaagatcaagactctcaaaaaagaagatcaaatcgacaaattaaaagaaaaaaatacgcagaagatatagaagggaagcaatctgaagaagaggttaaaggttctatgaaaataaaaaagaattcagctcctttacctggtgaacagcctttacaatngtttgtggagatccgagtgaagaagatgctgcaattgtagacaaaatctatcttctagaccgtaaanaaggaaatatcacctggagtgatgattgatacagaagaatttttcgtaaaatacaagaattactcctatcttcactgtgagtgggccacagaagag

SEQ ID NO: 95621 - DNA, 916 bp, Homo sapiens
  misc_feature (753)..(753): n is a, c, g, or t
  misc_feature (820)..(820): n is a, c, g, or t
gcaattctaaaccctccttcctttcccagtgctgcagtgctgctatgaaacctttgatgaggcaggtatagaaaaaatatccagtgaagcacactggaatcagcatgaaaatgtgtttggaaattcctgatggttttttcctttggtatagtcagaggcatgtttacggcctccatcttccaagaagagcgatggttctgggacatatactaagttgcagaatacccaggtgagggtcatgtctgagaagaagcagagaaaaaaggtggaatcagaaagcaagcaagaaaaggctaatcgtataatatcagaggccatagcaaaagcaaaggagcgtggggaacgcaatattccacgagtaatgagccctgaaaactttcctactgcttcagttgaaggaaaagaggaaaagaaaggtagaaggatgaaatccaagccaaaggacaaagacagcaaaaaaacaaaaacatgttctaagttaaaagagaagacaaaaattggcaaactcattattacattgggtaagaaacaaaaaagaaagaatgagtcttcagatgaaatatctgatgcagaacagatgccacagcatacattaaaagatcaagactctcaaaaaagaagatcaaatcgacaaattaaaagaaaaaaatacgcagaagatatagaagggaagcaatctgaagaagaggttaaaggttctatgaaaataaaaaagaattcagctcctttacctggtgaacagcctttacaatngtttgtggagatccgagtgaagaagatgctgcaattgtagacaaaatctatcttctagaccgtaaanaaggaaatatcacctggagtgatgattgatacagaagaatttttcgtaaaatacaagaattactcctatcttcactgtgagtgggccacagaagag

SEQ ID NO: 95622 - DNA, 578 bp, Homo sapiens
  misc_feature (415)..(415): n is a, c, g, or t
  misc_feature (482)..(482): n is a, c, g, or t
ctttttttaccccacctttaaaaacctttgggccccttttttcccccaaaaggtttgaaggaaaagaggaaaagaaaggtagaaggatgaaatccaagccaaaggacaaagacagcaaaaaaacaaaaacatgttctaagttaaaagagaagacaaaaattggcaaactcattattacattgggtaagaaacaaaaaagaaagaatgagtcttcagatgaaatatctgatgcagaacagatgccacagcatacattaaaagatcaagactctcaaaaaagaagatcaaatcgacaaattaaaagaaaaaaatacgcagaagatatagaagggaagcaatctgaagaagaggttaaaggttctatgaaaataaaaaagaattcagctcctttacctggtgaacagcctttacaatngtttgtggagatccgagtgaagaagatgctgcaattgtagacaaaatctatcttctagaccgtaaanaaggaaatatcacctggagtgatgattgatacagaagaatttttcgtaaaatacaagaattactcctatcttcactgtgagtgggccacagaagag

SEQ ID NO: 95623 - DNA, 2186 bp, Homo sapiens
tgagtcccaggattccggggactggagggcagcgccggcagccaaggattttgacacttcatgacatgtcattatttagagcaataatgaatattgacctgttttggattagttgatgaccttcggaaatgatccaataatatctactatagagaagctgaatatactccatttggagtgaacagcccggattgttacagaattttcaagatgacagatccaatgatggacttttttgatgatgccaatctttttggtgagaccttagaaggtttgtcagatgatgcatttgtacaaccaggacctgtttcactagttgatgaattgaatttgggtgcagaatttgaaccgttgcacatagattcactgaaccatgttcaaggtactccaacacatcagaagatgactgattttgaacagttaaatcaatttgattcaataaaatttcaccatgttaatcaatcttttggtagcccagctgaacatgtgttatctccacactctcagtttaattgttctccaatccatccccaaaaccaacccaatggtttgtttccagatgtatcagatggcagtccaatgtggggccatcagacagctactaccatttcaaatcaaaatggatctccttttcaccaacaaggacattcacactctatgcatcaaaataaaagctttgtggcacaccatgactttgccttatttcaggccaatgaacaacaaacacagtgtacttcactacgctcacaacaaaacagaaataatctcaacccagggcagaattctcttagccagtctaaaaattttatgaatgtttctggtccacatagagtcaatgttaaccacccaccacagatgactaatgcatctaattcacaacagtctatttcaatgcagcaattttctcaaacgtcaaatccttcagcacacttccacaagtgtagcagtcatcaagaaggaaattttaatggaccttccccaaatatgacttcttgttctgtcagtaattcacagcaattttcttcacattattccttttccagtaatcatatatcaccaaacagtctacttcagtcctctgcagttcttgcatctaatcatacaaatcagactttatctgattttactggaagtaattccttttcacctcatagaggaatcaagcaagaatctactcagcatatcctaaaccccaatacatcattgaattcaaataatttccaaatattgcattcatcacatcctcagggtaattatagcaattcaaaattatctcctgtgcacatgaacttcccagatcctgttgactcaggaactcaaatgggccatttcaatgatcatgtagaaactaatggcttttcatctttagaagagaatttacttcatcaagtggaatctcaaactgagccattcacaggacttgaccccgaggacctccttcaggagggtcttcttcctcactttgatgagtcaacattcggacaagataattcaagtcacattttagatcatgaccttgatcggcagtttacttcgcatctggtaacacggccttctgatatggctcagactcagttgcaaagtcaggctcggagttggcattcatcattttctaatcatcagcatttacatgacagaaatcacctatgtttacagcgacagcctccatcttccaagaagagcgatggttctgggacatatactaagttgcagaatacccaggtgagggtcatgtctgagaagaagcagagaaaaaaggtggaatcagaaagcaagcaagaaaaggctaatcgtataatatcagaggccatagcaaaagcaaaggagcgtggggaacgcaatattccacgagtaatgagccctgaaaactttcctactgcttcagttgaaggaaaagaggaaaagaaaggtagaaggatgaaatccaagccaaaggacaaagacagcaaaaaaacaaaaacatgttctaagttaaaagagaagacaaaaattggcaaactcattattacattgggtaagaaacaaaaaagaaagaatgagtcttcagatgaaatatctgatgcagaacagatgccacagcatacattaaaagatcaagactctcaacttcttatccaatgggagagtagtggctcaaggctcctgggctgctgcaagagttgagaaaagaagatcaaatcgacaaa

SEQ ID NO: 95624 - DNA, 2113 bp, Homo sapiens
tgagtcccaggattccggggactggagggcagcgccggcagccaaggattttgacacttcatgacatgtcattatttagagcaataatgaatattgacctgttttggattagttgatgaccttcggaaatgatccaataatatctactatagagaagctgaatatactccatttggagtgaacagcccggattgttacagaattttcaagatgacagatccaatgatggacttttttgatgatgccaatctttttggtgagaccttagaaggtttgtcagatgatgcatttgtacaaccaggacctgtttcactagttgatgaattgaatttgggtgcagaatttgaaccgttgcacatagattcactgaaccatgttcaaggtactccaacacatcagaagatgactgattttgaacagttaaatcaatttgattcaataaaatttcaccatgttaatcaatcttttggtagcccagctgaacatgtgttatctccacactctcagtttaattgttctccaatccatccccaaaaccaacccaatggtttgtttccagatgtatcagatggcagtccaatgtggggccatcagacagctactaccatttcaaatcaaaatggatctccttttcaccaacaaggacattcacactctatgcatcaaaataaaagctttgtggcacaccatgactttgccttatttcaggccaatgaacaacaaacacagtgtacttcactacgctcacaacaaaacagaaataatctcaacccagggcagaattctcttagccagtctaaaaattttatgaatgtttctggtccacatagagtcaatgttaaccacccaccacagatgactaatgcatctaattcacaacagtctatttcaatgcagcaattttctcaaacgtcaaatccttcagcacacttccacaagtgtagcagtcatcaagaaggaaattttaatggaccttccccaaatatgacttcttgttctgtcagtaattcacagcaattttcttcacattattccttttccagtaatcatatatcaccaaacagtctacttcagtcctctgcagttcttgcatctaatcatacaaatcagactttatctgattttactggaagtaattccttttcacctcatagaggaatcaagcaagaatctactcagcatatcctaaaccccaatacatcattgaattcaaataatttccaaatattgcattcatcacatcctcagggtaattatagcaattcaaaattatctcctgtgcacatgaacttcccagatcctgttgactcaggaactcaaatgggccatttcaatgatcatgtagaaactaatggcttttcatctttagaagagaatttacttcatcaagtggaatctcaaactgagccattcacaggacttgaccccgaggacctccttcaggagggtcttcttcctcactttgatgagtcaacattcggacaagataattcaagtcacattttagatcatgaccttgatcggcagtttacttcgcatctggtaacacggccttctgatatggctcagactcagttgcaaagtcaggctcggagttggcattcatcattttctaatcatcagcatttacatgacagaaatcacctatgtttacagcgacaggtatgtagctctttgcttttattttggagatttgggggtagggcggactgttagtcattgggttaattttatatgaaacatagtcaagatttctcaaacttggtaattccattaagtgaacatacatattttgatataggtttatattgttttacaagtcttgtattgaaagtgattcactgatatgctcaaagcaatagattagcttctatatttagaaaattataaggtgttaagacttcttttgtgatgtttatgaatacctttgagagaaagttattttatcaaaaacaacttaataatcataattaaaagggaaaaaccagactgggaaaattttattgcaaatacaattaacattgagttaatattcctataaaaagctttataaattagcaaacttttaagacctcagttgataactagataaaacatataagctgaaattcac

SEQ ID NO: 95625 - DNA, 353 bp, Homo sapiens
tgctgggattacaggcgtgagccaccgctcccagcctacatttcttaaatctatcttgctagctcctctcgcacttgaaatcaaatactccagcaactaacacttgtgaagcatttttcaattttcctgcacagttacattatctcagaacggttcattaccgtggggtgtgtgctcttcataaatgcaaactgatgcagaagcagccaccagccaaaaaatcggctttagaacgtacagttttgtagccttcattttttacgttacattttcagttaagatgtgaaaatcattgaaccaattcatttaataaaaagttgagtaacatttatattttgtcacttccgtgggta

SEQ ID NO: 95626 - DNA, 4570 bp, Homo sapiens
atttgcctctggcaggcaaatgagcttgtcagtttctgcctccattagaccctcaacccaaaggagcaggagatttcggtagcgttttaactttatctcagaatctgaaagcggaaggccaggcaagctgcacacatcaagcgaaacgcctgaggggcggccagcgcgagggtttctggccatcgaccctcacctcccgggacttccagggtcttccccccaccccgcgcacacctccctgcctcgccccgagggcgtcacgtggcagcgtggggcccgcctcctggtgatgtcacggcgctcgcagccgtcgcgctgaagaaaggatgctcgaggatgctgtccaggtgggcggccgcgggcgcgatgcggcactgcaggtgtaattagcatggtcaatgcgggagcgatgagtggctctggaaacctgatggatttcctcgatgagccgttccctgatgtggggacgtatgaggacttccacaccatcgactggctaagggaaaagtcacgggacaccgacagacacaggaagatcaccagcaagagcaaggagtccatatgggagttcatcaagagcctgctggatgcctggtcgggatgggtggtgatgctgctcatcggcctgctggcgggcaccttggctggggtcatcgatctcgccgtggactggatgacggacctgaaggagggggtctgcctgtctgccttctggtatagccatgagcagtgttgctggacttctaacgagaccacttttgaggacagagacaagtgtcccctgtggcagaaatggtcggagctgctggtgaatcagtcagagggtgccagtgcttacattctgaattacttaatgtacatcctatgggcgctgctgtttgcatttttggctgtctccctggtgcgtgtatttgcaccatatgcctgtggctctggcataccagagataaagaccattttgagcggctttatcatcaggggctacttggggaagtggaccctgctaatcaagacagtcacgctggtgctggtagtgtcctccggtctgagccttgggaaggaagggccgctagtgcacgtggcttgttgctgtggcaacttcttcagcagccttttctccaagtacagcaagaatgagggcaagaggcgggaggtgctttcagctgcagcggctgctggagtctctgttgcctttggtgcaccaattggaggcgtgcttttcagtctagaagaggtcagttactactttcccctgaagaccttgtggaggtcatttttcgcagccctggtggcggcctttacgctgagatccatcaatccctttgggaatagccgtctcgttctcttttatgtggaataccacacgccctggtacatggctgaactcttccccttcatcctgcttggggtcttcgggggcttgtggggaaccctcttcatccgctgcaacatcgcctggtgcaggaggcgcaagaccaccaggctggggaagtacccggtgctggaggtcattgtggtgactgccatcactgccatcattgcctaccccaatccctacacacgccagagcaccagcgagctcatttctgagctgttcaatgactgtggagcccttgagtcttcccagctctgtgactacatcaatgaccccaacatgactcggcctgtggatgacattccagaccggccggctggtgtcggtgtttacacggccatgtggcagctggccctggcactgatcttcaaaatcgtcgttaccatatttacctttggcatgaagatcccgtcgggcctcttcatccccagcatggctgtgggcgcgatagcgggcaggatggtgggaattggcgtggagcagctggcctaccatcaccatgactggatcatcttcaggaactggtgcagacccggtgcagactgtgtcacgccagggctgtacgcaatggtgggagctgcggcctgcctcggtggagttaccaggatgacggtgtcattggtggtcatcatgtttgaattaaccgggggtctggagtacatcgtgcccctgatggcggcggctgtgaccagcaagtgggtagctgatgcatttgggaaagaaggcatctacgaggcccacatccacttaaatgggtaccctttccttgacgtgaaggacgagtttactcaccgcacactggccaccgacgtcatgcggccccggcggggagagccgccactgtcggtgctcacccaggacagcatgactgtcgaggacgtggagacgctcatcaaggagaccgactacaacggcttccccgtggtggtctccagagactccgagcgcctcattggatttgcccagaggagggaactgattctcgcaataaagaacgccagacagaggcaggagggcattgtgagcaattccatcatgtacttcacggaggaaccccccgagctgccggccaacagcccacatcccctgaagctgcggcgcatcctgaacctcagcccgtttacagtgacagaccacactccgatggaaacggtggtggatatcttccggaaactggggcttcggcagtgcctggtgacgcggagcgggagacttcttggcatcatcacaaaaaaggatgttctgagacatatggcccagatggcaaaccaggaccccgaatccatcatgtttaattagcaacaaggtggcaattattttcagaaaaacactgactgtgtcatttaaaaagaaataaatgatatgttattatcccaatgaaagatcatgcattggggacagcagaaacaaaagcttttttggaaaggcggggaagaaggatgaaacctttaaaaacaaaaacaaaaacatcaatgagtaggcattttatagctttaaccccgtatgagtttcaagctgtgtttcctaatgagtttgctactgctgtgggggcatgtgggtgggtaaatgatgtaaatgatgtgatctgtacaagtatgtggagcatgaatgctgactcaagaaacttttactccttctgctcaaggctgatgtttgtaacttatgaacacacgtgaagtgttgagtccaaaagacaaaggggcatcggcatgtcagcgtccttatttattggttcttgaagttttgctgctatgttactgaatcatactaaagacatttgcgcttactttgttgaaaaagaaaaagaaattaaatttgaacacagtgaaagctgcaagtatgccagtgggtccgctcacgaccgtcctgtttcttgctcctgttctcagcctgttatctggcttatccatcagtttctgaaccaacatcaggggcacctgccatgatgagtgtgaagaaatcatttctctatgcaagactggcatcctgggactgcacgatgaactattggagcatacagtactgcggtgtgtctcctcccatacaaagggacacatccttattttgagggtatactcacccgatcattgatttgcatccccatggcatttgcttcatttatttattgcttttgcccatgcattcaatattgatcagctcagcacttccatgggccatagccggtatgcccccagcctgccataagcgtgctttcattttcaagtagcatatgcaagagtccaaacaggctacccaatgttactacttatttttcctctcaggtcttatcagatacggctgtggagaggatgaggcatatgcgttgtcagttggaatccctccaaatggattgcaagagaaatactaaattgattctaaatctgttccattatcttctctgtaggatgcaaaacatccagttgtaatgtataagcatgcacttcatactagcaatcacagcacaggaggacagcattaaattttatatagccaatttgggcactgggcatctttgtatttgaacttaacgacacatttactcttttagtcaggatttcggtcttttctgcgggaaggaattaagctatgtattaggtccaccatacgatctgtgtaagtaagattatcccacttgccctttctctttagtctttgtcccttccttttcactaagtgcccctcatccttttcaatctcattgtcactggatagtgctgtatcacttaggtgtgcattcggctgcaaataacagaaaacccagcaaacactgaagggctggataagaaccctgagagggggtactccaggactgtctccataacatcattgggatccccatcccgttgctatttctttttcaccgtttttaccttttgtcctctggcttattgcctcagagttgcaagatggttcctgaactgtcaggtatcatgtctgctttctaagtgggaagaggaagggagaggcaagcaactaggtacaatgtctatcaggaaagcaaagcttccccagagacgctcagcttgtatccattgactggaagtctgtcacgtggctccccctagccgcacactagtgtgggaaggaaaatattgagctaggcacattactctctgaacgaaattcatattatcttattaaggaagagtgttggtcttcaggaggggaagtttgctgtattggatgccatcatcg

SEQ ID NO: 95627 - DNA, 3868 bp, Homo sapiens
atttgcctctggcaggcaaatgagcttgtcagtttctgcctccattagaccctcaacccaaaggagcaggagatttcggtagcgttttaactttatctcagaatctgaaagcggaaggccaggcaagctgcacacatcaagcgaaacgcctgaggggcggccagcgcgagggtttctggccatcgaccctcacctcccgggacttccagggtcttccccccaccccgcgcacacctccctgcctcgccccgagggcgtcacgtggcagcgtggggcccgcctcctggtgatgtcacggcgctcgcagccgtcgcgctgaagaaaggatgctcgaggatgctgtccaggtgggcggccgcgggcgcgatgcggcactgcaggtgtaattagcatggtcaatgcgggagcgatgagtggctctggaaacctgatggatttcctcgatgagccgttccctgatgtggggacgtatgaggacttccacaccatcgactggctaagggaaaagtcacgggacaccgacagacacaggaagatcaccagcaagagcaaggagtccatatgggagttcatcaagagcctgctggatgcctggtcgggatgggtggtgatgctgctcatcggcctgctggcgggcaccttggctggggtcatcgatctcgccgtggactggatgacggacctgaaggagggggtctgcctgtctgccttctggtatagccatgagcagtgttgctggacttctaacgagaccacttttgaggacagagacaagtgtcccctgtggcagaaatggtcggagctgctggtgaatcagtcagagggtgccagtgcttacattctgaattacttaatgtacatcctatgggcgctgctgtttgcatttttggctgtctccctggtgcgtgtatttgcaccatatgcctgtggctctggcataccagagataaagaccattttgagcggctttatcatcaggggctacttggggaagtggaccctgctaatcaagacagtcacgctggtgctggtagtgtcctccggtctgagccttgggaaggaagggccgctagtgcacgtggcttgttgctgtggcaacttcttcagcagccttttctccaagtacagcaagaatgagggcaagaggcgggaggtgctttcagctgcagcggctgctggagtctctgttgcctttggtgcaccaattggaggcgtgcttttcagtctagaagaggtcagttactactttcccctgaagaccttgtggaggtcatttttcgcagccctggtggcggcctttacgctgagatccatcaatccctttgggaatagccgtctcgttctcttttatgtggaataccacacgccctggtacatggctgaactcttccccttcatcctgcttggggtcttcgggggcttgtggggaaccctcttcatccgctgcaacatcgcctggtgcaggaggcgcaagaccaccaggctggggaagtacccggtgctggaggtcattgtggtgactgccatcactgccatcattgcctaccccaatccctacacacgccagagcaccagcgagctcatttctgagctgttcaatgactgtggagcccttgagtcttcccagctctgtgactacatcaatgaccccaacatgactcggcctgtggatgacattccagaccggccggctggtgtcggtgtttacacggccatgtggcagctggccctggcactgatcttcaaaatcgtcgttaccatatttacctttggcatgaagatcccgtcgggcctcttcatccccagcatggctgtgggcgcgatagcgggcaggatggtgggaattggcgtggagcagctggcctaccatcaccatgactggatcatcttcaggaactggtgcagacccggtgcagactgtgtcacgccagggctgtacgcaatggtgggagctgcggcctgcctcggtggagttaccaggatgacggtgtcattggtggtcatcatgtttgaattaaccgggggtctggagtacatcgtgcccctgatggcggcggctgtgaccagcaagtgggtagctgatgcatttgggaaagaaggcatctacgaggcccacatccacttaaatgggtaccctttccttgacgtgaaggacgagtttactcaccgcacactggccaccgacgtcatgcggccccggcggggagagccgccactgtcggtgctcacccaggacagcatgactgtcgaggacgtggagacgctcatcaaggagaccgactacaacggcttccccgtggtggtctccagagactccgagcgcctcattggatttgcccagaggagggaactgattctcgcaataaagaacgccagacagaggcaggagggcattgtgagcaattccatcatgtacttcacggaggaaccccccgagctgccggccaacagcccacatcccctgaagctgcggcgcatcctgaacctcagcccgtttacagtgacagaccacactccgatggaaacggtggtggatatcttccggaaactggggcttcggcagtgcctggtgacgcggagcgggagacttcttggcatcatcacaaaaaaggatgttctgagacatatggcccagatggcaaaccaggaccccgaatccatcatgtttaattagcaacaaggtggcaattattttcagaaaaacactgactgtgtcatttaaaaagaaataaatgatatgttattatcccaatgaaagatcatgcattggggacagcagaaacaaaagcttttttggaaaggcggggaagaaggatgaaacctttaaaaacaaaaacaaaaacatcaatgagtaggcattttatagctttaaccccgtatgagtttcaagctgtgtttcctaatgagtttgctactgctgtgggggcatgtgggtgggtaaatgatgtaaatgatgtgatctgtacaagtatgtggagcatgaatgctgactcaagaaacttttactccttctgctcaaggctgatgtttgtaacttatgaacacacgtgaagtgttgagtccaaaagacaaaggggcatcggcatgtcagcgtccttatttattggttcttgaagttttgctgctatgttactgaatcatactaaagacatttgcgcttactttgttgaaaaagaaaaagaaattaaatttgaacacagtgaaagctgcaagtatgccagtgggtccgctcacgaccgtcctgtttcttgctcctgttctcagcctgttatctggcttatccatcagtttctgaaccaacatcaggggcacctgccatgatgagtgtgaagaaatcatttctctatgcaagactggcatcctgggactgcacgatgaactattggagcatacagtactgcggtgtgtctcctcccatacaaagggacacatccttattttgagggtatactcacccgatcattgatttgcatccccatggcatttgcttcatttatttattgcttttgcccatgcattcaatattgatcagctcagcacttccatgggccatagccggtatgcccccagcctgccataagcgtgctttcattttcaagtagcatatgcaagagtccaaacaggctacccaatgttactacttatttttcctctcaggtcttatcagatacggctgtggagaggatgaggcatatgcgttgtcagttggaatccctccaaatggattgcaagagaaatactaaattgattctaaatctgttccattatcttctctgtaggatgcaaaacatccagttgtaatgtataagcatgcacttcatactagcaatcacagcacaggaggacagcattaaattttatatagcca

SEQ ID NO: 95628 - DNA, 3713 bp, Homo sapiens
atttgcctctggcaggcaaatgagcttgtcagtttctgcctccattagaccctcaacccaaaggagcaggagatttcggtagcgttttaactttatctcagaatctgaaagcggaaggccaggcaagctgcacacatcaagcgaaacgcctgaggggcggccagcgcgagggtttctggccatcgaccctcacctcccgggacttccagggtcttccccccaccccgcgcacacctccctgcctcgccccgagggcgtcacgtggcagcgtggggcccgcctcctggtgatgtcacggcgctcgcagccgtcgcgctgaagaaaggatgctcgaggatgctgtccaggtgggcggccgcgggcgcgatgcggcactgcagatcaccagcaagagcaaggagtccatatgggagttcatcaagagcctgctggatgcctggtcgggatgggtggtgatgctgctcatcggcctgctggcgggcaccttggctggggtcatcgatctcgccgtggactggatgacggacctgaaggagggggtctgcctgtctgccttctggtatagccatgagcagtgttgctggacttctaacgagaccacttttgaggacagagacaagtgtcccctgtggcagaaatggtcggagctgctggtgaatcagtcagagggtgccagtgcttacattctgaattacttaatgtacatcctatgggcgctgctgtttgcatttttggctgtctccctggtgcgtgtatttgcaccatatgcctgtggctctggcataccagagataaagaccattttgagcggctttatcatcaggggctacttggggaagtggaccctgctaatcaagacagtcacgctggtgctggtagtgtcctccggtctgagccttgggaaggaagggccgctagtgcacgtggcttgttgctgtggcaacttcttcagcagccttttctccaagtacagcaagaatgagggcaagaggcgggaggtgctttcagctgcagcggctgctggagtctctgttgcctttggtgcaccaattggaggcgtgcttttcagtctagaagaggtcagttactactttcccctgaagaccttgtggaggtcatttttcgcagccctggtggcggcctttacgctgagatccatcaatccctttgggaatagccgtctcgttctcttttatgtggaataccacacgccctggtacatggctgaactcttccccttcatcctgcttggggtcttcgggggcttgtggggaaccctcttcatccgctgcaacatcgcctggtgcaggaggcgcaagaccaccaggctggggaagtacccggtgctggaggtcattgtggtgactgccatcactgccatcattgcctaccccaatccctacacacgccagagcaccagcgagctcatttctgagctgttcaatgactgtggagcccttgagtcttcccagctctgtgactacatcaatgaccccaacatgactcggcctgtggatgacattccagaccggccggctggtgtcggtgtttacacggccatgtggcagctggccctggcactgatcttcaaaatcgtcgttaccatatttacctttggcatgaagatcccgtcgggcctcttcatccccagcatggctgtgggcgcgatagcgggcaggatggtgggaattggcgtggagcagctggcctaccatcaccatgactggatcatcttcaggaactggtgcagacccggtgcagactgtgtcacgccagggctgtacgcaatggtgggagctgcggcctgcctcggtggagttaccaggatgacggtgtcattggtggtcatcatgtttgaattaaccgggggtctggagtacatcgtgcccctgatggcggcggctgtgaccagcaagtgggtagctgatgcatttgggaaagaaggcatctacgaggcccacatccacttaaatgggtaccctttccttgacgtgaaggacgagtttactcaccgcacactggccaccgacgtcatgcggccccggcggggagagccgccactgtcggtgctcacccaggacagcatgactgtcgaggacgtggagacgctcatcaaggagaccgactacaacggcttccccgtggtggtctccagagactccgagcgcctcattggatttgcccagaggagggaactgattctcgcaataaagaacgccagacagaggcaggagggcattgtgagcaattccatcatgtacttcacggaggaaccccccgagctgccggccaacagcccacatcccctgaagctgcggcgcatcctgaacctcagcccgtttacagtgacagaccacactccgatggaaacggtggtggatatcttccggaaactggggcttcggcagtgcctggtgacgcggagcgggagacttcttggcatcatcacaaaaaaggatgttctgagacatatggcccagatggcaaaccaggaccccgaatccatcatgtttaattagcaacaaggtggcaattattttcagaaaaacactgactgtgtcatttaaaaagaaataaatgatatgttattatcccaatgaaagatcatgcattggggacagcagaaacaaaagcttttttggaaaggcggggaagaaggatgaaacctttaaaaacaaaaacaaaaacatcaatgagtaggcattttatagctttaaccccgtatgagtttcaagctgtgtttcctaatgagtttgctactgctgtgggggcatgtgggtgggtaaatgatgtaaatgatgtgatctgtacaagtatgtggagcatgaatgctgactcaagaaacttttactccttctgctcaaggctgatgtttgtaacttatgaacacacgtgaagtgttgagtccaaaagacaaaggggcatcggcatgtcagcgtccttatttattggttcttgaagttttgctgctatgttactgaatcatactaaagacatttgcgcttactttgttgaaaaagaaaaagaaattaaatttgaacacagtgaaagctgcaagtatgccagtgggtccgctcacgaccgtcctgtttcttgctcctgttctcagcctgttatctggcttatccatcagtttctgaaccaacatcaggggcacctgccatgatgagtgtgaagaaatcatttctctatgcaagactggcatcctgggactgcacgatgaactattggagcatacagtactgcggtgtgtctcctcccatacaaagggacacatccttattttgagggtatactcacccgatcattgatttgcatccccatggcatttgcttcatttatttattgcttttgcccatgcattcaatattgatcagctcagcacttccatgggccatagccggtatgcccccagcctgccataagcgtgctttcattttcaagtagcatatgcaagagtccaaacaggctacccaatgttactacttatttttcctctcaggtcttatcagatacggctgtggagaggatgaggcatatgcgttgtcagttggaatccctccaaatggattgcaagagaaatactaaattgattctaaatctgttccattatcttctctgtaggatgcaaaacatccagttgtaatgtataagcatgcacttcatactagcaatcacagcacaggaggacagcattaaattttatatagcca

SEQ ID NO: 95629 - DNA, 1610 bp, Homo sapiens
  misc_feature (1216)..(1216): n is a, c, g, or t
atttgcctctggcaggcaaatgagcttgtcagtttctgcctccattagaccctcaacccaaaggagcaggagatttcggtagcgttttaactttatctcagaatctgaaagcggaaggccaggcaagctgcacacatcaagcgaaacgcctgaggggcggccagcgcgagggtttctggccatcgaccctcacctcccgggacttccagggtcttccccccaccccgcgcacacctccctgcctcgccccgagggcgtcacgtggcagcgtggggcccgcctcctggtgatgtcacggcgctcgcagccgtcgcgctgaagaaaggatgctcgaggatgctgtccaggtgggcggccgcgggcgcgatgcggcactgcaggtgtaattagcatggtcaatgcgggagcgatgagtggctctggaaacctgatggatttcctcgatgagccgttccctgatgtggggacgtatgaggacttccacaccatcgactggctaagggaaaagtcacgggacaccgacagacacaggaagatcaccagcaagagcaaggagtccatatgggagttcatcaagagcctgctggatgcctggtcgggatgggtggtgatgctgctcatcggcctgctggcgggcaccttggctggggtcatcgatctcgccgtggactggatgacggacctgaaggagggggtctgcctgtctgccttctggtatagccatgagcagtgttgctggacttctaacgagaccacttttgaggacagagacaagtgtcccctgtggcagaaatggtcggagctgctggtgaatcagtcagagggtgccagtgcttacattctgaattacttaatgtacatcctatgggcgctgctgtttgcatttttggctgtctccctggtgcgtgtatttgcaccatatgcctgtggctctggcataccagagttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggcttgtgacccaattaagtcctactntacatatgctttaagaatcgatgggggatgcttcatgtgaacgtgggagttcagctgcttctcttgcctaagtattcctttcctgatcactatgcatcttaaagttaaacatctttaagtatttcagatgctttagagagatttttttttcatgactgcactctactgtacagattgctgcttctgctatatttgtgatataaggcattaagaggatacacacgtttggttcttcgtgccctgtttatgtgcacacatttatgcattgagacttcaagctcttcctttttttggccacgttatctttgggccttttgttaaagagttgctttggtgggccttcaattcccacgaattcttccaaacaacttttctgcaggaggatagtcacgct

SEQ ID NO: 95630 - DNA, 3891 bp, Homo sapiens
atttgcctctggcaggcaaatgagcttgtcagtttctgcctccattagaccctcaacccaaaggagcaggagatttcggtagcgttttaactttatctcagaatctgaaagcggaagtttttcataattcttcgcgaaaggccaggcaagctgcacacatcaagcgaaacgcctgaggggcggccagcgcgagggtttctggccatcgaccctcacctcccgggacttccagggtcttccccccaccccgcgcacacctccctgcctcgccccgagggcgtcacgtggcagcgtggggcccgcctcctggtgatgtcacggcgctcgcagccgtcgcgctgaagaaaggatgctcgaggatgctgtccaggtgggcggccgcgggcgcgatgcggcactgcaggtgtaattagcatggtcaatgcgggagcgatgagtggctctggaaacctgatggatttcctcgatgagccgttccctgatgtggggacgtatgaggacttccacaccatcgactggctaagggaaaagtcacgggacaccgacagacacaggaagatcaccagcaagagcaaggagtccatatgggagttcatcaagagcctgctggatgcctggtcgggatgggtggtgatgctgctcatcggcctgctggcgggcaccttggctggggtcatcgatctcgccgtggactggatgacggacctgaaggagggggtctgcctgtctgccttctggtatagccatgagcagtgttgctggacttctaacgagaccacttttgaggacagagacaagtgtcccctgtggcagaaatggtcggagctgctggtgaatcagtcagagggtgccagtgcttacattctgaattacttaatgtacatcctatgggcgctgctgtttgcatttttggctgtctccctggtgcgtgtatttgcaccatatgcctgtggctctggcataccagagataaagaccattttgagcggctttatcatcaggggctacttggggaagtggaccctgctaatcaagacagtcacgctggtgctggtagtgtcctccggtctgagccttgggaaggaagggccgctagtgcacgtggcttgttgctgtggcaacttcttcagcagccttttctccaagtacagcaagaatgagggcaagaggcgggaggtgctttcagctgcagcggctgctggagtctctgttgcctttggtgcaccaattggaggcgtgcttttcagtctagaagaggtcagttactactttcccctgaagaccttgtggaggtcatttttcgcagccctggtggcggcctttacgctgagatccatcaatccctttgggaatagccgtctcgttctcttttatgtggaataccacacgccctggtacatggctgaactcttccccttcatcctgcttggggtcttcgggggcttgtggggaaccctcttcatccgctgcaacatcgcctggtgcaggaggcgcaagaccaccaggctggggaagtacccggtgctggaggtcattgtggtgactgccatcactgccatcattgcctaccccaatccctacacacgccagagcaccagcgagctcatttctgagctgttcaatgactgtggagcccttgagtcttcccagctctgtgactacatcaatgaccccaacatgactcggcctgtggatgacattccagaccggccggctggtgtcggtgtttacacggccatgtggcagctggccctggcactgatcttcaaaatcgtcgttaccatatttacctttggcatgaagatcccgtcgggcctcttcatccccagcatggctgtgggcgcgatagcgggcaggatggtgggaattggcgtggagcagctggcctaccatcaccatgactggatcatcttcaggaactggtgcagacccggtgcagactgtgtcacgccagggctgtacgcaatggtgggagctgcggcctgcctcggtggagttaccaggatgacggtgtcattggtggtcatcatgtttgaattaaccgggggtctggagtacatcgtgcccctgatggcggcggctgtgaccagcaagtgggtagctgatgcatttgggaaagaaggcatctacgaggcccacatccacttaaatgggtaccctttccttgacgtgaaggacgagtttactcaccgcacactggccaccgacgtcatgcggccccggcggggagagccgccactgtcggtgctcacccaggacagcatgactgtcgaggacgtggagacgctcatcaaggagaccgactacaacggcttccccgtggtggtctccagagactccgagcgcctcattggatttgcccagaggagggaactgattctcgcaataaagaacgccagacagaggcaggagggcattgtgagcaattccatcatgtacttcacggaggaaccccccgagctgccggccaacagcccacatcccctgaagctgcggcgcatcctgaacctcagcccgtttacagtgacagaccacactccgatggaaacggtggtggatatcttccggaaactggggcttcggcagtgcctggtgacgcggagcgggagacttcttggcatcatcacaaaaaaggatgttctgagacatatggcccagatggcaaaccaggaccccgaatccatcatgtttaattagcaacaaggtggcaattattttcagaaaaacactgactgtgtcatttaaaaagaaataaatgatatgttattatcccaatgaaagatcatgcattggggacagcagaaacaaaagcttttttggaaaggcggggaagaaggatgaaacctttaaaaacaaaaacaaaaacatcaatgagtaggcattttatagctttaaccccgtatgagtttcaagctgtgtttcctaatgagtttgctactgctgtgggggcatgtgggtgggtaaatgatgtaaatgatgtgatctgtacaagtatgtggagcatgaatgctgactcaagaaacttttactccttctgctcaaggctgatgtttgtaacttatgaacacacgtgaagtgttgagtccaaaagacaaaggggcatcggcatgtcagcgtccttatttattggttcttgaagttttgctgctatgttactgaatcatactaaagacatttgcgcttactttgttgaaaaagaaaaagaaattaaatttgaacacagtgaaagctgcaagtatgccagtgggtccgctcacgaccgtcctgtttcttgctcctgttctcagcctgttatctggcttatccatcagtttctgaaccaacatcaggggcacctgccatgatgagtgtgaagaaatcatttctctatgcaagactggcatcctgggactgcacgatgaactattggagcatacagtactgcggtgtgtctcctcccatacaaagggacacatccttattttgagggtatactcacccgatcattgatttgcatccccatggcatttgcttcatttatttattgcttttgcccatgcattcaatattgatcagctcagcacttccatgggccatagccggtatgcccccagcctgccataagcgtgctttcattttcaagtagcatatgcaagagtccaaacaggctacccaatgttactacttatttttcctctcaggtcttatcagatacggctgtggagaggatgaggcatatgcgttgtcagttggaatccctccaaatggattgcaagagaaatactaaattgattctaaatctgttccattatcttctctgtaggatgcaaaacatccagttgtaatgtataagcatgcacttcatactagcaatcacagcacaggaggacagcattaaattttatatagcca

SEQ ID NO: 95631 - DNA, 3538 bp, Homo sapiens
atttgcctctggcaggcaaatgagcttgtcagtttctgcctccattagaccctcaacccaaaggagcaggagatttcggtagcgttttaactttatctcagaatctgaaagcggaaggccaggcaagctgcacacatcaagcgaaacgcctgaggggcggccagcgcgagggtttctggccatcgaccctcacctcccgggacttccagggtcttccccccaccccgcgcacacctccctgcctcgccccgagggcgtcacgtggcagcgtggggcccgcctcctggtgatgtcacggcgctcgcagccgtcgcgctgaagaaaggatgctcgaggatgctgtccaggtgggcggccgcgggcgcgatgcggcactgcaggtgtaattagcatggtcaatgcgggagcgatgagtggctctggaaacctgatggatttcctcgatgagccgttccctgatgtggggacgtatgaggacttccacaccatcgactggctaagggaaaagtcacgggacaccgacagacacaggaagatcaccagcaagagcaaggagtccatatgggagttcatcaagagcctgctggatgcctggtcgggatgggtggtgatgctgctcatcggcctgctggcgggcaccttggctggggtcatcgatctcgccgtggactggatgacggacctgaaggagggggtctgcctgtctgccttctggtatagccatgagcagtgttgctggacttctaacgagaccacttttgaggacagagacaagtgtcccctgtggcagaaatggtcggagctgctggtgaatcagtcagaggtgctttcagctgcagcggctgctggagtctctgttgcctttggtgcaccaattggaggcgtgcttttcagtctagaagaggtcagttactactttcccctgaagaccttgtggaggtcatttttcgcagccctggtggcggcctttacgctgagatccatcaatccctttgggaatagccgtctcgttctcttttatgtggaataccacacgccctggtacatggctgaactcttccccttcatcctgcttggggtcttcgggggcttgtggggaaccctcttcatccgctgcaacatcgcctggtgcaggaggcgcaagaccaccaggctggggaagtacccggtgctggaggtcattgtggtgactgccatcactgccatcattgcctaccccaatccctacacacgccagagcaccagcgagctcatttctgagctgttcaatgactgtggagcccttgagtcttcccagctctgtgactacatcaatgaccccaacatgactcggcctgtggatgacattccagaccggccggctggtgtcggtgtttacacggccatgtggcagctggccctggcactgatcttcaaaatcgtcgttaccatatttacctttggcatgaagatcccgtcgggcctcttcatccccagcatggctgtgggcgcgatagcgggcaggatggtgggaattggcgtggagcagctggcctaccatcaccatgactggatcatcttcaggaactggtgcagacccggtgcagactgtgtcacgccagggctgtacgcaatggtgggagctgcggcctgcctcggtggagttaccaggatgacggtgtcattggtggtcatcatgtttgaattaaccgggggtctggagtacatcgtgcccctgatggcggcggctgtgaccagcaagtgggtagctgatgcatttgggaaagaaggcatctacgaggcccacatccacttaaatgggtaccctttccttgacgtgaaggacgagtttactcaccgcacactggccaccgacgtcatgcggccccggcggggagagccgccactgtcggtgctcacccaggacagcatgactgtcgaggacgtggagacgctcatcaaggagaccgactacaacggcttccccgtggtggtctccagagactccgagcgcctcattggatttgcccagaggagggaactgattctcgcaataaagaacgccagacagaggcaggagggcattgtgagcaattccatcatgtacttcacggaggaaccccccgagctgccggccaacagcccacatcccctgaagctgcggcgcatcctgaacctcagcccgtttacagtgacagaccacactccgatggaaacggtggtggatatcttccggaaactggggcttcggcagtgcctggtgacgcggagcgggagacttcttggcatcatcacaaaaaaggatgttctgagacatatggcccagatggcaaaccaggaccccgaatccatcatgtttaattagcaacaaggtggcaattattttcagaaaaacactgactgtgtcatttaaaaagaaataaatgatatgttattatcccaatgaaagatcatgcattggggacagcagaaacaaaagcttttttggaaaggcggggaagaaggatgaaacctttaaaaacaaaaacaaaaacatcaatgagtaggcattttatagctttaaccccgtatgagtttcaagctgtgtttcctaatgagtttgctactgctgtgggggcatgtgggtgggtaaatgatgtaaatgatgtgatctgtacaagtatgtggagcatgaatgctgactcaagaaacttttactccttctgctcaaggctgatgtttgtaacttatgaacacacgtgaagtgttgagtccaaaagacaaaggggcatcggcatgtcagcgtccttatttattggttcttgaagttttgctgctatgttactgaatcatactaaagacatttgcgcttactttgttgaaaaagaaaaagaaattaaatttgaacacagtgaaagctgcaagtatgccagtgggtccgctcacgaccgtcctgtttcttgctcctgttctcagcctgttatctggcttatccatcagtttctgaaccaacatcaggggcacctgccatgatgagtgtgaagaaatcatttctctatgcaagactggcatcctgggactgcacgatgaactattggagcatacagtactgcggtgtgtctcctcccatacaaagggacacatccttattttgagggtatactcacccgatcattgatttgcatccccatggcatttgcttcatttatttattgcttttgcccatgcattcaatattgatcagctcagcacttccatgggccatagccggtatgcccccagcctgccataagcgtgctttcattttcaagtagcatatgcaagagtccaaacaggctacccaatgttactacttatttttcctctcaggtcttatcagatacggctgtggagaggatgaggcatatgcgttgtcagttggaatccctccaaatggattgcaagagaaatactaaattgattctaaatctgttccattatcttctctgtaggatgcaaaacatccagttgtaatgtataagcatgcacttcatactagcaatcacagcacaggaggacagcattaaattttatatagcca

SEQ ID NO: 95632 - DNA, 101 bp, Homo sapiens
ctatgttagccaagagctagacctacaaaggtcaagaaaacaaagtatctccctcttcaaaacacaagagttcattggaggacacaggtaatggcagcgcc

SEQ ID NO: 95633 - DNA, 600 bp, Homo sapiens
gtcgttaacagatgttaaatgttcattcattccacaaacagtaccatgtgccatcacgtaccttaagcccctggtcatataagattccttcagaaatcttgctgtctattgtctgaaggaaggtataagcaaatagcataatgtgtttatttaacaaatatatatgatgaattcatcctcactccaggcactaagaatatacaaagacatggtgactgttcttaaagagcctactatctagctaggccttaaagaagactaatataggaataattagttttgtatagactttcatgtacttttcacaaaccttaactcatggttacaataacctcataggcattgttatccttattttacaagggctaagattagagccaaaagttgttatattatttagtaaaggttagacaggtaagctgagatttgaagtcaagcactttgcaggattaactgaaatcaaggaggggatgcattctagtcaagagcagaagcaaagctaaaaggtgctcgcttcagcagcacgtatactgaaaattagaacgatgcagagaagttagcatgacccctgtgcagtgatgacacacaaattcgtggaaa

SEQ ID NO: 95634 - DNA, 279 bp, Homo sapiens
agatacgaatcgagccggtaccctcgccgctcgtggttgttcccgctgtagaggggaatctgtcaaaatagccactcggcagcatgtctgcatggtaacgggcggcgtacatctagcagaggatgatgaaatattatttggaaggggagaaaacattacagaaaattaagtagaaagaaatgagagttcctaactacttacagaattttctggtagaaagtagaaaaagaaaagaaaaactgttcctgccttctccataaagtccactcaccttttttt

SEQ ID NO: 95635 - DNA, 826 bp, Homo sapiens
cttatataaacttcatttatttttgacaaaagagcagaggtattttaattgacaaggagagtcttctgaagaaatagtactggaaaaactgaatattcacatgtaaaagatgaatatcaactcatatctcctgctatataaaaaaacccaaaatgcatcatatattaaaatgtaaaatataaaagtatagaatttctagaaagagacaataggagaaaatcagtgtaatcatggattaggcaaagatttcttacatataacaccaaaagtgcaatttatataagaaaatgttgctatattggactttgtaaaaaaaacttctgcactacgaaagacactattaataaagtgaaaagaaaagccatagactgggagaaaatatttgtgaatcatatatttgacaaaagactggtaagcatataaagtaactagaatgttcctacttgctgtgagactgaaaaatagaatggttactttggaaaacagtttggtcgtttttcacatgtttgaacaaacatacataccatataattcagtaattctactagtaagtatttacctaagagaaataaaaactgatgtttatacaaaaaatggtacatgaatgtttatagaaactgtattcataactgtccaaaactaaatacaaaccaaatattctccaaatagtggataaaacacctgtgatacctccatacaatgggtactcctcagcaatgcaaaggaatagactactaaggcacacagaaacatgggcaaatcttaatgcattaccctgaatgaaacaatccagacacaaaaagctacatacaatataattcaattt

SEQ ID NO: 95636 - DNA, 617 bp, Homo sapiens
cagatcagccagctcacaaagaacattagctgcaggatgttctacctccagtaacttcaggatggttgcaccatcattagtaatggttacatcaccagtatcatccaccaacattttatccaagacaacggaccaagagcactttttacaatattggcaatcgaagctgcagccataatgttctgggagcggatcgcctccccactgctgcggtctccgaacacggacaaaggcccctccatcttcctggcggcggtacataccgaattctgctcctactgcgggcaaccagttatcgtggcccctcggccaaccggctaccacagcagtggcgacggtgtggagcggacccgagtgatgcaccgccccatccgcttcccggctgccccggctggccgcggggcacggcgggaagcagatctctgaacttttattttgccatttgaaatattagctcttcttcccaactttcaggcaactatcaaagtactaaacaggatagacaacaaaatcttgtgacaacatttaaatgtatgaaatgtattttattactaaaatatataaaatttaaaaattacatttgaattatgtacttcaaaaataaaaattctaaatgt

SEQ ID NO: 95637 - DNA, 203 bp, Homo sapiens
agcaaggcaggtgcccaagtccctccatccctgacatctgggtctctgtgacctggagttgtgtcagagaggtccagatcctggctgtggggcttctgggatggcacattgtgaaagcggggcccctgacctcctgctgctcagcatccatagtggcatgctccctcctccgtgtaaagggctggagtccacactggtacccc

SEQ ID NO: 95638 - DNA, 798 bp, Homo sapiens
ctcctagaatcttggtgggcctgtgactacaaggaccagaagaatatggtagaagtggtttcagttctggaatcaaccctcaaccagtcaggtggcttctgcttccttttttggaccactcaattttgcgatgctccctctgagaagccagccaacatgctgtgacatgcacaaccacacggagagaccctgtggaggcactcttggcaactgccagcttcaactgtcagtcatgggaggcaaccatcttggatgcccagcccagtggagccttcaggtgactgcatcccagccaccatctgactgcaacctcaccagcaagcccacaggagatccacctagctgagcccaatcaacccacagaaacatgaaagaagataaattgtggctttgagtcactgaaatttggggacatttattatggagcaatagataaccagatacccctcttctaatttgtcatgtatgtgaaccagaccagacctggccactaagtgagtaactgtctccatgaaggaaccattagaaatgtcctgcttttctttgggtctccattttcccatctgggaaaaaagaggtagggctagatcagcagtcacagtctagagtctatgatgggtagtcaatagttagaaacaatatttctaaaaacctgatgaaagccacacatttacatgtgatgaagccactctggctaactaaaaaccaagtttccttgttttgggttgaaattacatcaactccgtgtatcagcactgttccttctgctagtcagaagctggttagcagtcccagatg

SEQ ID NO: 95639 - DNA, 336 bp, Homo sapiens
ctatttcctgaacacatgaaggaaagcaatatggtaaaatacacaaatgcaacccaaagtatagtcttccctcactggggaaatcccttggaagtaccccttagctcatattgcccctcagcgaataattattgaacagcttctataagctgtgctttctgctggattgtatcagacttgtaccaaaataaggtgcaaatgaccagtattatagtctttctgtgggatatttgaattttcatttgagtttattaaaacatattttaatgagaagtgtgaatacttttttgctttttgaaataggatcttgctccgatacccaggctggagtgcagt

SEQ ID NO: 95640 - DNA, 401 bp, Homo sapiens
gaatttttttatgggcagattaaaaaggaagttaactatgtaaagtaaggcattgccttcccaccccatcccacctcagttcgtgttaaattatgaatttttctaagagagttctttaatgacatggatagagaggaagctgaggtggcagtagagtagggagtggaaggcaaatacataagatactattaaactgtgaagctgtttgttacaattccaagattttataatttctccaacaaaaaacatttgtattttcttcccagtttaagttcaatgttaatttgagaaataattctactctcaaacttcatgttatgctgacagttcaactgatgctgtcaaaatgtgaattactaacttcagtattctctattcatctgatttttcttaaaatgttt

SEQ ID NO: 95641 - DNA, 510 bp, Homo sapiens
attttatgatgaattttaggaaaatgagtactccttgtgaaccaaagcagcagctctgtggtctgagtgagtggcagggagctctgggcatggagtagtgtttcacctcttctccaggggacagagcctcagaggccccagctggaaatgggcattggaatcacagtttcaccaaggtattggtgagacactactacctgccaggagggaatacgaaacattaagaaacaaaataaatgtccatattccatttcaacgagaaacacatagtcaatggctaacttcagtcaatgccagcaaaagtgtttctttatcctgggacaagtacatatgtaagacccatttacttgcaaatcaacttacataaacacaaactagcaaacaacacatctcaatcacaagttaaagttatttattccattttattttatttattggttattattttctgagacagggtctcttgctctgtctcccatgctggaaagcagtggcgtaatcaagggcccc

SEQ ID NO: 95642 - DNA, 397 bp, Homo sapiens
aatagatgctgggcgggcagccaaccaagagcactgcagtagtccaccctaccctaatcctgggttttgttttctgcagtttcacttacccacagtacaacacaataaaatactctattttgagagagaccacagtcatgtaacttttattacagtgtatttttataattgttctattttattagactgttgataatctcttactgaatctaatttataaatttaacgttattatagatacatgtgtataggaaaaagtatacatagggttcgatactatccatgatttcaggcatcctctggggatctatgaatgtatcccttgtggataaccgggagctactgtgccttgtatttttgtttgtttgtttttttgttttcgtttttgtttttgaga

SEQ ID NO: 95643 - DNA, 878 bp, Homo sapiens
cttcaggacagcactggagaaaaagaaactcttctcagttgactggcatgactagaggctggtaatgacaaggggctgaagttttcactaccatgagttgtcacatctaatggacttgacagccggagtgtctttaaacactaaacctagctgggtgtttctcaactctgctgcatcttagactcatgtggaaaattttatcccaaagaagggaaagagggcagtggacaggaggagagaagagaaaaagaaaacaccaatgcttggatcccactcctgggagactaatttaatgatctgggaagaataaatcctcagatccttgcccatgtgctcacttggctccagagcctataaccgagtgacatctaaaaacagagttatccaagaacactcaactggtaagggaagaacgcctcaattgagcatgtgtacaactccagtaaacacactgtgcctgcagcccctcccaactgctggcagaccactctacatgcagacagctcaccccaaggagagaatcaggggagaagagacacaaccgcctgaaagcatgccaacatattccccaagtcaaaaggttcaaaccatacacttgattctctcaagttgcttgcttggccttctttcaagtgtactttacttccctccatccttgccctaaaactttttactaaactttcactccataggctgggcccatggtaaacattccactttggctcaatggcagattgatcaatgaaagttaattgatcaattaactaagatgttagtctctttgccttcaagtactataagggaaaatacaacataaaagtaagaagtttaatgctccctgttgaaaataaagaaagagaacaaacccccaccctttt

SEQ ID NO: 95644 - DNA, 816 bp, Homo sapiens
aacccggatgcagccgcgatctcgggcggtgcagccgccgcttccgcccggcagtggggcaagctgaagtgagaagccgctgggcctgagaggagctctttaattccgggaggtgtgcgactagcggatcagcgggctggctttccgtgctgtgcggagcctttgggcggcggtcgtcttggaccggaggattccaagggctcgggtcgtctaagggtcggggagccccggagacttgatcccgccctgcagctagtgtggcccctcagggtttggggagtcccactctggacgggaccctgtgatgcgtaggcaggaataagatcccccgcccgtgccggtgtgccactgcttgtgtaaatgggccccttgaaacccccagcagtcgctctccgctgaaccttcttcgaattttctctcacctcatctccttttccttaaacgtctgttttgaatatcagacccctgtagcgttgaagccagcgctcgtttaattaatgcaggtgggaacgctgtcgccacagtttgcagtctattcattcagaataacccgccagtcagccgactgctcagagctcggaaagacccagctccaaactaggagtttcgagattttaattggcaagttggacccgaaagagttaatggagaagactacttaaatctatctagaacaagtgatgagatatttggagatgtgtttgcatgcttggtgaatgcagacggccaaatggtacatttccagataatattcttggattaatgtatttgaatgcaccctacgtacattttttgagaggaaaaaaggaagaaaga

SEQ ID NO: 95645 - DNA, 404 bp, Homo sapiens
ttcaacaacaactaattagggagacgcgcatatcatggctgcaagctcagatgctgaatccccaaccagagaagacctttatacgaaataaagccgcccaagtcttcgccttgctttttgttacagaatatctcactaagtggcccaagtatttttgtttacattctctcagtagtggacctaaatccaaggggagtagatgtgtgcctgcgaatcctcatggctatcgattcagagttggtggatcgtgatgtggtgcatacgtcagaggaggctcgtaggaatactctcattaaagataccatgagggaacagtgcattccaaatctggtggaatgatggtaccaaatattacaaaattatcagtatactaattctgaagtgaccgtcagtgctttgaagta

SEQ ID NO: 95646 - DNA, 624 bp, Homo sapiens
atacatataacacaaagtgtgtgttaactgtttatgttttcagtcaggcttccggtcaacaataggctattagtagttaagtttctggggagccaaaagttataccacagagttttgactgcatgaaaggttggcacccctaacctccaagttgttcaggggtcaactatattaaaagtctatgatatactcttggctttccagaaacttaatttgaagaagttaatttaaaaaccatagttttctatatattaatttgacagttcagcctttattaggtcaaagtttcaaaagagctcagctgttagatgtttagtaatgaatgccatcagcctttatgtcatcaggattcaggatgtttaggtgtgtgtttgctcagggctcagaaatagtcttggtggtgggtttacagctgcccatcttgttaggtgtggaacctgccttagcgctggggctgctgccagtctatgggaacattccctcccgtgcccttcctacactgtagaggcctacaggttgatgaccacttctgggacccttcattacacctctcactgaaagcatgtagagttgtgtaagtgacagcagccagccttgactcatcaaatagtctttcagtttgta

SEQ ID NO: 95647 - DNA, 1129 bp, Homo sapiens
agatctagatatatttacatgtagagatagatgatagatataaatagataatgataaattgatagacacatacatatctagatagataaatatagatagattatagaatgaataaatacatacatatatttatctaaatagatagagatggctggatggatagatggatgaatggatggatagatgattgatagacagatagatggtcctagccacactcaaagctaggagattctacagggtgtaacaccaggggacagagatcaaaagaattctgcctatggccagtaacttgagagttaagtagtatcatttctattttctagaagggaaactgaggtttagagagataactcacccaagttccaacagtggccattggccaagctggagttcagaccacgccctcctgcctctcaatgggtactgctttgttgtcattgtgacaacccttccttcagtgccccgagtaatgctaattacctgcacactgatgtggactgttgaggcaaaacatccagtactttctctagggaacactccttgtgctcatcatgtactgtgcagcatatatcttggcgaccccctgccaaatatgagctccaagaaggcaagggctgcatccatctggttcatggccatatctaagaccccagacaggttcctggcccatagtgtgccctctgtaaatagtcattcagtcattcaacaaatgcctgttgagctggactacatactgcagataccaagataatcaagacatagctctgtcttcccgctcccctccctatctagcatagcagaaacataaaataaaccacaagatagcgtgatatggcacaaacattactatggccaccttctcagggttattcattcttatgtccccagagcctaaaacaatagttggcacatagtaggtgctcaataatgtttgcagatcatttgtatgccttgctgtcttctctctgcatatggtagaaaatttagaagtcacgtgaggttaattggtcaagagaaaattaaaagtacatataacagcctcccagtctagcttccgaagtctctgacccatcctacaatcctggcacccccctttttgagcagagctttgcatttctaaatagga

SEQ ID NO: 95648 - DNA, 727 bp, Homo sapiens
gctttgtttcttctctccctcgcttccttctcttcttccttgcttctatttggtgccaaacaccgcgttttatttatgatattaaaaagtaaagtgagtgtgatggtggctggtcacccattgttttgaattaataacagaaaaaaagaaatattttagtggcccatatgtttatttttatgtgtttatgtatgtggttttggggttttttagtgccttctatccctagaagtcactttaatctcaagactgtccaaataaacttttcagcaaaagcatcaggtgagaagtctgggagaaaccatcctataaaacaatatgaacagaatggagcagtgaacacaatgctcccattctttctctgtcctccaagccatctttcttcttatagactccctgccatgtgttgcctggctcaggttctacatgttcatcctgccatattggcactggcttctttgaattctgctctagttctgagacggtggcgctttattcactactaactcccaggaccagtgcatgctattcttcaatttattgtgtagattaaaaggtatcttcttaaaaaatgatgcatgctgctgggaaatacagacactttaattttacttagaatcttacttggaatgtgttagtagccagataaacaagcaagactgactcaggaaagaagccagagaaagggtaagtgtgtcaagcaaaagtagacagcagcaccaaattg

SEQ ID NO: 95649 - DNA, 767 bp, Homo sapiens
aggtttaggtgggttgcctggctagctccagaactggtatacaggggcttgagacaagaatggaagcccgaaggaattcaaaggtatgcttacataggaggagatagcgtgcaattgcccagagaaatccttgcagcttcaacagcccttcccaacaagccaccccttagaacagtcaccaaaaatacgtaaaatattgccagctatgaagaattcttttaggcggcgccgtgacgcgcctcgggaacggtcctcggcgcgcgccgctctcttaccctcgggcctcagaagtcggtgccagtgaccggaggcgacagcggcagcgagtgggtccttgtgagctagaagaatcctgcaaaaatgtctctctatccatctcttgaagacttgaaggaagacaatgtaactcaggctcaaactgctttttctgcaaaccctgccaacccagcaattttgtcagaagctgctgctcccatctctcaagatggaaatctctatcccaaactatatccggagctctctcaataatacatgggcctgagttgaaatgaagaagaaatacgtgcaaatgtggccgtggtttctggtgcatcaattcagaggtagttggtagcaagatcttccggtatgatctgtatggtggttcctgtaactgaaaatgatgctggaattcgtagagcagaaattaaacaagggattcgcgaagtcattttgtgtaaggatcaagatggaaaaattggactcaggcttaaatcaatagatatgat

SEQ ID NO: 95650 - DNA, 476 bp, Homo sapiens
gcataatttaggttaagataccaaaaataagactatacatggacttccatggacttttaagacccatctaagattagagctaatcttggggtactgggaatataaaagcttatcattctttattttttagcataagtaatcaaagaatcaagctaactgaccaatatctatcttttccttggtaagtaaggcctctccaggaagttcaggcccttcagaaaggcttcaggaggaagacttagcagagagactctaaatcttccaagtttgttcccatctagtcttaccccccaccaagtttccatctgagaaaacgttgagtaagcatcaacagactttacggaaagattgttctcatagcctggcaaaaagagctctatccagccacaaccatcacatggtcaggaagatgtccccttgctgaatcacccccaccacttcctgaagttctctgggattttgggaggaaatatgtc

SEQ ID NO: 95651 - DNA, 906 bp, Homo sapiens
agcggaggcggccgccatgttgaatgtggctccgcccggggagctgctggagtacgagggagccaagaagggctccaaggacctctgcctcttctctgagctcgttcttaggcccctctgccgtctgcacgctcctttccagccacccggcctcccgatgccggcctagcacgttcctcgcgccaggcttttgcatctgcccttcccactgtctttcgtgtgcaaacgccacaggtcctgcgcaccgcacccctcatggaatagcgtcgcctcctctctaccttcacacacgccccgaaacttgcctctcatcctgtgtctctatagatttttgcaccatctgaccgacgaacccctacccttccctagaccatgtcacgattccgtcgcatcctctgccattgtccctcggaatattcctagatggcatttatcactgtggatagttaccactactcagcgttttggctaagatcaagtgttccatcatcgtgggtggctcatacgtgtaatcccagtactttggaaggtggaggcaagaggactgcttgaggccaggagtttcagatcagcccaagcaatatagcaagacctccatctctacaaaagatttttaaaaattagccaggtggtggcagcagacgcttgtgcagctatacgcaagattaaggctgggacttccttggcaagaagcaggagctgctgaagttgctggtcaacctatgggtgaagctgtcccagctgtgcatcaccaatgtcagcagtcccgtctttttgacaccagggaccagtttcgtggaagataattttcccatgaatgggggcagggggatggttttgggatgattcaagcacattacgcttattgcgtacaccatctctattattacattctaatatatgata

SEQ ID NO: 95652 - DNA, 688 bp, Homo sapiens
agcttccatagggggaaatttaaattttttttacaagttgtttaattataatgtgctttaaaaacactttagcatatcataaaccttcaaaacaaaatgagtaatcatcttctgagatccatagaaaatgtttcttaaatgtcactttcaattaccacttctggagctaacttgcaaaacaattgtgtttccaccaactgaaatatgttttcaccaaatttaagataatctgtggtcagtgtgagctttgtcttgatttaggaggaggaaagcaaagttccatttatgaatactttgaaaattttcagaaattctcctaaattgtttcagcaaccggggccaaaagagaggcctgggaatcccaaggtgaggagggaaacttttaaaagttacacttatgggccaggcacggtggctcacaccgtaattccagcactttgggagactgaaatgggtggatcacttgaggccaggagttcaggaccagcctggtcaatatggtgaaaccccatctctactaaaaatacaaaaattagcctggtgtggtggtgcatacctgtaatcccagccacttggcaggctgagacatgagaatcacttgcacccaggagacagaggctgcagtgagtgagatcatcccactgcactccaacctagacaacagagtgacactctgtctcaaaaaaaa

SEQ ID NO: 95653 - DNA, 748 bp, Homo sapiens
agctccgtgtgctcagcctcagagccgtaggcgagagcgcctgtctgcatgagtgagcatatgggtgtttttgagtctgtgggtgtcacagagaggagatcgggagctgcctgctcacaggcactttgggaccccgaaagaaaaggctgtgccgagagagttcttccagtcagaggtgtcatgaagactggacatgggcctatcagggccatgggcatgatgtcagccaaggaactcgcggcctgcctctgccaagagaccagcatctcggcctgagcactcccagcctcccatcgccttcaacctggctgcattcagctgccatgcccctacctccttgtgtggtcagcaccctccaggacttcatcttgggtcacccaaaggccgaggacattgctggccagcaggaaattcatggtgcatccaggaagacttccaagaggtggtggagcagggggcgccacacccagacagctgtgtgtaattgcgcagctgcgggctgctgcgggtgctggccggcagtgcattctgggcacactggactgtgtcaccgcatgcaggctgtggccggagggggaactgctggccgccaaggcctatgtgcctggaaaccagcagggctgctgcaggaggagggctgcagaatgctccagctcagacctgactcagggttttagagggcatagggcataaggctgtggacatagacagccctactgcgcaggaagagcataaaccagccggaggg

SEQ ID NO: 95654 - DNA, 3538 bp, Homo sapiens
  misc_feature (152)..(152): n is a, c, g, or t
  misc_feature (357)..(357): n is a, c, g, or t
  misc_feature (378)..(378): n is a, c, g, or t
  misc_feature (383)..(383): n is a, c, g, or t
  misc_feature (436)..(436): n is a, c, g, or t
cgcagaggtgtcctcagtgcccggagaggttggcagtgtcggccccgagggaagcgtggagcggacggccgacaggggatttctgcccaaacttcatcaccaactctttctgagagcaaaaacatggggccgagtccggcagctgcacgcanaatccaactctctggcagctctcggcaccgacgagctccagatcccgcgttcgcatcccggcgctttgcgcgcagagctaagccttcggacccgtggactgcagcccccgcgcgtcgcggtaaagcgggtcgcgtctccagcccccgaggcgcagcgacggtgggagccggctcggcgttgggggcgggggcggggccggcgaanggggagggctgcgcggcggangggangagccgcggcgacagacggcggcgcgcaccaaccgggcgccggctggcagganccgcgcagaggctggtccgagcgcgttgcgggcgcccggcgtaaggggagtcgggtagcagcatcctcctgggcgccgctttcgcgcggcggcggcggctgcggcggggtctttctttgcttaaatacctcgttggccagaagcgctggtaccgggggcgggttgggtcgggtcgggcagtgctgcacacctgggtttccttgcctagagctgtgtgttcggggtcctttggtccagtcggaggctgcggagcggcgggggttgcctgcgctgtccgcccgggcatcctcccggtgatggaagcagccgccgccgccgctgcggggtcgcgctgtgccccatccaccgctgccagagaggtgggaaaattcgccgcacggaggccgaaagcgagaggggctgcgccgctatgccgggagctgagtcccatataagccgcccccagccatcgcccccagccggcttcgttcccctgagcgagacaggaagctgcggtcccgagaaagcggaggagacgtcgctggagccgggaggcgccgggttcggcggagcgcggagcggggctctgggccgcgtgaaagtttttcttcccgagccgcagggcgcccgctgcccggaaactgcccagggataagtcggccgactccccagacccctcgaaggtgcggggacccccagcggaagcgagagggagcgaaatcgaggaacgagtgacagccggacagtccgccgggcggtgatccggggccgctcccgggcgcgccctcggctccaggtcctacccggagccgctgccatgggagagccagccttgggcgctggggaccagccgccgcgcccgcctcggagtcgcggcccgagtcccggcgccagcagccagcccgctgcgtccccttcccgggctgcagggctgcctccgccgcgccgccggcccggattgtgcctgtgatgagccgcagcccgcagcgagctctgcccccgggcgcgctccctcggctgctccaggctgcgcctgcagccgcgccgcgtgccctgctcccgcagtggccccggcgcccaggacgccgctggcccgcgtcccctctcggaatgaaggtgttccgtaggaaggcgctggtgttgtgcgcgggctatgcactgctgctggtgctcactatgctcaacctcctggactacaagtggcacaaggagccgctgcagcagtgcaaccccgatgggccgctgggtgccgcagcgggggcagccggaggcagctgggggcgcccagggccgcctccggccgggccgccccgtgctcatgcccgtttggacctccgcactccttaccgccctcccgctgccgccgtcggggcggctcctgcagccgcggcagggatggcgggggttgcggcccctccaggcaatggcactcggggcaccgggggcgtcggggacaagcggcagctggtgtacgtgttcaccacgtggcgctctggctcgtcgttcttcggcgagctattcaaccagaatcccgaggtgttctttctctacgagccagtgtggcatgtatggcaaaaactgtatccgggggacgccgtttccctgcagggggcagcgcgggacatgctgagcgctctttaccgctgcgacctctctgtcttccagttgtatagccccgcgggcagcggggggcgcaacctcaccacgctgggcatcttcggcgcagccaccaacaaggtggtgtgctcgtcaccactctgccccgcctaccgcaaggaggtcgtggggttggtggacgaccgcgtgtgcaagaagtgcccgccacagcgcctggcgcgtttcgaggaggagtgccgcaagtaccgcacactagtcataaagggtgtgcgcgtcttcgacgtggcggtcttggcgccactgctgcgagacccggccctggacctcaaggtcatccacttggtgcgtgatccccgcgcggtggcgagttcacggatccgctcgcgccacggcctcatccgtgagagcctacaggtggtgcgcagccgagacccgcgagctcaccgcatgcccttcttggaggccgcgggccacaagcttggcgccaagaaggagggcgtgggcggccccgcagactaccacgctctgggcgctatggaggtcatctgcaatagtatggctaagacgctgcagacagccctgcagccccctgactggctgcagggccactacctggtggtgcggtacgaggacctggtgggagaccccgtcaagacactacggagagtgtacgattttgtgggactgttggtgagccccgaaatggagcagtttgccctgaacatgaccagtggctcgggctcctcctccaagcctttcgtggtatctgcacgcaatgccacgcaggccgccaatgcctggcggaccgccctcaccttccagcagatcaaacaggtggaggagttttgctaccagcccatggccgtcctgggctatgagcgggtcaacagccctgaggaggtcaaagacctcagcaagaccctgcttcggaagccccgtctctaaaaggggttcccaggagacctgattccctgtggtgatacctataaagaggatcgtagtgtgtttaaataaacacagtccagactcaaacggaggaagcccacatattctattatagatatataaataatcacacacacacttgctgtcaatgttttgagtcagtgcatttcaaggaacagccacaaaatacacacccctaagaaaaggcaagacttgaacgttctgaccaggtgcccctcttcttctttgccttctcttgtcctctttctcctatttcttaccctgtcctccacctgccttccattttgaagtgggatgttaatgaaatcaagttccagtaacccaaatcttgtttacaaaatattcgtggtatctgtgaacatgttaagagtaatttggatgtgggggtgggggtggagaaaggggaagtggtccagaaacaaaaagccccattgggcatgataagccgaggaggcattcttctaaagcagacttttgtgtaaaaagcaaaggttacatgtgagtattaataaagaagataataaataatattctttttaa

SEQ ID NO: 95655 - DNA, 3486 bp, Homo sapiens
  misc_feature (152)..(152): n is a, c, g, or t
  misc_feature (357)..(357): n is a, c, g, or t
  misc_feature (378)..(378): n is a, c, g, or t
  misc_feature (383)..(383): n is a, c, g, or t
  misc_feature (436)..(436): n is a, c, g, or t
cgcagaggtgtcctcagtgcccggagaggttggcagtgtcggccccgagggaagcgtggagcggacggccgacaggggatttctgcccaaacttcatcaccaactctttctgagagcaaaaacatggggccgagtccggcagctgcacgcanaatccaactctctggcagctctcggcaccgacgagctccagatcccgcgttcgcatcccggcgctttgcgcgcagagctaagccttcggacccgtggactgcagcccccgcgcgtcgcggtaaagcgggtcgcgtctccagcccccgaggcgcagcgacggtgggagccggctcggcgttgggggcgggggcggggccggcgaanggggagggctgcgcggcggangggangagccgcggcgacagacggcggcgcgcaccaaccgggcgccggctggcagganccgcgcagaggctggtccgagcgcgttgcgggcgcccggcgtaaggggagtcgggtagcagcatcctcctgggcgccgctttcgcgcggcggcggcggctgcggcggggtctttctttgcttaaatacctcgttggccagaagcgctggtaccgggggcgggttgggtcgggtcgggcagtgctgcacacctgggtttccttgcctagagctgtgtgttcggggtcctttggtccagtcggaggctgcggagcggcgggggttgcctgcgctgtccgcccgggcatcctcccggtgatggaagcagccgccgccgccgctgcggggtcgcgctgtgccccatccaccgctgccagagaggtgggaaaattcgccgcacggaggccgaaagcgagaggggctgcgccgctatgccgggagctgagtcccatataagccgcccccagccatcgcccccagccggcttcgttcccctgagcgagacaggaagctgcggtcccgagaaagcggaggagacgtcgctggagccgggaggcgccgggttcggcggagcgcggagcggggctctgggccgcgtgaaagtttttcttcccgagccgcagggcgcccgctgcccggaaactgcccagggataagtcggccgactccccagacccctcgaaggtgcggggacccccagcggaagcgagagggagcgaaatcgaggaacgagtgacagccggacagtccgccgggcggtgatccggggccgctcccgggcgcgccctcggctccaggtcctacccggagccgctgccatgggagagccagccttgggcgctggggaccagccgccgcgcccgcctcggagtcgcggcccgagtcccggcgccagcagccagcccgctgcgtccccttcccgggctgcagggctgcctccgccgcgccgccggcccggattgtgcctgtgatgagccgcagcccgcagcgagctctgcccccgggcgcgctccctcggctgctccaggctgcgcctgcagccgcgccgcgtgccctgctcccgcagtggccccggcgcccaggacgccgctggcccgcgtcccctctcggaatgaaggtgttccgtaggaaggcgctggtgttgtgcgcgggctatgcactgctgctggtgctcactatgctcaacctcctggactacaagtggcacaaggagccgctgcagcagtgcaaccccgatgggccgctgggtgccgcagcgggggcagccggaggcagctgggggcgcccagggccgcctccggccgggccgccccgtgctcatgcccgtttggacctccgcactccttaccgccctcccgctgccgccgtcggggcggctcctgcagccgcggcagggatggcgggggttgcggcccctccaggcaatggcactcggggcaccgggggcgtcggggacaagcggcagctggtgtacgtgttcaccacgtggcgctctggctcgtcgttcttcggcgagctattcaaccagaatcccgaggtgttctttctctacgagccagtgtggcatgtatggcaaaaactgtatccgggggacgccgtttccctgcagggggcagcgcgggacatgctgagcgctctttaccgctgcgacctctctgtcttccagttgtatagccccgcgggcagcggggggcgcaacctcaccacgctgggcatcttcggcgcagccaccaacaaggtggtgtgctcgtcaccactctgccccgcctaccgcaaggaggtcgtggggttggtggacgaccgcgtgtgcaagaagtgcccgccacagcgcctggcgcgtttcgaggaggagtgccgcaagtaccgcacactagtcataaagggtgtgcgcgtcttcgacgtggcggtcttggcgccactgctgcgagacccggccctggacctcaaggtcatccacttggtgcgtgatccccgcgcggtggcgagttcacggatccgctcgcgccacggcctcatccgtgagagcctacaggtggtgcgcagccgagacccgcgagctcaccgcatgcccttcttggaggccgcgggccacaagcttggcgccaagaaggagggcgtgggcggccccgcagactaccacgctctgggcgctatggaggtcatctgcaatagtatggctaagacgctgcagacagccctgcagccccctgactggctgcagggccactacctggtggtgcggtacgaggacctggtgggagaccccgtcaagacactacggagagtgtacgattttgtgggactgttggtgagccccgaaatggagcagtttgccctgaacatgaccagtggctcgggctcctcctccaagcctttcgtggtatctgcacgcaatgccacgcaggccgccaatgcctggcggaccgccctcaccttccagcagatcaaacaggtggaggagttttgctaccagcccatggccgtcctgggctatgagcgggtcaacagccctgaggaggtcaaagacctcagcaagaccctgcttcggaagccccgtctctaaaaggggttcccaggagacctgattccctgtggtgatacctataaagaggatcgtagtgtgtttaaataaacacagtccagactcaaacggaggaagcccacatattctattatagatatataaataatcacacacacacttgctgtcaatgttttgagtcagtgcatttcaaggaacagccacaaaatacacacccctaagaaaaggcaagacttgaacgttctgaccaggtgcccctcttcttctttgccttctcttgtcctctttctcctatttcttaccctgtcctccacctgccttccattttgaagtgggatgttaatgaaatcaagttccagtaacccaaatcttgtttacaaaatattcgtggtatctgtgaacatgttaagagtaatttggatgtgggggtggggtcgaacagggcattgcccggcgtttaacagctcccataccccaaccccgggggcgcccacccctagagacccgccgccacggcggccgcgcctcgc

SEQ ID NO: 95656 - DNA, 3274 bp, Homo sapiens
  misc_feature (152)..(152): n is a, c, g, or t
  misc_feature (357)..(357): n is a, c, g, or t
  misc_feature (378)..(378): n is a, c, g, or t
  misc_feature (383)..(383): n is a, c, g, or t
  misc_feature (436)..(436): n is a, c, g, or t
cgcagaggtgtcctcagtgcccggagaggttggcagtgtcggccccgagggaagcgtggagcggacggccgacaggggatttctgcccaaacttcatcaccaactctttctgagagcaaaaacatggggccgagtccggcagctgcacgcanaatccaactctctggcagctctcggcaccgacgagctccagatcccgcgttcgcatcccggcgctttgcgcgcagagctaagccttcggacccgtggactgcagcccccgcgcgtcgcggtaaagcgggtcgcgtctccagcccccgaggcgcagcgacggtgggagccggctcggcgttgggggcgggggcggggccggcgaanggggagggctgcgcggcggangggangagccgcggcgacagacggcggcgcgcaccaaccgggcgccggctggcagganccgcgcagaggctggtccgagcgcgttgcgggcgcccggcgtaaggggagtcgggtagcagcatcctcctgggcgccgctttcgcgcggcggcggcggctgcggcggggtctttctttgcttaaatacctcgttggccagaagcgctggtaccgggggcgggttgggtcgggtcgggcagtgctgcacacctgggtttccttgcctagagctgtgtgttcggggtcctttggtccagtcggaggctgcggagcggcgggggttgcctgcgctgtccgcccgggcatcctcccggtgatggaagcagccgccgccgccgctgcggggtcgcgctgtgccccatccaccgctgccagagaggtgggaaaattcgccgcacggaggccgaaagcgagaggggctgcgccgctatgccgggagctgagtcccatataagccgcccccagccatcgcccccagccggcttcgttcccctgagcgagacaggaagctgcggtcccgagaaagcggaggtcctacccggagccgctgccatgggagagccagccttgggcgctggggaccagccgccgcgcccgcctcggagtcgcggcccgagtcccggcgccagcagccagcccgctgcgtccccttcccgggctgcagggctgcctccgccgcgccgccggcccggattgtgcctgtgatgagccgcagcccgcagcgagctctgcccccgggcgcgctccctcggctgctccaggctgcgcctgcagccgcgccgcgtgccctgctcccgcagtggccccggcgcccaggacgccgctggcccgcgtcccctctcggaatgaaggtgttccgtaggaaggcgctggtgttgtgcgcgggctatgcactgctgctggtgctcactatgctcaacctcctggactacaagtggcacaaggagccgctgcagcagtgcaaccccgatgggccgctgggtgccgcagcgggggcagccggaggcagctgggggcgcccagggccgcctccggccgggccgccccgtgctcatgcccgtttggacctccgcactccttaccgccctcccgctgccgccgtcggggcggctcctgcagccgcggcagggatggcgggggttgcggcccctccaggcaatggcactcggggcaccgggggcgtcggggacaagcggcagctggtgtacgtgttcaccacgtggcgctctggctcgtcgttcttcggcgagctattcaaccagaatcccgaggtgttctttctctacgagccagtgtggcatgtatggcaaaaactgtatccgggggacgccgtttccctgcagggggcagcgcgggacatgctgagcgctctttaccgctgcgacctctctgtcttccagttgtatagccccgcgggcagcggggggcgcaacctcaccacgctgggcatcttcggcgcagccaccaacaaggtggtgtgctcgtcaccactctgccccgcctaccgcaaggaggtcgtggggttggtggacgaccgcgtgtgcaagaagtgcccgccacagcgcctggcgcgtttcgaggaggagtgccgcaagtaccgcacactagtcataaagggtgtgcgcgtcttcgacgtggcggtcttggcgccactgctgcgagacccggccctggacctcaaggtcatccacttggtgcgtgatccccgcgcggtggcgagttcacggatccgctcgcgccacggcctcatccgtgagagcctacaggtggtgcgcagccgagacccgcgagctcaccgcatgcccttcttggaggccgcgggccacaagcttggcgccaagaaggagggcgtgggcggccccgcagactaccacgctctgggcgctatggaggtcatctgcaatagtatggctaagacgctgcagacagccctgcagccccctgactggctgcagggccactacctggtggtgcggtacgaggacctggtgggagaccccgtcaagacactacggagagtgtacgattttgtgggactgttggtgagccccgaaatggagcagtttgccctgaacatgaccagtggctcgggctcctcctccaagcctttcgtggtatctgcacgcaatgccacgcaggccgccaatgcctggcggaccgccctcaccttccagcagatcaaacaggtggaggagttttgctaccagcccatggccgtcctgggctatgagcgggtcaacagccctgaggaggtcaaagacctcagcaagaccctgcttcggaagccccgtctctaaaaggggttcccaggagacctgattccctgtggtgatacctataaagaggatcgtagtgtgtttaaataaacacagtccagactcaaacggaggaagcccacatattctattatagatatataaataatcacacacacacttgctgtcaatgttttgagtcagtgcatttcaaggaacagccacaaaatacacacccctaagaaaaggcaagacttgaacgttctgaccaggtgcccctcttcttctttgccttctcttgtcctctttctcctatttcttaccctgtcctccacctgccttccattttgaagtgggatgttaatgaaatcaagttccagtaacccaaatcttgtttacaaaatattcgtggtatctgtgaacatgttaagagtaatttggatgtgggggtgggggtggagaaaggggaagtggtccagaaacaaaaagccccattgggcatgataagccgaggaggcattcttctaaagcagacttttgtgtaaaaagcaaaggttacatgtgagtattaataaagaagataataaataatattctttttaa

SEQ ID NO: 95657 - DNA, 3109 bp, Homo sapiens
  misc_feature (152)..(152): n is a, c, g, or t
  misc_feature (357)..(357): n is a, c, g, or t
  misc_feature (378)..(378): n is a, c, g, or t
  misc_feature (383)..(383): n is a, c, g, or t
  misc_feature (436)..(436): n is a, c, g, or t
cgcagaggtgtcctcagtgcccggagaggttggcagtgtcggccccgagggaagcgtggagcggacggccgacaggggatttctgcccaaacttcatcaccaactctttctgagagcaaaaacatggggccgagtccggcagctgcacgcanaatccaactctctggcagctctcggcaccgacgagctccagatcccgcgttcgcatcccggcgctttgcgcgcagagctaagccttcggacccgtggactgcagcccccgcgcgtcgcggtaaagcgggtcgcgtctccagcccccgaggcgcagcgacggtgggagccggctcggcgttgggggcgggggcggggccggcgaanggggagggctgcgcggcggangggangagccgcggcgacagacggcggcgcgcaccaaccgggcgccggctggcagganccgcgcagaggctggtccgagcgcgttgcgggcgcccggcgtaaggggagtcgggtagcagcatcctcctgggcgccgctttcgcgcggcggcggcggctgcggcggggtctttctttgcttaaatacctcgttggccagaagcgctggtaccgggggcgggttgggtcgggtcgggcagtgctgcacacctgggtttccttgcctagagctgtgtgttcggggtcctttggtccagtcggaggctgcggagcggcgggggttgcctgcgctgtccgcccgggcatcctcccggtgatggaagcagccgccgccgccgctgcggggtcgcgctgtgccccatccaccgctgccagagaggtgggaaaattcgccgcacggaggccgaaagcgagaggggctgcgccgctatgccgggagctgagtcccatataagccgcccccagccatcgcccccagccggcttcgttcccctgagcgagacaggaagctgcggtcccgagaaagcggaggagacgtcgctggagccgggaggcgccgggttcggcggagcgcggagcggggctctgggccgcgtgaaagtttttcttcccgagccgcagggcgcccgctgcccggaaactgcccagggataagtcggccgactccccagacccctcgaaggtgcggggacccccagcggaagcgagagggagcgaaatcgaggaacgagtgacagccggacagtccgccgggcggtgatccggggccgctcccgggcgcgccctcggctccaggtcctacccggagccgctgccatgggagagccagccttgggcgctggggaccagccgccgcgcccgcctcggagtcgcggcccgagtcccggcgccagcagccagcccgctgcgtccccttcccgggctgcagggctgcctccgccgcgccgccggcccggattgtgcctgtgatgagccgcagcccgcagcgagctctgcccccgggcgcgctccctcggctgctccaggctgcgcctgcagccgcgccgcgtgccctgctcccgcagtggccccggcgcccaggacgccgctggcccgcgtcccctctcggaatgaaggtgttccgtaggaaggcgctggtgttgtgcgcgggctatgcactgctgctggtgctcactatgctcaacctcctggactacaagtggcacaaggagccgctgcagcagtgcaaccccgatgggccgctgggtgccgcagcgggggcagccggaggcagctgggggcgcccagggccgcctccggccgggccgccccgtgctcatgcccgtttggacctccgcactccttaccgccctcccgctgccgccgtcggggcggctcctgcagccgcggcagggatggcgggggttgcggcccctccaggcaatggcactcggggcaccgggggcgtcggggacaagcggcagctggtgtacgtgttcaccacgtggcgctctggctcgtcgttcttcggcgagctattcaaccagaatcccgaggtgttctttctctacgagccagtgtggcatgtatggcaaaaactgtatccgggggacgccgtttccctgcagggggcagcgcgggacatgctgagcgctctttaccgctgcgacctctctgtcttccagttgtatagccccgcgggcagcggggggcgcaacctcaccacgctgggcatcttcggcgcagccaccaacaaggtggtgtgctcgtcaccactctgccccgcctaccgcaaggaggtcgtggggttggtggacgaccgcgtgtgcaagaagtgcccgccacagcgcctggcgcgtttcgaggaggagtgccgcaagtaccgcacactagtcataaagggtgtgcgcgtcttcgacgtggcggtcttggcgccactgctgcgagacccggccctggacctcaaggtcatccacttggtgcgtgatccccgcgcggtggcgagttcacggatccgctcgcgccacggcctcatccgtgagagcctacaggtggtgcgcagccgagacccgcgagctcaccgcatgcccttcttggaggccgcgggccacaagcttggcgccaagaaggagggcgtgggcggccccgcagactaccacgctctgggcgctatggaggtcatctgcaatagtatggctaagacgctgcagacagccctgcagccccctgactggctgcagggccactacctggtggtgcggtacgaggacctggtgggagaccccgtcaagacactacggagagtgtacgattttgtgggactgttggtgagccccgaaatggagcagtttgccctgaacatgaccagtggctcgggctcctcctccaagcctttcgtggtatctgcacgcaatgccacgcaggccgccaatgcctggcggaccgccctcaccttccagcagatcaaacaggtggaggagttttgctaccagcccatggccgtcctgggctatgagcgggtcaacagccctgaggaggtcaaagacctcagcaagaccctgcttcggaagccccgtctctaaaaggggttcccaggagacctgattccctgtggtgatacctataaagaggatcgtagtgtgtttaaataaacacagtccagactcaaacggtgcgttggccctccgtgtatcctctagagtcagctatgaaga

SEQ ID NO: 95658 - DNA, 577 bp, Homo sapiens
aacgggtgtggctcgagaggtggattttggatttgttctacagggaatacagtataatcaaagtcaagataaagatccagtttttaaaatggtctcgatcctctgcacagcatttgatgctgttgggctggtagctgttctcttcatctgaggcactgtagagccctgtacctcaaaccttttctactgctgcttgtctgtttctttcacccagaacccttcaccccacagatgtagatgttcaaatcatatggttctgccttcttccctcttcacatatcactccctagggtgactcttaacactccatggaaatccttgttccccctgagtctcctccttaaacatcaagcaatccagaatatttactgctcccatcaggctgttattctataggatgcaccacctggcatcccaccctattctttccacctttcattaaattttctaacagtctttcactacggtttttgttacctaaaatctgcagtttcctgtgcatagcatagggcttgtcacacagtaggaattcagaattctttgttgactaaataatactccattctttctgcctcat

SEQ ID NO: 95659 - DNA, 632 bp, Homo sapiens
tgttgttctgagatagagtctcatctcttttgcccaggctgaaatgtggtggctcgatctcgtctcactgcagcctcaacctcccctcggctcaggtgatcctcccacctcagcctcccgggcacatgccaccatgcctggctaatttttgtatgttttgtagagacggggttttgccacgttgcccaggctagtcttgagctcctgagctcaagtgatccacctgtcttggcctccccaacaggcatgaaccaacacgcccagccagtttcagtgatttttcaagaaatacgtactcattttagaaagtacaaagagattgaaataagagctcactaaccagagatgacccattatggtttaaatttctttgtatatgtgcctaccttttcctgtgtgtgcatatttaatacacggcttgagtattccttctctgaaatcgttgggaccagaagtgttttggatttcaggcttgttcagactttggaatatttgcattacacttactgtctgagcatccctaatgggaagatctgactccatagcacatttcttttgaatgtcatgctggtgctcagaaagtttcagatttgggagaatttcagatgttggattagggatgttctacctat

SEQ ID NO: 95660 - DNA, 479 bp, Homo sapiens
aaagtagctgattctaggactgaacaaggaaatacacaagatgagtctgaaggatcttgtagtgccagatagtaagaaactgctcaaaacgaaagctaaaacaaaaagagaaaaccataacaatgggggtgtgccaaagagatacaggagccaactgaaagcgttcccagtggccaaaactgaaaaaatttgagcaggaaaataaaatagtatttataatttcaaagcagaaaatacataaacatgagtccatatggatataataaacgactgaataaagacataaataaaggagaactgacaatctcccttgtggaaaaaatccaaataatttctgtagataacccactcttaaggaggtagagcactagccagtatgcattggctgcacatagtaactttctttctttttctctttttttttttttttgagacggagtttcactgttgttgcccaggctggagtccaatggcatgac

SEQ ID NO: 95661 - DNA, 374 bp, Homo sapiens
acggtatacagtaggtgcaatttcagtattagttgctactattgtcataatcaccagagtgtttcaagagctgagcctccatggctctccacatcgcttcacaaactcccctgttctgggaaccagcctgaattgcaacctcaacccccgactgatgcaaccctataagcaaaccagaatcatggctggggtaggggctctaccctttgggatctggccaaaccaggaagaggtagagtggcctggaggcaaaccacaggtgattcagaatgttcaccacgtggttaaccctgtcttactcctgctttagagagaagccaccatgaaaagtcctcatcatcaggggacagacctctctgttccctggttataat

SEQ ID NO: 95662 - DNA, 615 bp, Homo sapiens
gatgactaccctccatggattcaaagaatggcatttaagacatgattgtgattaattaaacactagcatgctcagtgcagccaagaggaagaactgaaagctaatgaagagggaaattgggaggcagtagaaactgccactttgtgacaacatctgtggctcctgggagcttaaacaacatcagattttcctttcctcttctgcaaaattgagacaattttaatagttgtcacataggaaactgcaaagatgaaataaaataaagtttgcaaattactggctgagaatctgaacatggtaaatgatagttacctttaatttcaatgtaataaataacataatcctgtatagtccacatttaaccaaatccagacaagagaagctttgattgcagctcccctgacattcctgaggtctaacacgttgatgtccctcaaattgaaactctaggaaaggggactgtctgtaaaactgtgaaggagcagagcccaggttcccattgtcagagtagtgccttgcacagaggaaaaattgtacagcccccatgaagcttgttccagggaaccagtgtctcagcaagttgcgatagaaaatggctgctctgtgaatagtata

SEQ ID NO: 95663 - DNA, 411 bp, Homo sapiens
ggacagctccagctattcaaaagttcctctttacactaaattgagtccacatctgactgcccatgacttccaccagtcagtcctagatttccttccccggcccccatggggtcacacagaacaaatttgtggcctctttcgtgccctagtgcttaaacatgtaaaaggagacctcatctccttccgaaaacttctctgagccatcaccccaaaacctgcaactctttctcaggcgtcaaagttctgagtcctttcaccctttaacagggattaaaatgtaaaattgttttataaaatttggaagctgagacaggagaatcgcttgaacctagggagcagaggttgcagtgagccagggttgcaccactgcactccagcctgggtgacagaggaagactccatctctcaaaa

SEQ ID NO: 95664 - DNA, 732 bp, Homo sapiens
caaatacagcagtttactcttctgaagtaaagcatttttggcaaaggcaagagcttgagaaaaagagatgagaagatttggtacatttttaaagagcttgtgattatagtgtgtagtttatggtgagatttggcgggcaggaggtttagctctggtagaagcaaaagtctgcagtcccatcagggtgaagagtggtgatggttaacaggcatggaaaagcacaaggtgttaggagaacgcaaaggcaacagatgggaggtgtgactcattacttaaatgccacagactccttagaatgaaaatctagcctttatatccctatggcaaaagattgctggactttaaatcctgatttcacccctagccttgtaaccatggacaagggcttcagcctttctcggcttcagtaaaatagaattgataatgcctacctcacagaattaacacaaggattaaatatagcaaccgataagcaaacactgatagctctgatctaccacactgtaaggggctagtcatgagccggcgtcagctttgttagtagccttgtccaactgatgactatatttgcatttgtggtcaactaaaaattcctccacacctctgagaattgcatttggctgcatgccatagaaacctgatcgtggtggcttatcataatagctaagagatttatttttctcaaatccagagataggcagtccaaggctggtgcaggggcttaagaactgg

SEQ ID NO: 95665 - DNA, 464 bp, Homo sapiens
cagagaggagggttgttttccctgaacatgataaggagctgagcagggcaaagtgggggctctggcccgtgattggtagacaggatgccctggaatgcagttggcctgcagcccagaatccagcactttgtatttgtttgtttctgggagactgtggtctggtgctactgtgacaggaagtgagaaagctgggagtgggggaacagagagggtcgatgtctttgtggttctcctgtgaaatctctttgtccctggagagcagctctgctacagagctctgctgagaagagagcagcctttgtgtgtctaatgggtctcggagcatctagctactccgagggattagagagtgtgaattctgactgtggccttttgcgttttagcacttaagttatataaatggtcctgatctcttagcactgggaagcttactgagttttgtgtgtgctgctattctttgtgga

SEQ ID NO: 95666 - DNA, 137 bp, Homo sapiens
ccaagatcaagccactgcactccaggctgggtgacagagtgagactgtctcaaaaaaaaccaaaaatatcctctctggcctcagtttactcatcctttaatggtaaaatctgctttccctcctcatagggctcttgt

SEQ ID NO: 95667 - DNA, 786 bp, Homo sapiens
aggagaatttacaccatggaaactggcaaacgctgcaaacactgcctcccaccatcacagacagccagttattaagcatttatcagcacattatgttgccagggactgtgctcagagttattggggggagaggcagtagcagtgttatgtagtcaagcttataactgataaactgtagtcatttggaaaaacagaagcaacgcagaggagatgggagtgaaccaagaacatagtaaccaccctgaacctcctcaacaaaccccagagggacatgtccccagaggagatgcagaagcacggggaggagggtccactctgtgctccgcagtcagtcaagaacaacactgaagtgctcaccaactactgacaacaacaagctgctgggctgcgaaggccttgagtagacactgcaacatggtgctggagaatgtgaaggagatgtgtactgaggtccccaaggggggcaacggtggcaagggcaagaagaagtccaagccagccaacaaagaccacttcatctccaagctcttcctgtgcagggactcagtcatcaccaacaagtgggggccacctccccattgacagaactcactccctcatcctatgaagacctaccctttgttatggggataataaagccctgtgcttttttttttctagtagtaaaaacaaaacataacaacaacaataaaactttagtcatttggtcatattagggaagtcatttattattctgtttcttcagaaataaaaaacagataacaaaaatattatctatttctaggg

SEQ ID NO: 95668 - DNA, 743 bp, Homo sapiens
gtcaaattgtttatactcagaatataaaacccaaatgattttccaaagattttatatgatcttaagagacaaacatctcattattcttctctgtcatatcttatctgtgagagctagtgaatttagaaaacaagattaccgttaaataacaaggcaattaatttaagcagtgtatagctccatgtctttgtttataaactggaaattcccatctccaataaattcataaaggaactctgttacctgaatgtctacactatgaaaatgtttaaacagaggatcaataggttcaggaatactgttcttcttttttattatcttcaacaatggcaaaactttcttccaataatgaacacttctccctatgtattctcgttgatcataaaaagaattaagaccactgccctaaaaaagaaagttaaaagcacacaactttaaggaacacgcatgattagatctaaagttcatttacaagttgtaagaactggctaaaatttcaagtcaaaaccaaatggtacctcaatagtcatttgttcaacttctaaatactgtaataactaaaccaccttaataccagtgaactcactgcaacctctgccgtgcaggttcaagcaattctcctgcctcagcttcccaagtagctgggattacaggcacctgccaccatgtctggctaattttgtagttttagtagagttttttttgtatttttagtagagacggggtttcaccgtgttagccag

SEQ ID NO: 95669 - DNA, 530 bp, Homo sapiens
gtcctgcctttccagacagaaccaatgttcattttacatatattgattgatgtctcatgtttccctaaaatgtataaaaccaagctgtgctctgaccactttgggcacatgtcatcaggacctcctgaggctgtctgaagggcatgcatcctcaaccttggcagaataaactttctaaattgagacctgtctcaaattttgggacttcacaccactaacatttaattataaatgtttaaaactcatcactgggcctatataaacaagtgtaataatacaacacattagtgaccatttctataatatatgtttcatgctaggtatagtcctacaaacttgtcatgttttatttctgattttttttcacagctattctgagggatgtcatgctctgttacaagtgaggaatctagggtcagagagcttgtgtccaggcccaggggcacagggcaaggaaagcacagtatagttggggtttagaccacatgggctggtgttggttgacctgaccccaacacctttgcctttgg

SEQ ID NO: 95670 - DNA, 407 bp, Homo sapiens
acatgcatattgcaggatgagagcagatagaaggaaaatctgtttttggaattgcatgtgtaaaaattacctgagtagcataaagatgaggtggttagcactgataacgagagaaaatgtgtaggtgaagagaattcatttaaaatcttcaggctgagcatggtggctcacacctgtaattctagcactttgggaggttgagggatcacttgagcccaggattttgagatcagcctgggcaacatgatgaaacaccatctgtaccaaaaatacaaaaattagctgggcgtagtaccacactcttgtagtccctgctactcaggaggctgaagcatgaggatcacttgaatcaggaggttgaggctgctgtgagctgtgactgtgccactgcactccagcctagacaa

SEQ ID NO: 95671 - DNA, 249 bp, Homo sapiens
ttttgacggagtcttgctctgttgcccaggctggagtgcagtggtgcgaacgtggctcactgcaagctctgcctcccaggttcacgtcagcagaggtctgccctgatttaaaactttactagcagcctggaatacaagtcagttgttgttaacaaattgaaacagtttccctttttagttataacaagtaaattcagttctcatagcctgatcaattctgccttgacaataaattgatatcaaataaca

SEQ ID NO: 95672 - DNA, 925 bp, Homo sapiens
gaagaggaaatgactcgtagtcaggttcaggagttagtggagtatttggactttggtactgctgtcttccaaggtagctctaagttttgatgtgtgggcttctgagtttatattctgaaaggaaatacacttcttttgaacatccccactaggttcttttccattgtcaataaggagcatcagccagtgaatctgtttcaggtttccattctgcagaactcctccaaagcatgtgctagtggcaagacagtggttcttatgatgttttcccttaacttttccttgtatgttcttgggtggttcctaagggaaagggaagcacatgatcatgggaatgatagcccagaacaaaaagaaatcttgtcttaccacagtgttttataggagagattgggagaaatcatcctgttttctctgtgacctgatttcagaagagactgatccaaaaattataacggcagggaacctagtgcatttggcactgagatttaaatgcaaccagaattgtcctcaaggcccagccataaaagcattgtctctctcgaccttctggtatcttgttagagagcttttcactgtgaggaagtgtggaaaaatagctctgtgtgtgtgtgtgtgtgtgtgtgtgtgtgtgtgtgtaatctgttaggtgggggataggttttgtgctagccaatattaaaagagactgcaataaaaaaattaccctgatctgatagaaagcaagtgtttttgtatgtgtgggtgaatgtgtgttcatgcccgtatatgtctacacacagatgacaaattatatttgaaatcgttggaaaataaattcagatcaaaatgcctttcaggcccattacctagaaatctatcttaaaacctgggtatgttcctaaggtcatttctttgcttatgctaaattaattacaattatgaa

SEQ ID NO: 95673 - DNA, 290 bp, Homo sapiens
ttttgcatttttagtagagacggggtttcgccgtgttggccaggctggtcttgaacttctgacctcaagtgatctgcctgcctcagccttctgctgggattacaggcgtgagccaccacacctggccaggttgtatatttgtgtccatttatcttctcagcagttttgtgcgtttcgtaacaacaacaaaaaaaagttttagaaaatgtccccaaattagccgggcacggtagcgcatgcttgtggtctggtcccagctacttaagaggctgaggtgggaggatcaatcg

SEQ ID NO: 95674 - DNA, 100 bp, Homo sapiens
ttaaaagaagctgcagcaaccttcagagcctgtcgcagacgtgggtggtgactgtcagcggaggttctcaaatcattggtgacataagtgagacaacatt

SEQ ID NO: 95675 - DNA, 703 bp, Homo sapiens
agcgggcatgagccgctgcaccgggccttttctggttttattaatggtgcatttgctatatccctttaaataaaaagaatgttgacataaatccaggttaaactgacacaaattaaagcaactttctttttatttaaaaatggtaacctgaaacatgaagagctgttctcgttctcagaaaaagagaacgagaaactcacaatccaaaagcccataacactttctaaattagttaaataaataggatgcaagcacttgactttggcacgtagcagtcttgaagttcctacttcctaccactctaatataagatctcagctactaccttgtgaccctacaaggagttaaagactttaaataccagtcactttgtagctttgcagtggttcagcaattagccatctaaacacaaaatctatagttcttgtacatagaatttgccccatgaatatctgttaattgagaggtgagaacataagatttcctctggaaatttgctgctccagtgaacgctgtagctttctgggatgactctgatgtctccacagaagcataaaattctttactgttttttcagtcacctgaaaataaaccacttcatttcagaggcagtgggggtggtcacatgtcaccccaaaccactttgaggaacaaagtttcaataacttcttacttggaaaaaaaagaacctctagaaatgggt

SEQ ID NO: 95676 - DNA, 391 bp, Homo sapiens
gaaggcaggagcaaactagagagagagagaagaaaagtcgtggccttaccaacaacccaaaagccctgaattctctggtgagataggcaactctggaggttgaggcagctgtagctcagccaagaattagaaggatgattctagatatttaaaatcaacagcatccccacccacgtaacccaccttcaggaaccagtagctttaaccaagagaacaagaaactcaatgagcagcagcctcaacaactggctctttcctcctgggtaaggagagggcagtggggaaggacggtgcctcaaagggaagtggaggcgctatcaatctggcctagacaggtaggttgactgcttttacatgggtgggctggggcctggtctgggacccctgctca

SEQ ID NO: 95677 - DNA, 702 bp, Homo sapiens
tgcagccttgacctcccaggttgaagtgatcctcccaacctcagcctctgagtagctgggactacaggtgtgcacctcgtctgcctgatctttttgaatttttgtagagaggggtctcgctatgttgtccaggctggtctcaaacttctgggctcaagcaacccgcctgccttggcctcccaaaatgctgggattataggcatgagccactccatctggcctcaagatgttaaatgcagtctaggtgggattcagacttccccctaccccaagtggatgaaaaagtgggtgcaggctgtgagagttaaactgacactttgaggtgctgccattgtaaatcagagagttaagaaaaacaaatagctacatactgtgatgaaccagaaataaccaggtcatcctgtgcagttcagttcccccaaataaaagaaacttgagcattcccatactttactgattccctaaggaaaaacggcattatctcttatgactgcagtgcttacctatgtcaggggatatgatgtgacatttgtgggtttgataatcaagtgacaacatttctaatttcacacagtgagcagcctatcataaacttggtaaccttggcaaatttgtagttatttccctttggtttttttccatctttcaatggattcgttttctttttaagtagagacagggtctggctgtgtcacccagaat

SEQ ID NO: 95678 - DNA, 414 bp, Homo sapiens
atttcccctcactgcctacgacggctccaacagttactcattgtaatttgactggtagaaatgcatttttcacagcgtctgggaaatcagctttatggtccccactttaagtacatttgacacaactatttaaatatttaagacaattttacatttgtagtacccggaggagtatataattgggaagattttcattataagagtttttattttacttcagggcttctgacatttcttgctgggctctgctgtccttggagacaaagggagttagttattcattagcgtttgtgggttattcattattgttggtcagacaaaaaagacagaataatatcaacaaaggacaccaaactaatcgggattaaaaaactcttttgtgtcacttaaggttggtgtctcttgtaaagacct

SEQ ID NO: 95679 - DNA, 370 bp, Homo sapiens
tattgtgaggtattaaaatcaacctgcgaaaagtcattctgttacttgacttgagatattttcaatatcaacttttattattttttaaattacagaacaataaatagtaactagaaaaatatgactgcagataagcacgaaaaagaaaaaataaacttgtaattacattatccacagataatgttttaaaagatttataaattactttaataatatgttttgataactggtaggacccattctgcataattactcatttgtttcataattttcctgactatacttatgataatatatttgcacttaactcttatagattttaaataaacagtttcatacaggacatataattttgtaacctgtatgctat

SEQ ID NO: 95680 - DNA, 574 bp, Homo sapiens
ttagagacggggtcttgctgtcacccaggctggtctccaactcctgggttcaaatgatcctcctgcctcagcctcccaagtagctgggactacagatgcgtgccaccacgcccagcctgaataggctcttcttggtaatctcttcccaatgaaggggagctgcagcacacataaatgcttgcaaagacctctgatatttagttctgaaatgcaaatgctcaatttcacagagaagacactactaatgatactctggttcatcaaatatcaaacagctgactctctgcacacattgctcatgaggggtccaggagtgggctgggggcaaggatagtagacccaggtcagtaagacataatgcacccaacagccacacaccagcagcctaatgagaaaccactgtctatcaggacgagaggccccaggggctataaagcaaaagagtacttttccatccttagaaacatctgttaggaaggtaagtcctccttgatgtctaatttcaatccctgtgctgaagtttctattcttctagcagtccataaagataaaagaaacactcaaagaagaaaaa

SEQ ID NO: 95681 - DNA, 239 bp, Homo sapiens
ctaatttttatgtacttttagtagagacggggtttcaccatattgaccaggctggcctcaaactcctgacctcgtgatccacccacctcagcctcccaaagtgctgggattacaggtgtgagccactgcacccggccttcctgaatgtttctttactcactcatattatcatttagaacagggatcacaaactacagcctaaggaccaaattcagacaaccacctgttttggcaaataa

SEQ ID NO: 95682 - DNA, 873 bp, Homo sapiens
  misc_feature (839)..(840): n is a, c, g, or t
agggccaggattctggaacttgggttgcctgatagaccctatacaaaagatgtagtagggaaaaggagcgacagctggctaaaggggccccccacaaccctccccgacaccctaggaaagcagcctctctccgctgtcccagggtgccatggagatggagagcgcggcggcctccacacgtttccaccagcctcacatggagaggaagatgagtgcgatggcctgtgagatcttcaacgagcttagactagagggcaagctctgcgacgtggtcatcaaggtcaatggctttgagttcagtgcccataagaacatcctctgtagctgcagttcctactttagagctttgtttacaagtggctggaacaacactgaaaagaaggtatacaacatccctggcatttctcctgacatgatgaagctaatcattgagtatgcatacacccggaccgtgcctatcacaccggacaatgtggagaaactgcttgctgctgcagaccagtttaacatcatgggtatcgtcaggggttgctgcgagttcctcaagtcagagctgtgcttggataattgtatcggcatctgtaagttcacggactactactactgtcctgagctgaggcagaaggcctacatgttcatactgcacaactttgaggagatggtgaaagtctcggcagaatttttagagctctcggtcactgaacttaaggatatcattgagaaaagatgagctcaatgtcaaacaggaagatgctgtatttgaggccattttaaagtggatttctcatgaccccaaatagagagaccagacattttcaaatttggttcctaaggtgccnnggcctaatgctgccgagtaccttctgaaacact

SEQ ID NO: 95683 - DNA, 951 bp, Homo sapiens
ggtggaatgttacaatctgaatatgtaccccaaaatttgtagtgttaaggaggtgtggcctttcgggaggtgtttagttcatgggttctgtagcctcatacattgattaatgctattataaaaggacttgacagagaaagtgtggtcctttttcatccttccatcttctgtcatgtaacgacacagcattcctcccctctggaggatgccgcattcaaggcaccattttggaagcagctagcaaacttcattaaatgctggcatcttggatcttggccttcacaccctccagaactgtgagaaatgaatttctgttgtttataagctacccagtctcagatattctgttatagcagcacaggcagactaagacacaagtatagtgcacatccatacctacagcagcgcttgtccatgacattttctgtacctctgttgtcaccctaattagtttggcattgcctaccatctagatacctccttcagtccacactttcattccttatatacaatgctggatgattaatactcaacatgtccttcaaaactcagctctttttcctgggaacagaatatatgctaattaatttttgttaaatataattaaatttatctacctaactaccacacagcccaaagagatggggaggtgttatggactgaatgtatcccccataaaattcatctgttgaagtcctaaccccagtaactcaaaatgtgattgtctttggaggtagggtctttaaagaggtaattaaagtgaaatgaaatcattgaggtggtcccaattctaatctgactgatgttcttataagacgaggagattgaggccagacccagtggctcatgcctgtaatcccactatgttgggaaaccaaagcctgcagataactggaggccaggagttcaagaccagcctgggcaacatggcgaaactctgtctctacaaaa

SEQ ID NO: 95684 - DNA, 389 bp, Homo sapiens
tgttgcgccctttccatattcactagtgaaaagcctcacagcttgggctctgggagtcagcctggtccacctttgaaacccagctcctccacattaggctgtgtaaccatgggagagctggttatcatctctgcccttctgtgtcatcctgggcaaaatgggaataacaggagcagagcataggttgttgtgagaattcagtgaggcaatgcatgcccaatactgcctgacatacagcaagtgctccataaaagttagctattgcttcagagtttaggttagaatagagacttactatcctgtgcagctatggtttgcataacaagcacagatcagaaagttagacatatctattagcaatttattttagaaatgcattctcctgtctc

SEQ ID NO: 95685 - DNA, 597 bp, Homo sapiens
tcgaggccgtagtacactatgatcgcacctgtgaatagcagtttcactccagcctgggcaacatagcgagacttagtctctaaaatgtttttaaaaatgtgccacatactcatgttttgccacacccagaatggcctttctaactttgcaaattcaatcaattagtaagaacccctgagatctcaatttcaccatggagcttctcctaaccaaatcccacggccatagcgattgctccccaccctgtccatctctgttcctggagggcagaaactagatcttgtcctgatgtttttctagaagtgcctcataaaaaaatgagcatgttggagctgctctgaaaagacctgctcacccattagccttttccacatcacttttatcattaatgctgtaagatcatatggactttgtgatttctagttttcttgttttattaattactcgatttaacttttatttggtgtatattgttattccgggcttattaagttttactaattggaggtttgtgcaaatatgttgatgtacgatgattacattcttagttaaaaattttaatagctctactcttggctgaatataattttgattagg

SEQ ID NO: 95686 - DNA, 228 bp, Homo sapiens
caaactgttaaactctgggaataagactgacagacgggttttctgagttacatgctttcatataatagttgtgtattttttacaatagtcttgcattgctgttgtaataaaatagaagattttaaaaactcaagggtcctgggtatctaagaaagaaacattaactatagagattatttgatggtagagattttagagagacacaaagtccagaggcaggacaagcag

SEQ ID NO: 95687 - DNA, 934 bp, Homo sapiens
aaggaacttgaagggtgaattacaatatcatgtgaacaaaactagcagtgactgggatcataacaatcagactaaatgatgagggcatttttaaaaaaattggggaataaaggacttagcttgtttcattatttcaaaattgagagattattatttgaccctcacaatttcgatttgtgaatttatatcatttctttgttaaaaatggatgatcccaattgaggtggctctgaaagtacgtattgttgccagtaaccatgagactgtcactcattttcctgatagcctcagttccagtaggaaggggaaaattattgttggctgtggcttcccttttttgcaaataatatccccaactcaagcagttgcaaacagtttgtccccgtggttaggggctaggatgaatttatgtttcttgtacctggtgctatgcatggctcatgataagtactaaatttgatgtttatttttaagtgtttttttcttatcctagaatgctgaagaattttcgacactagaacccagggattaaagttttgatgcatctacacttttagttatcatatactgtgcactttacaaaacattccctcatttaatctacaccccccccattttaccagtgaggaaactgagacccacatatatttaactgacttgcccaactaaagtcacataggaaatggtgaggctgaggcgggggaatgacttgaacctgggaggtggcgattttactcagccgagatatgtgcgccattggcaactccaagcctggggtagacagacgtggagactcctggtctccacaaaattgaattacacagacaaggagagaacagacatgacagcaacgaaaacggaaacggacagaaagggacagaacacgaacagaaaaacaaaagaacacaacaacaacaaaaaaacaagaaagaaa

SEQ ID NO: 95688 - DNA, 551 bp, Homo sapiens
gaagtatgattatcaatccaccagagagacggggaagagtggcccacatgagctcagaattggctggtgatggcgttgcaggtagtagaggtgctgagaactgacactatatccctcacgtgatgctctctttagaagatcaggctctccctggctaactatggccttcagccctctagacaggaacctgctggaccacaggggagtgggccttgccatattcccataggttgagcacacacagactagcaaacatcaaacaccaataagccctcacacacctggtatgatattgccaacatcacttctcgggggatagcaattatgccacaatttcatgtccctgactcaccaggccacacacgacaagactgcaagagcacctcctccttgggcccctggcctgggcagaactcacgggagagcccctggattgcagagtgctctttccccaacacccatctgacctggccacccccaccctaaaactcattaagtgctccccatggccaaaagcagtggtctccgaagtagggtttagaagaaaaaga

SEQ ID NO: 95689 - DNA, 454 bp, Homo sapiens
acatttaaaactaaaacaatttatactaatacagtttatacatttcatactaatttagctacagttggataaatatttaatggaacaaagtaaatcaaagtaccttttcaaatgaattggaaattaaatccacataacaattttttatgaccacactattacagtgtgatggcatgccaaatgatcataatgtggaattatgtatttcttcattggctttcaagattctgttctttagtttgtgggctcctctccaacttgcttgtctcctcacagtttaggcgactgtttataattcttgtccatcctgcataaacacacacagtcaaaatgaaaaaaagcttctatcagcagatctgtgcttgctgtacagaaatgggaaaacaattgaagtttgcattatcttttttctaattaccagatcgtttttggagctatttaggcatacgctttt

SEQ ID NO: 95690 - DNA, 756 bp, Homo sapiens
agcggaggtacctcctggtacattattctaaaaggatcagtgaatgtagtcatttacggcaagggtgtggtctgcaccctgcatgaaggagatgacttcggcaagttagcactagtgaatgatgccctacgagctgcctctatcgtcttacgagaagataactgccatttcttaagagtagacaaggaggatttcaaccggatcctaagggacgtggaggcgaatacagtcagacttaaagaacatgaccaagatgtcttggtgctggagaaggtcccagcagggaacagagcttctaatcaaggaaactcacagcctcagcaaaagtatactgtgatgtcaggaacacctgaaaaaattttagagcattttctagaaacaatacgccttgaggcaactttaaatgaagcaacagattctgttttaaatgactttattatgatgcactgtgtttttatgccaaatacccagctttgcccggcactggtggcccactaccacgcacagccttcacaaggtacagaacaggagaaaatggattatgccctcaacaataagaggcgagtcatccgcctggttctacagtgggctgccatgtatggagacctcctgcaagaggatgacgtgtctatggccttcctggaggagtttatgtatctgtatcagatgatgcccggatgattgctgccctcaaggagcaactgccagagttggagaagattgtccagcaaatctcagaagatgcaaggtccacaa

SEQ ID NO: 95691 - DNA, 256 bp, Homo sapiens
acccctgcctcaagcctaatggtgtcccctgctttgacagttaggaccccacttaatttcagatcaagtactggtttttgtaagtcttctttcacaacaacttcctctgtcttcacccagtcactttccccaccttcattctttgtttgcactctgaactcataaatctggttttcaacacatctgtcaaccatgtagtgagtttctttaatgcttcctttatgcactctttcccagtcatcggagcccttaagcc

SEQ ID NO: 95692 - DNA, 2046 bp, Homo sapiens
acaattagtgtcagaaaaaatcagggatatgggctttagggatgcttggaaatactgaaaactggaatacatttgacatcgccaccaagaaagcttatctggacatatttctgcccaatgaacagagtattagaatcgaaattataacatcagacactgctgaaagagtcctagaggtggtgtcacacaaaattggactgtgtcgagagctcttgggctacttcggcctctttctcattcggtttggcaaggagggcaagctctctgttgtgaaaaaattggctgactttgaactcccttatgttagtcttggaagttctgaggtggaaaactgtaaggttggactccgaaagtggtatatggctccatccctcgactccgtgctgatggactgcagggtggcggtagatttgctctacatgcaggcaatacaggacattgaaaaaggatgggccaaacccacacaggcacagaggcagaaattagaagctttccagaaagaagacagtcaaacaaagtttttggagctggcccgggaggtacggcactatggatacctgcagctggatccttgtacctgtgactacccagaatcaggctctggagctgttctttctgttggcaataatgagatcagctgctgcatcaccctgcctgacagccagacccaggacatcgttttccagatgagcagggtgaagtgctggcaggtcactttccttggaactctgctggatacggatgggccccagagaactctcaaccagaacttagagctcagatttcaatacagtgaggatagttgctggcagtggtttgttatttacaccaaacaggcttttttgctgagtagctgcttgaaaaagatgatctcagaaaagatggtaaagctagctgctgagaatacagaaatgcagattgaagttccggaacaaagcaaaagtaaaaaataccacattcaacaaagccagcagaaagactattctagttttctatcaagaaaaagcaagattaagatagctaaagatgactgcgtttttgggaacataaaggaagaagatctctgaagaaagctctcatattttaaaatatccttggaggctatctcaagacagtgaaagaacttggggattcaggtgggctacctaccatcagtggaggaaatttgacctcttcccatttttttggcattaacatggactgtattcatcaaggtattataccacagcactctatggaaatctcaagattagaaaaaaaaaaagaaccaagttatagagttagtttttattttatttttgcacttcgtcatgacagtatagagtttgtttttaatgtctcataaatgacaagtggcaaattcaaatcaactcatataaaactcattctattttttctctaaaatagatctttatatggcttcatgaagtcttttatgtgttttgaatttacataaatgaaagtctcataaaatatcataaagatattttggatcgatttctaaagatgtgactcttcaacggaggagaatagggctctgagaaatggaatcactgaaaaagaaacctgggttctctgatctatccacacagaactagagcaaggaggtgatgaaatactgatctctttcctcacataagtctgagcctaccaatatggatgtactcaaagtgaaacgctgccctgttctctgcttgaccattgttataattttattctgtccttagagtactgaaggcagttcaataatcaacatgctatttggaatgttttaatttggaaagcaataaggctctgcacctgatatcagataccttataattctcttagctttaaaaatatgtatactttctcacaaggtttttccttatctagcttcatttctctcatggtaattaatgtaattatgtatagaattaagaccacaataagggagatgatcagaggaatctgtatagtgtaattagaaaaagtacaatattctaatgttctaactgggttgtatacctaattatataataaatacaaaataattccgagtgaata

SEQ ID NO: 95693 - DNA, 1989 bp, Homo sapiens
acaattagtgtcagaaaaaatcagggatatgggctttagggatgcttggaaatactgaaaactggaatacatttgacatcgccaccaagaaagcttatctggacatatttctgcccaatgaacagagtattagaatcgaaattataacatcagacactgctgaaagagtcctagaggtggtgtcacacaaaattggactgtgtcgagagctcttgggctacttcggcctctttctcattcggtttggcaaggagggcaagctctctgttgtgaaaaaattggctgactttgaactcccttatgttagtcttggaagttctgaggtggaaaactgtaaggttggactccgaaagtggtatatggctccatccctcgactccgtgctgatggactgcagggtggcggtagatttgctctacatgcaggcaatacaggacattgaaaaaggatgggccaaacccacacaggcacagaggcagaaattagaagctttccagaaagaagacagtcaaacaaagtttttggagctggcccgggaggtacggcactatggatacctgcagctggatccttgtacctgtgactacccagaatcaggctctggagctgttctttctgttggcaataatgagatcagctgctgcatcaccctgcctgacagccagacccaggacatcgttttccagatgagcagggtgaagtgctggcaggtcactttccttggaactctgctggatacggatgggccccagagaactctcaaccagaacttagagctcagatttcaatacagtgaggatagttgctggcagtggtttgttatttacaccaaacaggcttttttgctgagtagctgcttgaaaaagatgatctcagaaaagatggtaaagctagctgctgagaatacagaaatgcagaaagactattctagttttctatcaagaaaaagcaagattaagatagctaaagatgactgcgtttttgggaacataaaggaagaagatctctgaagaaagctctcatattttaaaatatccttggaggctatctcaagacagtgaaagaacttggggattcaggtgggctacctaccatcagtggaggaaatttgacctcttcccatttttttggcattaacatggactgtattcatcaaggtattataccacagcactctatggaaatctcaagattagaaaaaaaaaaagaaccaagttatagagttagtttttattttatttttgcacttcgtcatgacagtatagagtttgtttttaatgtctcataaatgacaagtggcaaattcaaatcaactcatataaaactcattctattttttctctaaaatagatctttatatggcttcatgaagtcttttatgtgttttgaatttacataaatgaaagtctcataaaatatcataaagatattttggatcgatttctaaagatgtgactcttcaacggaggagaatagggctctgagaaatggaatcactgaaaaagaaacctgggttctctgatctatccacacagaactagagcaaggaggtgatgaaatactgatctctttcctcacataagtctgagcctaccaatatggatgtactcaaagtgaaacgctgccctgttctctgcttgaccattgttataattttattctgtccttagagtactgaaggcagttcaataatcaacatgctatttggaatgttttaatttggaaagcaataaggctctgcacctgatatcagataccttataattctcttagctttaaaaatatgtatactttctcacaaggtttttccttatctagcttcatttctctcatggtaattaatgtaattatgtatagaattaagaccacaataagggagatgatcagaggaatctgtatagtgtaattagaaaaagtacaatattctaatgttctaactgggttgtatacctaattatataataaatacaaaataattccgagtgaata

SEQ ID NO: 95694 - DNA, 1125 bp, Homo sapiens
acaattagtgtcagaaaaaatcagggatatgggctttagggatgcttggaaatactgaaaactggaatacatttgacatcgccaccaagaaagcttatctggacatatttctgcccaatgaacagagtattagaatcgaaattataacatcagacactgctgaaagagtcctagaggtggtgtcacacaaaattggactgtgtcgagagctcttgggctacttcggcctctttctcattcggtttggcaaggagggcaagctctctgttgtgaaaaaattggctgactttgaactcccttatgttagtcttggaagttctgaggtggaaaactgtaaggttggactccgaaagtggtatatggctccatccctcgactccgtgctgatggactgcagggtggcggtagatttgctctacatgcaggcaatacaggacattgaaaaaggatgggccaaacccacacaggcacagaggcagaaattagaagctttccagaaagaagacagtcaaacaaagtttttggagctggcccgggaggtacggcactatggatacctgcagctggatccttgtacctgtgactacccagaatcaggctctggagctgttctttctgttggcaataatgagatcagctgctgcatcaccctgcctgacagccagacccaggacatcgttttccagatgagcagggtgaagtgctggcaggtcactttccttggaactctgctggatacggatgggccccagagaactctcaaccagaacttagagctcagatttcaatacagtgaggatagttgctggcagtggtttgttatttacaccaaacaggcttttttgctgagtagctgcttgaaaaagatgatctcagaaaagatggtaaagctagctgctgagaatacagaaatgaactgaacgtaccttttccagggaaaataaattcactgcctcttggtgactgaacaattcaagatgtgctagagagcagtaaatcaaagcaataaaagaatcaaggaaactctttttaaaagagtaatataataaaatccaacctctcaggcaggatggaccctcttaggctgagattattgtatgtattaaaaagaagaaagagaaaagt

SEQ ID NO: 95695 - DNA, 298 bp, Homo sapiens
tttggtaccacataatgaagttaatctttttctccaaaacagtaaacttttagtaaggagataggttttattttattttctaatcatttaatcttacactagaatcgatagctaaagcttttttccccaataaattaacagtttacagtagtaccttagatatagattgggaggtatgctggtgttattaaaaaatcagatgaactctataaacacccatttggaaaaatagctattttgacatctttcttttctttactttttggctttctcagttttgaagctacccaatgtattt

SEQ ID NO: 95696 - DNA, 658 bp, Homo sapiens
ctaggcggaaggatcccttgagcccaggagtttgagaccagcctgggcaacatagtgagaccttgcctctacaaataataaacagattagccaagcaaggtggcacgtgtctgtggtttcagctactcaggaggctaagtgcgaggattgcttgagctcagtcagacggttgagacggcagtgagctctgataatgccactgaactctagcctgggcgacagagcctgcccctgtttcgggaaaaaaaaataattcattattagaatgtgtggtcttttcatagagccacagattttgaagcacagatcctaatgttttgtgcccttccccttcttattcaaccccctttcttgaaattacagttatgtctgacaactgagtgacagtgtgaccttttatcccgtatcatcgagccttcaattagtgtctccttttgacagatgtctcatttactgcttcattttcaagcttttctcattattctaattgctaattagggtaataataaatatcttgccccaggttacatgtcaagatgttgctttattggggatatcattcacttctttaactttgatttagcttgtttgcctccatgtttctcggattccagaagattatacaccaccaaaaacttaaacctaactaaaaaattat

SEQ ID NO: 95697 - DNA, 772 bp, Homo sapiens
gcaacctaagtgtctaacagcagatgaatggataaataaaatatggtacataaacacaatggagtactattcagccataaaaaagaatgagatcctgtcatttgcaacattgtagatggaactagagatcattaagtgaaataagccaggcacagcaagacagacatcatgttctgacgtatttgttggagctaaagatgaaaacaactgaacttatagagggtagaaggatgtttaccagaggcgggaaaggcagtgagggcatggtgagggggaagtggggaatgttaacgggcacaaaatgtagaatgactaagacctagtatttgatagcacaaggttactacagtcaataataattgtgcattttaaaggtataattgaattgtaacacaaaggataaatgcttgaggttatggataccccatttaccctgatgtgattattagacattgcatgcctatatcaaaatatatcatgtaccccatagatatatacacctagtatgtacccacaaaaattaaaaataaagtaaaatttcaatgattaggaagaccattgttaatatcagtttcctttaaatgtttctataaatttaatacaatttcaataaagctcccaatatttattcttagtactggaaaaagttttccaaaatgtgtatggcagaaatagggccaaaataggcaagaaaactattttcgagatgtcagttttcctcaaattgttctattaattaaacgccacctgaattaaaatttgacaagtgaat

SEQ ID NO: 95698 - DNA, 314 bp, Homo sapiens
accaagcagccagaaggatcttccaaaaatccaaatgtgaccgaccatatcctttaaaacccttcagtggcttcagttaccctcaaagccccacacctcacagggtcctcaagaccctgtgacctctgccaactgcctacgtctccaacgtcggcttcttgtgaaaggtcagaatcaaaacgtagtcaccagtattaaacaaaacaaccctgacaccaagagcgaaactccgtctcaaaaaaacccccaaaaaaccctgacacagagtcagggaaggctatgcagtgaatgcttgcatgcctgataacaaaaac

SEQ ID NO: 95699 - DNA, 632 bp, Homo sapiens
aaccagtgacaagctgggggaaatgacactgtccagtagttggaggtcacacagccccttgccttattctcaaaccctaaccacatggctggatattcctgaaatgcattcctaaacctctgctgctgagaataattggacctgccatctattcccagtttaactgccctgtataccaaacaaatccaattcaagccaacaggcaaagtataggctcagacagagcccatcctatgtgcaaggcggtgagcaggggtggaaaatctcactgtgactcatccagctgatttctggagcacactaggtgatgcccctcacttggcacccgtgttggcgctggcatcatggacaatagaaacacccagatgtacacggagggtagaaccaaggctccagggacgcagccaagtcctggcctgaggatcaccataaagagggctggtgttgagcccatcataccaggagtcagcaaggtcatgtttccggatgcttcggaagtgggcagcaagaagcacctctcatcagcttcacgagggccagagaaggggcccagactcagagatgcatttgagaaggggccttcagagctcagaatccaggagcaggggcctccagcaagaccagggtgagct

SEQ ID NO: 95700 - DNA, 363 bp, Homo sapiens
ggaggctaccagtgtctggaggaggaatggagacttagtgcttcagggggacagagtttctggttaagatgatgcaagaggtctagaaatggatggtggtgatggctgggcaacattgtgaacgtacttaatggcactgaattgtacacttaaaatggtccaaacaatagattttatgctatacatatttactataattaaaaaaaacctagtgataccactaagtcactaaactgattccagtcaccagactgtgtttaggtcgaagtgtcccacctcccctaactggactgagtttaaggtctgagaccttttctttttctgagacagagtcttattctgtcgcccaggctggagtacaat

SEQ ID NO: 95701 - DNA, 699 bp, Homo sapiens
cttgcttgtgtctgaactctagtgcacttatgattttgtagaccatgtgaaatttaataagataccttttttttcctttctttgtgtgtagtgcagcaacagtttggtctgcatttgttagaagtttaactcctaacaacccaaagacctatttaacaattggtgcataaatgaaagtagtactgtatacttgaaactgtttaagtacaagttgaacaaaaattatgaaaaggtatatttgcttctcgggaaagcaaagaagctgctttaaaaaataaaaaggggactaaaaatttgttttgtataaagaggttagccctgcgcacgtaggactgaattcagtgatatccctatacactgccatttagtggataggttattgtacttccattcatactctgggcacttgtgttgtattgttctgttacatactttttttaacctgttttgttttatcatatatgcattaaaagtattatctttatcaacatttgctgctactgtgttaacatttttgttttgcttgccatgaatttcaacttccaccacccagtgaattgatttataaattgctatgctttgctgtttttctgttgctgtggaacttaaagaatgtgaaagctgtcaaagggtattttacgaatcacttttgtgtttgatatagtaaaacaatgtgattcattccaaagtaacagaagg

SEQ ID NO: 95702 - DNA, 356 bp, Homo sapiens
tagagatggggtcttgctttgttgcctaggtcggtctcaaactcctggcctcaagcaatcctcttgccttggcctcctaaaatgctggaactacaggtgtgagcccctgcacacagcttgaaacatttattgttgaactgagtacacaggaacccatcaacacatttttcaattactgaataaaccaaaaaaaaattgtagggctcctccactctccacttcaagctcattctatcatgggagagtatatccaaaattaaatgtcaaggatcctccaaccccccaatcaacaactgctacaaggagaaaccactgtcaattacattttaaacaggctgctgtggacacattcataa

SEQ ID NO: 95703 - DNA, 748 bp, Homo sapiens
ccacaatgagataccatatcataccagtcagagtggctaatattaaaaagttaaaaaataacagatgctgacaaggttatggagaaaagggaacacatatactgctggtaatggcagtgatgggccatctggagcagccactgccatcacaccagctgctacaaggaagcttggccagggctgctgcatgcttcatggagccagcaggagtcagggacaagtgggaaccccacccctactcagtagaggcaggagcttaccaggtgccactgcagccacccaagccatggctgcaaactggacatccctgtgctctttgttccaagagcaggcaggagccccaccctccagggcaaagctgcagctgctcgaatcatggctatggacccaggcatctctgtactctcaggggcccagaaacgccgccccccattccccgaccttcgcaggcttggaaatgcctgctcccgctgcttggcttctccctgctatttgtgcccgctctaatcctgtagcaaagttgggacaaagcctgggtactctcacagcccagctgggtgttcacacactcgaggcagtgctgaaacaccagtcccttgccgcctaagaccctccaaactttgggcactgataagcataggagggaagctgagcaggggctgagagcagctctgcactggcctgcagatacctctcgacacctatagcctgggcaccatgaacagcagcaggaagcagacaggttcct

SEQ ID NO: 95704 - DNA, 216 bp, Homo sapiens
tggaagtaaatccatcaggatgttaaatctcagggtaattggaaatgttgagtgcttgaatgctatttctcaagctagtcatgttagtggatcaagcatacccttgcagtctagtcggccctggtctactctgtgaagcccatctagagagaatgctagagaaaactcaccccaacacaggaacaagctaccaatgtctgggctcctaattgtgtg

SEQ ID NO: 95705 - DNA, 231 bp, Homo sapiens
gatgggtcatgaatgctttttccacaatactggtatcaacaaaaaggataagactgggaactgtggctctgaagaaggttttctctgcctcaaatcctcccaagtcacctttaaaaagcaaagtctactaccagtctttttttttttgagatggactcttactctgtcacccaggctggaatgcagcggcatgatcttggctcactgcaacctccgcctcccaggttcaag

SEQ ID NO: 95706 - DNA, 226 bp, Homo sapiens
agtcctctctttggaaatggagcaccccattttatttttccttttgatttaaacatgtggaaaattcccattagtaccaagagatggcaatgcggacagagcaggctgaatcctcctgttaagatatgatgacctgtgtttaattctgcagttaatatgatggccatgtgttcatttcaccaatttactatatggatactttcctactcaagactactctcatacc

SEQ ID NO: 95707 - DNA, 468 bp, Homo sapiens
tctactcccacccagccagaagtggagaaatacagaggcacccacttcatctacctctcctaagttcaagagttctgctaagatttttcctattttgtcgactcactagttctgtttcagaggtgagaggatggcaaaaaaaattctctgtttctctccttgggttctgcctttggcagtttttagcttgaggttgtatctctttccttatttcagtgtgatagtatattttttgctggattttaatgtttttgcttatttccccctgtctaagtgagggagacccccactaggggcacatggcatcctcagaagaacaaaggctctacaacctgacaggccagccatgggaccctgggttcttctgagagtcactttatcctctagtcatgagaacagtcatgattactctgcagattagagatgctgtatgcaaatgttggtgcctgagggtggggataccagggg

SEQ ID NO: 95708 - DNA, 663 bp, Homo sapiens
aggtaagacctattcacccaggaagtggtcagactagaaattgtacccaggcctatctggctgctcagcatctgctctttccactctaccagaatattcattatttaacacaagcttctctccttttttgccaaatagatgatctgttacagactgtacagagcacatctggattagctattattctttttattaagactatgtttcacccgtctgaaaagattcctcatttggtaagtgcatctcctttttagaattgtactttattgagagttagggtatgtttaaaaaataattttggcttggtgcagtggctcacacttataatcccaacactttgggaggccagggcaggagggtcacttgaggccaggagtttgagattagcctggggagtttagctagaccttgtctctacaaaaaaaaaaaaagaaaatttgctgggtatggtggtgcacagctgtagtcccagctctttgagaggttgaggtaggaggatcgcttgagcctaggagtttaaggctgcagtgagataagattgcaccagtctgggcaacagagtgagaccttgtctcttaaaaaaaaaaaaaattaaaaatatttttaaagaagtgaattaaaataatttttttttgcattgtctggttccttctgatgaccttt

SEQ ID NO: 95709 - DNA, 426 bp, Homo sapiens
tgcatatttaaaaggagaatcgattgcctggcctattgtaaaggccttgtaaactttaaaaagcaaattaaaaaacaaaatcaatgatgacgttaagctcttggggatccccataacgtcctggtgattagagtggctaggcgactaggctttggaattcatgggacagtgcacttttaaatttggcagttctaaaatgaaaataaagaattgtcctttgactctaataaagttagcttaatggaaaactcactgcattgtcctcgtttttctcactgtgtcacagaccaagaaaagcgtcatccaagctcatgacaggtgttccctgaatttctgagctgctgagtgccactgaggagctcagaaagcatgatctgaatcgtgagcttacatgcgacacggccacatctcagcttcaatgccatg

SEQ ID NO: 95710 - DNA, 573 bp, Homo sapiens
gcctggagcaggccttgtgcttttcccaacactgtgcgtgttgactcagggttactgtcaatggctaattctagtgtgtcttttgttgaagtctgcagaaaagcctcaaccagcaccagcttttgaaggacttacaaaacttgtgttcttctgattctgggatttttgcctgaaatgcctcgtatatttttggctaggtgttgttagcacttgtgttacggcatttggagctctgtatttttgtgatgtgctagctgtgaggatgtttaaaattagattcctagaaatcaggttataggagctctcggccacgcttcatgggttatgttttgacacctcatagtggatcccgttgcggtggctattcttagtatttgtggaacacctgactcttgatgctaggagaatgttatttgttttctttgtaagcctaaagtctaatgaccttgtagagtctttatacccatctcttataaatcagctttaatatgcttgaaaaagtcctcattgtgcccttgaaaagcaggtgcacattttaaaagtcatccttttaaaatccttttctccagtctg

SEQ ID NO: 95711 - DNA, 445 bp, Homo sapiens
aaaatacatcattccatcccaacagccccaaaggtcttaactcattctaacatcaactctaaagtccaaagtctcatctaaatatcctctacagcaggtaaatgagactccaagtacaattcatcccaacgcaaaatttctcttcgaatgtgagcctgtggaattagataagtcatgtggttccaaaacacaactgtgggaaaggcatagaatagatattctcattccagaaggagaaatcagaatgaaggagagtgatgagtcccaagcaagttcaaaatctcagcaagtcaaattccattagctcttaaggctcaagaataaccctctttggctcaatgctctgccctccaggtccactggggtgccagcatcactaccgtggctgtgtggggtggccctgtcccttaggctacccacggcaccagcccttctcctggttttg

SEQ ID NO: 95712 - DNA, 313 bp, Homo sapiens
ttgcgtaagctcctcttgaactcctggcctcaagagatcctcccgcctcagtctcccaaagcactgggatgtcaggtgctagccactgatcctggcatgagcagaacttaacaactagatctaatttgactccactcctcactagctgtgttgccctgggaaagtcactgagtcactgatctcagtttccctatctgtcagagggggccaatattcatttctcccattcatgggtgactgtgaggactaagtttggatgataggactaatacctcccatatctaaggggtattcagtaatatattaagaataa

SEQ ID NO: 95713 - DNA, 433 bp, Homo sapiens
attagcttcttcctcttgatgttgtacttattatcaccatgtcatgtgtctttaggtcacagcttcttccccttgatgttgtactatcaccatgtcatgtgacttgaggtctgcttaggtgcctctccaggggcttaacttatttctggtagtgttgagttgtggggtgggaggagagggttaaactcagaaaaggcactgctaatgttgagtgtatccttgagatgaactgaaggcttgcagcctgctgggcttgtgggaaaccctttctgggtggagttaggataggtgaattggggctgtttattctggacaaatatctgaggtatctaatttgaaaaataaaagttagacttgtctgagtaagaaaatggttggtaattctgtgaactctgtacattgagtcagatggacaggtaccttatcaaggacc

SEQ ID NO: 95714 - DNA, 582 bp, Homo sapiens
aaataattgccccaacttttgttttatgaactcaaattattcattatattcttagagatgaaagagtaaagggagttgatttactgggacaatccaaaagaaatacaagcttaattatttgatgaccatttctcacctcacttgctcattgtgaaggaaggtgtttcttacattgttgatgcaggctcccttttacttcccttttgtaatcctcaaataaagagctatcttttcttttacagtatggcagttctcaaaagcatggtccacgcacccctggttggtctctgagattccttaagggagtacatgaggcctatattattttcacaaaaatagtttgcttttctcatgtgtagtagtggacataactactggcaccttaatacatatcaagacagtggcaccaaaatacattaggtaatcatttaccaatgtgagcattagtaaaaagtgtgcagcagtaaagtgtgcatcctcactcctgcacactttgttaagaaaaaagccaattttgcctaagaatgtttttgataaacaggtaaaaattaacgttatttaacctcagctcttcagtgcaag

SEQ ID NO: 95715 - DNA, 420 bp, Homo sapiens
gtaaaatataaaaataaactagacttgaaattgtatactggagttagccataatctctacaatttattctaactattcaaaacctaattacatgcttaatgctactactgttttatggctccttagtgctgtggttacaaacaaaaacaggacttactaatatttatggctagagcattatatttctttttttttcttaactggaaatgaccgtttcaatcaatcatcacaagtcatttgaaaaagcaatgtactaaggatataacctttggttatctcaaagagtttactcaaagttagactcagcatcttcctacccttctctcccatatgtcttagcactccctaacccaagcccagcacaagaggatgtaagaaaaaccaaggtgctaaaatcaagggctgaccatacaggtacta

SEQ ID NO: 95716 - DNA, 650 bp, Homo sapiens
agcaccagcatctggcttgggtcgccttctacgctgtggaagctttgttcttttgctcttcatgataaatcttgctgctgctcgctgtttgggtctgcactacctttatgagctgtaacatgcaccacaagggtctacagcttcattcctgaagtcagcgagaccatgaacccatcagaaggaagaaactccagacacatctgaacattggaaggaagaaactccggacacaccatctttaagagctgtaacactcactgcgaaggtctgtggcttcattcttgaaatcagcaagaccaagaacccacgagaaggaataaattctggacacatttggcaacccagatgggacacattttggcgaccacaaagggacacattttggcaccccacatgggacagtcacctatcgccaagctgatcgaggccatcaagctacagatggtcttacaaagggaccccaaatgagctcaactaacaacttctaccaagaacccctggactgagccactgaccctttcactggcctaaagagttcccttctggaggacactacaactgcagggccccttcttcacccctatccagcaggaagtagctagagaggtcatcgcccaatacccaacagccgttggggtgtcctgtttaga

SEQ ID NO: 95717 - DNA, 291 bp, Homo sapiens
tcccaactctccaactcagactctcgctctgacccccaagtcaaatatggcaggtagcactgccttctttaggggtcttccagattatgctaccaccaccaccaccaccaccactccacttttcagaaacatgtgggtttccacttgtcaaaaataaaacaaccctcttgatcattatagacttggggtcttggctagagaacaaatgaaaacagaattaagaacaaagaggcggggcatggtggctcaagcctgtaatcccagcacttttggaggctgaagcaggtggat

SEQ ID NO: 95718 - DNA, 453 bp, Homo sapiens
gtgggggctgtgacacccacacacggcaggggcaggggaagagaggagatgaaatcagcctggatggccctcactctgggcctcctcttgcactattcatttcttgggcttctgattatctgctgactgggacaaaaaaagaagccaaatcctagggcatgaattctagtccattccaattttatttttgcatttctgaaatacacggattcttccaaccagaatattaatattcaaaatagcaataataaaagtattagcaacaaaacagctactttattcagtgcttacaaccacccttgagaagtcatatccccactttacagatgagaaaactgagactcagcttgcctgaagatacctagctaataaatggaaaaacaattgtgtctgacatccaagtgtatactttgactaccatgtctcttagaaagcacttaatcctggttgggt

SEQ ID NO: 95719 - DNA, 813 bp, Homo sapiens
agcgggtttcaccatgttcgttaggatgtcttggtctcttaacctcatgatccacccgcttggcctgccaaagtgctgggattacaagtgtgagccaccatgcctggcctacactattttttaattaatacatataagatgtagatatttttggggtacatgtcataatttgatacattcatatgatcaaatcatggtaattgggttagccatcaccttaaatatttatctttataccaggaacatttgaattattgtcttctagctattttgaaatgtgccatcaattatttttaactgtagctaccctactgtgacctatactatttctaaatatctttgtatttgattctaaagactcttaatcttgatgggaattgatttttttgttttttcatgttcttaggatcacaacttttacagatttttaaaatattggccgggcgcagtggcccacacctgtaatcccagcactttgggaggctgaggcaggagatcaagaccatcctggctaacacgatgaaatcccgtctctactgaaaatacacaaaattagccaggcgtggtgacacacacctgtagtcccagctacttgggaggctgaggcaggaggatcacctaaacccgggaggtggagattgcagtaagccgagatcgcgccactgcactccagcctgggcgacagagtaagactccgtctcaaaaaaaaagaaatttctgtattaagccttacaaaagatatccatattctaatccttggaatctgcgaatgttattttatatggcaaaagaagggtggaatctgtgtgtgtg

SEQ ID NO: 95720 - DNA, 574 bp, Homo sapiens
agcaatggggatagtgtaagcataaataataggtaagaagtggatcaatgcaatggaaagaaaggattaatagtgttttggcaggttagaaggagagaagaggagaggattttttttttttttttttactttggttggtcgtgtgggctggaagaacagagcagatcgttaaatactttggaaaagaagtaacatttgtgtggaccttgaaaggggtagaggctcaggtttacacagataattacaaggtagaaggctctctgttctctccataaatgagagataccatcatatatttaaagctatagaattggatgagatcatctatacttggtgagtatagctaaagaggtaaaaggattgagcctggagctttcccaacatttagtggttagaatgaaaaggaggagctggcagaggagactgacagggataagctggtgagacagaaggaaactagcagaatgtgacatccctagagccaagtgaagagttacaagaagaaaggagtgatcagtttagtcaaatgcttagtggtaatggagtaaagtgctttctagaaggtaatctgagc

SEQ ID NO: 95721 - DNA, 314 bp, Homo sapiens
ccactctggccctcagtttctgtctggaaagaggtagccagtcacactaaagggggacttctttttgggtaggctattagagaggctgattcgatcattgattttttttttttaaacaaagcttatgtttttcctccgagtataaaagtaaaacatgacggttatgtaattttgaaaaacagaaaaataaatttaggcctggcacggtggcttactcctgtaatctcagcactttgggaggccgaggtgggcagatcacttgaggccaggagttcaagaccagcctggccaacatagagaaaccttgtctctat

SEQ ID NO: 95722 - DNA, 311 bp, Homo sapiens
agtagcaccctaccaccaccatttcccttgttggagtggagtgagaggaagccaactaaacagtggtttaaataagacccagagtctcataacatagtatctaaaatacccatgtttcaatagaaaatcattcatcatacctagaaccaggaagatcttaaattgaatgaaaaaaagataataggtgccaacagtgaaatgacagtggtgtttgaattatcttacaaagattttaatgcagcaatcattaaaatgcctcaacaaacaaggaacatgcttgaaacagaagagtcttagcaaacaaacaatct

SEQ ID NO: 95723 - DNA, 451 bp, Homo sapiens
ctgatgagtagacaagataacagtgttaatatagatgtttctttgatgaatcccttatagttcagagaaaaagcatttaggaatataataaatcctattttgagctgttcggtcaattatttaaaaaccaggtgatatttaactcctcaaagtaaattaagtttcttttgggttaccttctgtattagtttgtttttatgctgctgataaagacatacccgaaactgggaacaaaaagaggtttgcttggacttacagttccacgtggctagggaagcctcagaatcatggtgggaggcaaaaggcacctcttacatggcggcagcaagagaaaaaatgaggaagaagcaaaagtggaaacctctgataaacccatcagatctcgtgagacttattcactatcatgagaatagcatgggaaagaccggcctccatgtttcagttatctccc

SEQ ID NO: 95724 - DNA, 460 bp, Homo sapiens
tgacagagtcctgctgttttgcccaggctggagtgcagtggtgcgattttggctcactgtaacctccgcctctttggttcaagcgattctcctgcctcagcctcccaagtagctgggattacaaggtgtgagccaccgcgccagccttaagaggcatctttaaggtgtcaaactcttaacatcatttatgaaaagccctgcctgtgaagcaggcctgaacactaatttgtatgttcttcatgaggaggtctccagcaaaagagaggtatgtactaataatttctgagaaatgtatgcagatcaggagactgcagtctttcactaacaaaagaagtttaacaacttttttgtgagaatatacattgtgatagtggaaataagcgtttacactgtttgtataaccactttgcattctctgaagaaggattggtatttgggagtgtgttgtgtattggggcaa

SEQ ID NO: 95725 - DNA, 405 bp, Homo sapiens
cagaagttttcatgggccgatctgctgagttcagcctaggagctgaggccaacatctgagtctcctcagcactcaagtttgagagaagtcctagtgacttcaagctcggaactaacgcggcagcggctccctctcgacgttgaagcctccctccctttccagggagagacgaggcacggaccgacaaagcccacgaacaccgatgagcgagctgccggccaccccagcttctacaatccgaccttctccttctgcctctaccgacaaaatggacagaaatttactttttaaaagacactttcaagagaatgagaagataatcatcaagtgggagaaaatatctgtaaatcttctatctaagaaaacacttgatccaggatgtaatgaagcactctgaaaactcag

SEQ ID NO: 95726 - DNA, 650 bp, Homo sapiens
cgggtgccccagcctctctccctgccttctcctccccaggctgtgaccactctcagctgacacctccgctgctctggcaacccaagaacagcctggagaaaggtcagctggccgccttccccagggcctgcctggatccttggaccccagtgttgcgtggtgtgggagcgccctctgttggctgtatgggccatgaacaccactggaaacagacttcctctttcccttgctgctcacccctgagacttccagccttcttaataagggactttaggagaggaatgggtagggtcgcctataatttgccgttgaaagcgagatgttttggagaatgaaagagggtgtgaataagtgcactgagatactgagtattcggcagatgcgtcttaagcagatggtgaggaaggcttccctgaccgcctacttgggtctcagccccatgggcataagccaacaaaatgtgtgctagccctcactggtgaaagggtcagctattcccaatttatgtttgaggaagtcagaatctcaaatctatgcttacccaatgacttcacgctttcccttgggaataatttcccaagaccccaatttcccctttgcagcagggacccaaggtggagacccaagggttccagttccagaaagaggga

SEQ ID NO: 95727 - DNA, 354 bp, Homo sapiens
acacactgttaatattacacaaagttacttaccaggcttaaaaacatagtgtgcttttacctgtcaccaggatttccagactgttgccagaaatactttagaggagagttttaaaagccctgggagaaccagattgttgctgaacaatttcaaagttaaaaatacaacccaggggtcgagaccttcccgaaccacatggacagccatgttctccatgctggacaccctttcaattatgtcctcccctaggtggtgtctccttcccttccacctctaacttccatcctcccttcctgatcccactacatatgtacttgttggcaagcaaatcagttccactgtcaaggaaaaagg

SEQ ID NO: 95728 - DNA, 135 bp, Homo sapiens
aactgctcctgctgaatgagaaagagaagagtcccggatgtgtgtgtggttacaacagaaaacactcttcctgccaggccgaactcccccggagatgccctcggcggcagacccagggccattgccactttttca

SEQ ID NO: 95729 - DNA, 243 bp, Homo sapiens
tgttgggattacaggcgtgagccatcgtgcccagccactcaggaggatttttctgtagaaatttttgtccaagtttctttttttgttttagctaaatctaagatctttcattaatgcctcattactcaaagatgttacataagatcgggcaaaaatctgtttgtaagctaatgttgattgattgattgattgagacgaaatcttgctctgtcgcccaggttggaatgcagtggcacgatgtca

SEQ ID NO: 95730 - DNA, 396 bp, Homo sapiens
atgggggtttccacccactttggaaaaatgtctggcagtttcttattgaagtcaacatgcacttatcctgtaatccagcaattctactcatttactaagagaaatttgtcaaaattagtcacaaaaaagcttgtataagcatgtttatagctattttagtcgtaaccaccaaaaattagaaacagcccatgtgtttatctgtagaagaatggacaaaatggaatttatccacaaaatgaactattatttagtgactaaaaggaacgaactaccaatttaagcaataacaggaatttaacaatattatgctgagtaaaagaagcattacacaaaaaaagtgcaagatatgatttcattcacaagaatctctggaaataatctgtggtagaaaaaaaa

SEQ ID NO: 95731 - DNA, 501 bp, Homo sapiens
gaggcatgtgggctagactgcctgctccctcagctcactctggcactctggccctgcatggacgccgtcctggccatgccattgccaccttctgatggatgctgctgggctgcctgacttcatgcctggggaggcctgacagagctcagctcacactgggaagtgtggatgcagggccatttgggggtcccatggacaagtgttctattctctgctgcaggtggtgcagacttgctctgggatcctggggcctgcgtggccatccttgcacctttcaaatgcttgcatcattgtcccttgcacagactcccttctgctgagacattttgtcaggtcatgagggaaagcttagcagtgaagccaccaccttgtgccagggaccgtcagtgccccacctcctaaccagaacagcaccctcttcacctgcagacagtgggtgggccaatcccaaatgtccatctgatcaccagttttctcaagctgcttctggcccatttgtgt

SEQ ID NO: 95732 - DNA, 368 bp, Homo sapiens
acggggcattcctttttgaacagtacccattcccttgatgtctacgatatcacctttcttatagattcacatatacatggccaaaggaacaactccatgttttctaaaaggcctagagaacatatatcgggtgcctctcctctttccctttgtgttcgtcattttggcgaattactagaagatggcagttccggctgaaaggaaaagatatgtccttatttttgtaccagtaccatgctgttttggtgactatggccttatagtataggttgaaatcaggtagtgtgatgcctccagctttttctttttgcttagtcttgcttcagttatgtgggctcttttctggttccatatgaattttggaattt

SEQ ID NO: 95733 - DNA, 412 bp, Homo sapiens
ttgtatttggttttctttggttagataaagtgctgggtataggattgagagtggagtatgaagaccagttaggatggaggatcagattggagttgggttagagatggggtaaaattgtgctccggatgagtttgggattgacactgtggaggtggtttgggatggcatggctttgggatggaaatagatttgttttgatgttggctcagacatccttggggattgaactggggatgaagctgggtttgattttggaggtagaagacgtggaagtagctgtcagatttgacagtggccatgagttttgtttgatggggaatcaaacaatgggggaagacataagggttggcttgttaggttaagttgcgttgggttgatggggtcggggctgtgtataatgcagttggattgg

SEQ ID NO: 95734 - DNA, 510 bp, Homo sapiens
ggtaaagcctgtagactgaagatcccaaagaacttgatctgaatgtcagacactcaagaaataagtttgtaaaagaaggcttacaattttcattacaattaggtgacatgaatgcaattttatacctattcagtactttgattaatgctattttttcccaggttttttgatctagaatctcttcttggctaagcatataggatgccacttcttgctacctccacagcaatacatcacctggacagcttgccactctttgttgccttgaacttctctgatgtttaggcagcccattctggtactgagaacacagtgaatgagctacatcctcctgctttcttcttctattattacttttacctgatttcttctcaggaggaagctgtacattttaacaggacagataggaggaaaagcaactatttttctgccgagataacaattgacaacttggggcagtatgtgcagagttttcctggagttgtattaaaaattatctgataagctgca

SEQ ID NO: 95735 - DNA, 227 bp, Homo sapiens
tgatacagcaaacacgttactgcaaaaacagctacagcagctacctgggtgagatggctgccacctgcagcctcagtgaatctggcttcacaccacatgccttgaatgtggcccctcccaaaagtaacatgtttattgcctcacacttccaatcatgggcctcaagagtttgtgatttatttattttataagctatagatatatataactgataactctggattact

SEQ ID NO: 95736 - DNA, 474 bp, Homo sapiens
aagttcaaggctgcaatgagctatgactgcacgactgcattccagcctgggagatcaaggaagatcctgactctaaaaataaaataaacatgtttatataagccacagttaaaaggggctcaatttgaacaggaaaactgtcaaagcaggaagaacatcaatagaaatgattaacactctctatcaatgcttaccgtaataccaaataaagctgcttaattaagattattttttaaataattattttaaaaatacgacatatttttaaatgttatttggaagcatgggaatttgctaagagaaatgtcaccaaatggggcatggttctatttcctacatttagcaaagccttatgatgcacagtgtattttctctagaattccatctggggttctcactacaaatttccagatgaagtcccctaatcaaatctatagcatcaagttggccaaagcctaagagtgatgcccactt

SEQ ID NO: 95737 - DNA, 514 bp, Homo sapiens
ggagagaccccgtctggcttctgtgtaggaagagccctgtcaccctttgtgaggaaggacctggggggtcaagagtgacagcagggggaggggctgttccctcaacacgtcatcacctgcctccctccaatcagttccacaggccacgaagcagacactaggaaaggaaggtgccaccccgcaccacccccagtctcgccttgagagaataaaggcagcgtgtgatgaaatgccaagttctgaggcaggtggttcccaggatggtcagcgccgcaatggccttctcagcatgttgctgagtcctgcagctggctgtcctgcaggccccaagagctgcagctgctccaggcagcatctccaaccgcagccatgcccaggctagcaaaacttccgacctcctttttattctttaatgaggtataatttacattaataacctgcacttatctaaagtgtacaatttgatgagctcagtcatgtgggaagccataaccacacattccatcgcccccga

SEQ ID NO: 95738 - DNA, 336 bp, Homo sapiens
cactgggacagggagaagagaatcgcaacaaacaagatttcttaaatgcccctgcatttcattaccattagatcataccattgtcctgcaatcatgttgcacaaatatctataaaaatacagttttccctctttctttggtgttttcatttttaaagcctcctgtgtaatataaaatttatactaaataaattcatgtgcttttctcttgttaatgtgtcttctgttatagacatctcagccatgagatttgtgatgggtgagaagatatttcttgtcaactcctttatcacaaacaaaaataattctctcaataagtgtttcttattttacacaa

SEQ ID NO: 95739 - DNA, 370 bp, Homo sapiens
tgatctcgccacccatgatttggttaaccatggtattcttcaagaccacaacctctgtttactttgattacaagtctaagccaagtacaagattttgtaaagaattttggaggaggacaccgatgtcccagcagaaggcggcatgagaccaacgtgggagccagaagagagaggttcctggctggcccaggtctagtcccttagtcacacacgtcaaagttcatcactagggtgttagtgaagaggaaatgggaccaggcgcggtggcttacgcctgtaatctcagcactttgggagatcgaggcgggtggatcacttgaggccatgagttcaagaccagcctggccaatatggcaaaaccctgtctcta

SEQ ID NO: 95740 - DNA, 612 bp, Homo sapiens
taccattatcaagtattacgtgctgtacatatgtatgtgctatactttcatatagtcatatgcatatagcagtgcagtaggtttacaccagcatcaccataaacacgtgagtaatgtgttgtgttatgaaggctgtgataatccttaggtgctaggaatttttcaccaacatagtcttatgggaccactatcatttatgcagtccattgttgactgaaatgtcattatgcagtgcgtgattgtattgatacagcaactagaatggatcccaaaagaattgcaggcacacctaggagatactgcgagttcagttccagacaaccatgaaaaagcgagtcatatacatttttgggtaccctggtgcatttaaaagttaggtttactactgatgttatcatttgaaaaaaaaaagagttttatacaattctgtagtctatttaaagtgtgaagagcattatgtctaaaaaatgcacatatcttaatttttaaatattgctaaaaaattttaatcatctgagccttcagcaggttgtaatctttttgctggtggagagtcttgcttcagtgttggtggctgctgacccatcaagatggtggttgctgaaggttgga

SEQ ID NO: 95741 - DNA, 667 bp, Homo sapiens
agttaatatcttatccttatatttgcactccctatttcattttctgcaagcatagctcctgcttcctgagatcagcacagcaaattaaactactcacacataagcctttgtctcaggccctgctttggggagaatataggctaagacaaatgctttaaggccataaacagaattgagagggtatttcagacttctgccttcagggactgggggttggagtcaaaagtttttctctattgtgctccaaggttaaataaacaatgctgttggtcataaaatgtcatccacattttcttcctgtgaaatagggtcacttgatgataatcagcagtccctttgctcttagaacattttgctttcatccttctcctggttgatattaatggtctttataaaattgatattgatatgatctgatggtatttggtagatgtggttaacatgtacagtcagttgacttttgaataaaagagactgtcttcaataatctgggtgtgcctcatccaatcagtgtaaaggcctaaagaacaaactgaagtcttccttggggaagaaacttactgtggattgctgttccactcctgcctgagtttcagcctgctggttggcctgcagattttaacttggcaagccagcctgaagagaaaaaagcaattctgcaataata

SEQ ID NO: 95742 - DNA, 801 bp, Homo sapiens
cagtaaattagccgagcatggtggctcgcgcctgtagttccagctattcgggatgctgaggcaggagaatcacttaaactttggaggcagaggttgcagtgagctgaggtcgcacattgcattccagcctgggcaacaagagcaaaactccatctcaaaaaaataaaaaaagaaagaaaaagtcagccttaatttagtgatgttattaagaataacaaatgccagtgtgatgatcagtcctggactctcaggtttgcctgttctgactagagttatggtgaaactttagttatcttccagtttttaatacggtccttgctgcaatgactttattctagagaactagcattactaaaacattttagtgcttagtggtttttaatacttatttcacaagaataattaaataagtcttttcctcgttgagtgtgtagtatgatgcaggttaggtatctgtgacacctataagtaaggctgacccatgaacaacactagcttgaactgtgtgggtccatttatatggagacttaaaaaaaataaatacattggaaaattatttggagagttgcaacagtttgaaaaaaattcagatgaactgggtagtctagaaatatgaaaacaattgagaaaaagttacatatgtcatgaatgcataaaatacatgtagatactaataatcagttttatcatttactaccataaaatatacacaaatctattataaaaagttaaaatttgtctaaacttatgcacacacagactgtacatggtgctattcatagttgagagaaatgtaaacaa

SEQ ID NO: 95743 - DNA, 859 bp, Homo sapiens
ctccataatggttgtactgattgacattctcaccaacagtgtaacaggggttccctttttcctcccatatcctcaccaatacttgttatcttgtgtcttattttattttattttttgagacagagtctcgctctgttgccccaggctggcgttgcagtgagctgaggtcgcacattgcattccagcctgggcaacaagagcaaaactccatctcaaaaaaataaaaaaagaaagaaaaagtcagccttaatttagtgatgttattaagaataacaaatgccagtgtgatgatcagtcctggactctcaggtttgcctgttctgactagagttatggtgaaactttagttatcttccagtttttaatacggtccttgctgcaatgactttattctagagaactagcattactaaaacattttagtgcttagtggtttttaatacttatttcacaagaataattaaataagtcttttcctcgttgagtgtgtagtatgatgcaggttaggtatctgtgacacctataagtaaggctgacccatgaacaacactagcttgaactgtgtgggtccatttatatggagacttaaaaaaaataaatacattggaaaattatttggagagttgcaacagtttgaaaaaaattcagatgaactgggtagtctagaaatatgaaaacaattgagaaaaagttacatatgtcatgaatgcataaaatacatgtagatactaataatcagttttatcatttactaccataaaatatacacaaatctattataaaaagttaaaatttgtctaaacttatgcacacacagactgtacatggtgctattcatagttgagagaaatgtaaacaa

SEQ ID NO: 95744 - DNA, 127 bp, Homo sapiens
atattcacagaactggaagatttcagaattttgagacccttctttgaatgaagggtcattagatgtaataatactttttgtactaacctattatttaagaagttggattatagtcaagtttgactgt

SEQ ID NO: 95745 - DNA, 434 bp, Homo sapiens
acctgcctcagcctcccaaagtgctgggattacaggcatgagccaccatgcccagccaatcatgttctgagttcttaaagccagaaacttatctttgcatttctgatgatagcaaaaattaattctatgaaaagtttgtgtgtgtatatgtgtaaatatgtatgtggatagctaagtatacattcagctcttactatgtccaaagcatatgaatgagaggctaaggactgcttactatggggaagaatgattcttactttacatttggccaagatcacagatcttataacaaaaggattaaatgttttagtattgatcctgatgaacacctgacttttaaagaagggttataagagcttataaaccaaggttaaggaaaaaaaaaagtggaacacggtggtaaaatattaatctttttgcagtagatatatatt

SEQ ID NO: 95746 - DNA, 274 bp, Homo sapiens
ccactttgagccacttagaaaattccaggtagaaataccgaacatgaacctcccacgcttcccccatcattctcccttcaaactggccgatgaggcatcagaagagtgagctgctattctgttgtggctgggaccttctcatgttttcatgaaacaagcccaggtaccaacttagagttcctaatcagaaggacaaaaccgaaaaagcaggtctcaggtctcattctgccttgcctttcttttatttatttttttttttgagacagagttttgc

SEQ ID NO: 95747 - DNA, 620 bp, Homo sapiens
ctaaagccacatacatggagacgacctgtcttcaactctcatatcccaggaacagcagctctcttgttatcctgtccctgtttcgctggtttctgcagacatccggtgatgcctcttctcccctgcacatggaggtaggctccatgcaacacactgcgtgcacacacgtgcccacctgtgcacacacccacatcctcactcagccgcctgccctcaagcacccaccatccctccctccacaatcctgcctggctcaggcccaggctaggggtgaaggggcatacggaggcaagcaggaaaggggccttggcctgaattccaaagtctgaaatagcccaccacaaattatctttgttctgacaggctgattagcataattatcccatcagaggaaaaaaaagcagaagagagaggacgaggacagtggtagaaagagagacagccaggggcagagacaaagaaagcagcaggcactgagaggggtggctctcaggaggccacagcccacgagcaagcacagatgcccaccgggccccaggcacagccctgggggagccccttccctccgacaggccaggcttgctgtgggcttcagggcctatctgtgagacgggagggct

SEQ ID NO: 95748 - DNA, 338 bp, Homo sapiens
caaatgacccacaagaggtgggccattaattattgggtcagatgcataaatgcacagtaatttatttaagcacctcttaatggtgacccacaaggaagattgctcgtagtagcggaaaggttcacaataaataagagaaaaaagcagaatgtagaactgtatgatagcaattctgcaaacaagaagcatcttttataaaagatggaaggagcccaggcacagtagctcatgcctgtaatcccagcactttaagaggctgaggtggaggatcacttgagctgcagtgacccatgattgtgccaccactccagcctgggtgatagaagtgagaccttctc

SEQ ID NO: 95749 - DNA, 390 bp, Homo sapiens
ggcacgagcacaaattaaaagttgtaagtttattataaaattagaaatagtgcaaaatatatgaatttcttagtataaataattttcaccatgccataaaacccattaaaatttaaaaatgaaaataagaaatatttatgtcaactttacatgtaaagttagccatactataccttttttgcatgcttctatcatcgtcatgaccaaaatttagtcaagactccatgtccaatttaagccctgatttatacactgcacacatatattttttcctacagaagaaatagctgcttgtttttccatcactaattctactgattaaatgttacttgtaagcaaaacttagttagtattaaatgaattcatatacatgaattctgtcatggtata

SEQ ID NO: 95750 - DNA, 150 bp, Homo sapiens
gaaatactgcttactctttcaaggttacctcaaatgccatgtcctcaatacaatatttatgtcctttatcagtaccgcctgaacttcagttcgacaaagctggggagcacctgctacagaacaggcatgtatgagccagtgggagtgtga

SEQ ID NO: 95751 - DNA, 551 bp, Homo sapiens
tgtggaaaattcatccattaattcccacattcattggaaaagagccaaaccaagatctcctgacttttgaactatcagactctccataaaaggtggtcactgtgaaattcttatgtcaattcatcttaattttccattgccttaaaataaaagagaacttcatgatgtacataggagtgattacaaatttaatttatactgatgctagttttatttttcttaggcaatactgggcaaagccacaagtcatacgcaggcagtgcttcaaaaaactatggaacaaaacagatccttggagaaggtatttggtgcttttagtgtagacttattgaatccaataagctgttaaatataatttccctaaactcaccatactaatggatctgtcacttgtgcctaccttctgctaggtgtgcttcagttctgatggtcttcccttttggagtttacaatctaaaacagattgtcatgtgcacaatgaattcaggttatttttatttccccatgttaaggtagtaggaggcctgccaaattggtacttctcatttctt

SEQ ID NO: 95752 - DNA, 248 bp, Homo sapiens
tcactgcactccagcctgggtgacagagcaagactctgtctcaaaaaaaaaaaagaaaaaaaggattacatacacacacacacacacacacacacacaaacagatgtttattgagcaatgctatgagtaagactgtgtcttagaccctgtagggaatacaaagattaaacaaatccctttccctcaaacactttacagcctactggaggttgaggaaagggagaaatcatgtgcacaagtagctacaa

SEQ ID NO: 95753 - DNA, 918 bp, Homo sapiens
accagaacagcatatccaaaaattatgaggcaatttgaaagtataacatatgtatagtcaaaataccaaaacaagagagaaggagcagagtacatatttcaagtaaaaatagatgacaacttttcaaaactaatgatagacaaaacacatgggtgaagtataggagatttttaagggtagtgaaactcttccgtgtaatactataatcgtgaataaatagcaatatgcatttgtcaaaacccgtatcagcttaatctgtgcaaactttcaaagaatcatttgataggttggaggataccagaatgaaatgcagaatgtgacaaagcaatccaactctattgtaaatgtataagacaaacttactgaagtgggtaagcaaaaaggtgctgacctgagtaattttgcaactgagtagtgtgtgagaataagagctaaagaaactctacataaagcactgtactatagttgatgaagtggtttcctagggaaatacaaatgatgagttctgatacttttatacatatacattgtaattgaacaattaagtaaatggatagaagagagtaggagccaggcttcttgctgttggagtgcaaccttaaaaataagcaacaggatgaggatataatcatccctgtggtaatggattacagttggagacagcagtatgaaatcatgattaactaattacagatacagatggttacacatagaaatatatatgggccaccaggctggcaacgaaacacatcctgattttacctaaactcttgacttgtgcttcctccaaaagcctgggtctgttatatctctcaactggcacatactgtttgctctgactggaaggccaccccaatacaactttcctaaccttaataaacgttccacagtatcactcccggaaaagccttggaaacc

SEQ ID NO: 95754 - DNA, 479 bp, Homo sapiens
tagagacgggtttcaccatgttgaccaggctcgtcttaaactcctgacctcgggtgatccacctgcctcagcctcccaaagtgctgggattacctgcatgagccactgtgcccagccaaaacttcttgacgttgagagtttgaatcttctgaatcatgaaacatttttaaatttttacatttacatacagtaaaattcactctttttagtgtacggttctaggagtttcggcaaaggtggagagttgtgtaaacactggcacagtcaagagacagaaccgttcccatcacttcatgccgtcccttagtggtcagcccttccccacatccgatcccctaatttgttccctgtttcttgatttctcttgggcctgttcctgtagtaaggcagccggggtagggggtggcaggcaggctctttgggggtccatgatcattcttctggcacatgggcctccttctctacatagacaacatgcc

SEQ ID NO: 95755 - DNA, 624 bp, Homo sapiens
aacgtggggcgctgacgcgctcctccccggagcctatggcagcgcagcgccggacggggcgttctccctccccccctcctctcgcttccatctccgccgtctcctcggtctcccttcccatcccggcccctcctccgccagccgcgtcctcccgggcttggtgaggaactgttcctggaggagccgcgggacgccaaaaccagccaatgggaagcggcgattcgcggagattggcactgatgatgggaaggaatattgatctcagcgttactttgaccattaatgaattatgatggcaataagcaaagattcgcacctctagcctccggggagcttaatcttctgctacaacatttgcatttggtgtctctctactgctcaggctggagtgcagtggtgcgatcatagctcactgcagcctcgacttcctgggctcaggtgaccctctcgcctgaaaccatattccccctcaagtagctgagactacagagacaaggtctcactatgttgcctaggctggtcttcaactcctggcctgaagttatcctctcatcttggactgccaaagtgctgggatttggcaccactgagccaaatcccaggcgtgagccactgagcctgggc

SEQ ID NO: 95756 - DNA, 1129 bp, Homo sapiens
aacgtggggcgctgacgcgctcctccccggagcctatggcagcgcagcgccggacggggcgttctccctccccccctcctctcgcttccatctccgccgtctcctcggtctcccttcccatcccggcccctcctccgccagccgcgtcctcccgggcttggtgaggaactgttcctggaggagccgcgggacgccaaaaccagccaatgggaagcggcgattcgcggagattggcactgatgatgggaagcaatgataaggaaactaaactggattaagtgctatcatcttggaggtgcaaaggcaaacaaggagaaagaagtgattgaagagcacttcagaaagcttggtacattcaaatcagcagggcttgattactcgcatcccaggacacttaaggaattggcaaatataattgcaagaccaccagcctttattttagaaaatgaaggttggacagaagaaggtcctgacaagtaaaatcagcagatggagtacctgttttttaaaagagggaaaaggacagctgtagtaattatagactattcagtttatcttggatacctgggaagatacaagagcaaatcatcaaacaatcaatttgcaaccacctagaagagtacaagctactgggtcgtaatcaacgtgattttgtgaagtgcaaattatgccacaccaatttaattttatctatgatagagtgatgagcctggcagaagaggggaaagcaatatctacaactggacttcaataaggaatattgatctcagcgttactttgaccattaatgaattatgatggcaataagcaaagattcgcacctctagcctccggggagcttaatcttctgctacaacatttgcatttggtgtctctctactgctcaggctggagtgcagtggtgcgatcatagctcactgcagcctcgacttcctgggctcaggtgaccctctcgcctgaaaccatattccccctcaagtagctgagactacagagacaaggtctcactatgttgcctaggctggtcttcaactcctggcctgaagttatcctctcatcttggactgccaaagtgctgggatttggcaccactgagccaaatcccaggcgtgagccactgagcctgggc

SEQ ID NO: 95757 - DNA, 1144 bp, Homo sapiens
gaaagaaagagatagagagaaggaaggagggaaaataggagggagggaagaagaaaggaaggaatgaatgaggcaggaagggagaaaaaatggaaggaagaataccggcaggaatttgctctataggatgtaaaatgcaaccactaaaactactaaaaaaaaatactatcaacagatactgctaaataaaaactattaacaaagaactgtaatagcagaggctttcactgtgtttttaacctgtttcattttcctttttaatcagcaatgataaggaaactaaactggattaagtgctatcatcttggaggtgcaaaggcaaacaaggagaaagaagtgattgaagagcacttcagaaagcttggtacattcaaatcagcagggcttgattactcgcatcccaggacacttaaggaattggcaaatataattgcaagaccaccagcctttattttagaaaatgaaggttggacagaagaaggtcctgacaagtaaaatcagcagatggagtacctgttttttaaaagagggaaaaggacagctgtagtaattatagactattcagtttatcttggatacctgggaagatacaagagcaaatcatcaaacaatcaatttgcaaccacctagaagagtacaagctactgggtcgtaatcaacgtgattttgtgaagtgcaaattatgccacaccaatttaattttatctatgatagagtgatgagcctggcagaagaggggaaagcaatatctacaactggacttcaataaggaatattgatctcagcgttactttgaccattaatgaattatgatggcaataagcaaagattcgcacctctagcctccggggagcttaatcttctgctacaacatttgcatttggtgtctctctactgctcaggctggagtgcagtggtgcgatcatagctcactgcagcctcgacttcctgggctcaggtgaccctctcgcctgaaaccatattccccctcaagtagctgagactacagagacaaggtctcactatgttgcctaggctggtcttcaactcctggcctgaagttatcctctcatcttggactgccaaagtgctgggatttggcaccactgagccaaatcccaggcgtgagccactgagcctgggc

SEQ ID NO: 95758 - DNA, 280 bp, Homo sapiens
aggcatcagcttcctcatctgtaaaaatgcagataacaaaagcacctaccgcacaaggtccatgatgaaaaagactttgaacagcctggaatttaataaacattttgtttgctattattattactgtgggagttttctctcctgctttgatgttttagcctgtgctgtatttatatttgttcttcaaacaacaaaatgagtatgtataattcaaaaatcctggacactgctgggactcacatttttcccattaagtcctagatggatttaggtctagctg

SEQ ID NO: 95759 - DNA, 776 bp, Homo sapiens
agtcacctgacttcagaaaatcaatttggattctacagaaaggttctgttggattctgagtggaacctctttggatatgcctttggatttcaagattgagccaagtgttgacatgggaagatgctccagttcctccagttatctcaaagaagctcattaccttgctaaggaatagcacacagtgaagacagtcagtgagaaccagagctattgttacaactgacagcagccagctcaggaggcagaggacgagagcgatcgggctgcacacacatggatgaggctgatttttcagaacacacgacttataagcaggaggatttgccttatgatggggacctctctcagattaagataggcaatgattacagttttacctcaaaaaaggatggccttgaagtcttaaatcaaattattttcatagcagatgaccctcaagagaaggctatgcatagtgagacttgtggaaatacagctgtgaccatacccctgggtaaaattactgaaaatgctgccaacaaaaaagacgagaaagagaaacaatgcactgcagctcttcatattccagcaaatgaaggagacgcttctaagtcaagcatttctgatattttacttcatcatctttccaaagagccattcttaagaggtcaaggcattgattgtgaaaccctcccagagatctcaaatgccgacagttttgaagaggaagctattattaaaagtattatttcatgttataataagaattcttggccaaaagaacaaaccccagaact

SEQ ID NO: 95760 - DNA, 362 bp, Homo sapiens
aattcaagcttctaacgatgtacggggacatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtca

SEQ ID NO: 95761 - DNA, 399 bp, Homo sapiens
  misc_feature (4)..(4): n is a, c, g, or t
  misc_feature (46)..(46): n is a, c, g, or t
atancctaggagttagaatgtgaccagacaatagatggtcttaaanataccaataagattaggcccatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtca

SEQ ID NO: 95762 - DNA, 963 bp, Homo sapiens
  misc_feature (96)..(96): n is a, c, g, or t
  misc_feature (792)..(793): n is a, c, g, or t
taaatcggcacgaggggtacctgaggtgcaccattgagtgtcggatttggggttagcatccagaaagaagaatgcgcatgacgctctgtgaaggcnaggagaacaaggggtctgtggaaatcatgagaaaggacttgaatgacgcccgggacctgcatggccaggcagagtcagcagctgcagtgtggaagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacaggnngtggtaccccattagcatctccaggcctgccatggtgtttcatcttgcggtatctctatttttcctctccctttcttatagttgatttgcgagtgttcgggtcgtgctgggctctggggttgtatggcggaaacccgggcggtttgagtgggaatatccacgtgattggg

SEQ ID NO: 95763 - DNA, 869 bp, Homo sapiens
gcctggctaatttctttatttttatttttttgtagagatggggtcttgctatattgcccagggtgtcctcaaactcctggcctcaagcaattttcccgcctcagcctcccaaaatgctggatgacagctgcaagccaccacaagcaactctgtcataatgcagtctttataaccagctgagcacaatctctactctcaaaatagggctctgaagtctaggaacaagtcctcagctcctgaaatgacagaggaggaagtgagtgaagtgaatgaatgaaggacacagtcaatattgagaataatcacagtgattgcaactgtaaaccctccctgacgcggccttgctctgaatgctactctgttggtctttcaggatggtatcagcactcccagcagacagagtggctcagggctcacaccaggtccctcagcccacacccatcagacttggggttcaaactcagatctgtctgttttcaagacagagcccaaccagcctgcctgaaatcagccagtgaagacttaattgagggattgctaggagacagatggtctcactgggtagatcataatcaggcaatgccagagggaggatccccactggccaccccattcctactgtgtctgaggacacatggacgaagcctcagctcagggcttcgtgttagggtcctggatttggggtgggggggcaggatgtgccttgtcggggctccctgctcaccacgccatggctcagccttgtcgctgctggtgggccgcctctgctccttttctcttcactccctctcttcttccagtgatgctttgttcttttccctttgacgtttccagaagatgcagatgcctccagctattacgagtcccat

SEQ ID NO: 95764 - DNA, 3028 bp, Homo sapiens
tcacgcctgtaatcccagcactttgggaggccgaggcgggtggattacgagtcaggattcgagccacctgccaacatggtgaaaccccgtctgtactaaaataccaaaattagccggcgtcgtggcaggcgcctgcaataccggctactcggggggctgaggcaggagaatcgcttgaacccgggacgcggaggttgcagtgagccgagatcgcgccactgcactcaagcctgcctggcaacagagcgaggctgtctcaaaaaagaaagaaaagcaaagcaaagctaacaaatgctcttctgtcatgcatcatcacagaatcaatgagagctccccccagccaggagacagcggacaaccagggtagcttcccagggggccagagggaggctgcgcgagaagaggctcagcgggatgggtccacgcagggagatcccacgcagggtgggcgtatacgagtgtccacgtccggagggccgttcaagggcgggtccctgaaggaagggtgcacgcagggcacgtccacgcgggcaggcccgtgcacgcagggcgtgcccatgcagggcgggtccgtgcaggatgagagcagcggaggaggcccacgcaggccatttcccgccccgtccccagcccacgcgggcgagctaccgcgggggtacgcgcagctcagatcctagcagcttacaaaaacaaccttttaaaaatggaaccttcaagtaaaaataaaactttgtttccctctttcgcaggagttactgaagtaggaagggacagcccagtaagatttcaggatacgacttgggccggtccgcaggcagtagagtgaagcgcgcagctgccaggacttgcgcggtgacgtgcgccgctgccaggaccttgcaggtggagagcatagttgccaaaatcaaggcggaggagcgcaccgccgctaggatccaggcggagaagcccaccgcggccaggacctaaggatgcagtacactgctgccaggatcttgtctgtggagcgcagcgcggccaggacctccggctgcagcacaccgctgccaggatcttatcggcagagcgctccgcggtccggaccccgccccgtgcgcgtccccgaccccgccccgtgcgcgtccccggcgttggcgtcttcgtcctgttgctggtctccgtccggtcgccggccgtctaggtctccggccctccccagccgctcctgcgcccttgccggccccgccgcccgcagccctggcgctccctgcgggccccgccgaggccgcctgcgccctgtgccagcgcgcgccccgggaaccggtgcgcgccgactgcggccaccgcttctgtcgggcgtgcgtggtgcgcttctgggccgaggaggacgggcccttcccgtgccccgagtgcgccgacgactgctggcagcgcgccgtggagcccggcaggcccccgctcagccgccgccttctggcgctcgaggaggcggccgcggcgcccgcgcgcgacggcccggccagcgaggccgcgctgcagctgctgtgccgcgccgacgccggcccgctctgcgccgcctgccgtatggctgcgggccccgagccgcccgagtgggaaccgcgctggaggaaggcgctgcgcggcaaggagaacaaggggtctgtggaaatcatgagaaaggacttgaatgacgcccgggacctgcatggccaggcagagtcagcagctgcagtgtggaagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacagatccttggcaggtacctgaggtgcaccattgagtgtcggatttggggttagcatccagaaagaagaatgcgcatgacgctctgtgaaggctggaactcaggtcttcagggagagaaaggaagactggattgcaccttgatgcctcctgaggaggcggcccccctcttgaggtgggcgtgggcccggcccagccttatccaagtcgctctgtccacctcccccttcctggcccccaccccactcctgtgcctcccaggagccctccctgtgctccacctgcctccgcagaaggaagcctctttctctgtttccctgggtgagggggctggcaggtggctaaccccatttagcatctccaggccctgccatggtgtctcatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtca

SEQ ID NO: 95765 - DNA, 3005 bp, Homo sapiens
tcacgcctgtaatcccagcactttgggaggccgaggcgggtggattacgagtcaggattcgagccacctgccaacatggtgaaaccccgtctgtactaaaataccaaaattagccggcgtcgtggcaggcgcctgcaataccggctactcggggggctgaggcaggagaatcgcttgaacccgggacgcggaggttgcagtgagccgagatcgcgccactgcactcaagcctgcctggcaacagagcgaggctgtctcaaaaaagaaagaaaagcaaagcaaagctaacaaatgctcttctgtcatgcatcatcacagaatcaatgagagctccccccagccaggagacagcggacaaccagggtagcttcccagggggccagagggaggctgcgcgagaagaggctcagcgggatgggtccacgcagggagatcccacgcagggtgggcgtatacgagtgtccacgtccggagggccgttcaagggcgggtccctgaaggaagggtgcacgcagggcacgtccacgcgggcaggcccgtgcacgcagggcgtgcccatgcagggcgggtccgtgcaggatgagagcagcggaggaggcccacgcaggccatttcccgccccgtccccagcccacgcgggcgagctaccgcgggggtacgcgcagctcagatcctagcagcttacaaaaacaaccttttaaaaatggaaccttcaagtaaaaataaaactttgtttccctctttcgcaggagttactgaagtaggaagggacagcccagtaagatttcaggatacgacttgggccggtccgcaggcagtagagtgaagcgcgcagctgccaggacttgcgcggtgacgtgcgccgctgccaggaccttgcaggtggagagcatagttgccaaaatcaaggcggaggagcgcaccgccgctaggatccaggcggagaagcccaccgcggccaggacctaaggatgcagtacactgctgccaggatcttgtctgtggagcgcagcgcggccaggacctccggctgcagcacaccgctgccaggatcttatcggcagagcgctccgcggtccggaccccgccccgtgcgcgtccccggcgttggcgtcttcgtcctgttgctggtctccgtccggtcgccggccgtctaggtctccggccctccccagccgctcctgcgcccttgccggccccgccgcccgcagccctggcgctccctgcgggccccgccgaggccgcctgcgccctgtgccagcgcgcgccccgggaaccggtgcgcgccgactgcggccaccgcttctgtcgggcgtgcgtggtgcgcttctgggccgaggaggacgggcccttcccgtgccccgagtgcgccgacgactgctggcagcgcgccgtggagcccggcaggcccccgctcagccgccgccttctggcgctcgaggaggcggccgcggcgcccgcgcgcgacggcccggccagcgaggccgcgctgcagctgctgtgccgcgccgacgccggcccgctctgcgccgcctgccgtatggctgcgggccccgagccgcccgagtgggaaccgcgctggaggaaggcgctgcgcggcaaggagaacaaggggtctgtggaaatcatgagaaaggacttgaatgacgcccgggacctgcatggccaggcagagtcagcagctgcagtgtggaagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacagatccttggcaggtacctgaggtgcaccattgagtgtcggatttggggttagcatccagaaagaagaatgcgcatgacgctctgtgaaggctggaactcaggtcttcagggagagaaaggaagactggattgcaccttgatgcctcctgaggaggcggcccccctcttgaggtgggcgtgggcccggcccagccttatccaagtcgctctgtccacctcccccttcctggcccccaccccactcctgtgcctcccaggagccctccctgtgctccacctgcctccgcagaaggaagcctctttctctgtttccctgggtgagggggctggcaggtggctaaccccatttagcatctccaggccctgccatggtgtctcatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtca

SEQ ID NO: 95766 - DNA, 2751 bp, Homo sapiens
tcacgcctgtaatcccagcactttgggaggccgaggcgggtggattacgagtcaggattcgagccacctgccaacatggtgaaaccccgtctgtactaaaataccaaaattagccggcgtcgtggcaggcgcctgcaataccggctactcggggggctgaggcaggagaatcgcttgaacccgggacgcggaggttgcagtgagccgagatcgcgccactgcactcaagcctgcctggcaacagagcgaggctgtctcaaaaaagaaagaaaagcaaagcaaagctaacaaatgctcttctgtcatgcatcatcacagaatcaatgagagctccccccagccaggagacagcggacaaccagggtagcttcccagggggccagagggaggctgcgcgagaagaggctcagcgggatgggtccacgcagggagatcccacgcagggtgggcgtatacgagtgtccacgtccggagggccgttcaagggcgggtccctgaaggaagggtgcacgcagggcacgtccacgcgggcaggcccgtgcacgcagggcgtgcccatgcagggcgggtccgtgcaggatgagagcagcggaggaggcccacgcaggccatttcccgccccgtccccagcccacgcgggcgagctaccgcgggggtacgcgcagctcagatcctagcagcttacaaaaacaaccttttaaaaatggaaccttcaagtaaaaataaaactttgtttccctctttcgcaggagttactgaagtaggaagggacagcccagtaagatttcaggatacgacttgggccggtccgcaggcagtagagtgaagcgcgcagctgccaggacttgcgcggtgacgtgcgccgctgccaggaccttgcaggtggagagcatagttgccaaaatcaaggcggaggagcgcaccgccgctaggatccaggcggagaagcccaccgcggccaggacctaaggatgcagtacactgctgccaggatcttgtctgtggagcgcagcgcggccaggacctccggctgcagcacaccgctgccaggatcttatcggcagagcgctccgcggtccggaccccgccccgtgcgcgtccccgaccccgccccgtgcgcgtccccggcgttggcgtcttcgtcctgttgctggtctccgtccggtcgccggccgtctaggtctccggccctccccgcggcgcccgcgcgcgacggcccggccagcgaggccgcgctgcagctgctgtgccgcgccgacgccggcccgctctgcgccgcctgccgtatggctgcgggccccgagccgcccgagtgggaaccgcgctggaggaaggcgctgcgcggcaaggagaacaaggggtctgtggaaatcatgagaaaggacttgaatgacgcccgggacctgcatggccaggcagagtcagcagctgcagtgtggaagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacagatccttggcaggtacctgaggtgcaccattgagtgtcggatttggggttagcatccagaaagaagaatgcgcatgacgctctgtgaaggctggaactcaggtcttcagggagagaaaggaagactggattgcaccttgatgcctcctgaggaggcggcccccctcttgaggtgggcgtgggcccggcccagccttatccaagtcgctctgtccacctcccccttcctggcccccaccccactcctgtgcctcccaggagccctccctgtgctccacctgcctccgcagaaggaagcctctttctctgtttccctgggtgagggggctggcaggtggctaaccccatttagcatctccaggccctgccatggtgtctcatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtca

SEQ ID NO: 95767 - DNA, 3636 bp, Homo sapiens
tcacgcctgtaatcccagcactttgggaggccgaggcgggtggattacgagtcaggattcgagccacctgccaacatggtgaaaccccgtctgtactaaaataccaaaattagccggcgtcgtggcaggcgcctgcaataccggctactcggggggctgaggcaggagaatcgcttgaacccgggacgcggaggttgcagtgagccgagatcgcgccactgcactcaagcctgcctggcaacagagcgaggctgtctcaaaaaagaaagaaaagcaaagcaaagctaacaaatgctcttctgtcatgcatcatcacagaatcaatgagagctccccccagccaggagacagcggacaaccagggtagcttcccagggggccagagggaggctgcgcgagaagaggctcagcgggatgggtccacgcagggagatcccacgcagggtgggcgtatacgagtgtccacgtccggagggccgttcaagggcgggtccctgaaggaagggtgcacgcagggcacgtccacgcgggcaggcccgtgcacgcagggcgtgcccatgcagggcgggtccgtgcaggatgagagcagcggaggaggcccacgcaggccatttcccgccccgtccccagcccacgcgggcgagctaccgcgggggtacgcgcagctcagatcctagcagcttacaaaaacaaccttttaaaaatggaaccttcaagtaaaaataaaactttgtttccctctttcgcaggagttactgaagtaggaagggacagcccagtaagatttcaggatacgacttgggccggtccgcaggcagtagagtgaagcgcgcagctgccaggacttgcgcggtgacgtgcgccgctgccaggaccttgcaggtggagagcatagttgccaaaatcaaggcggaggagcgcaccgccgctaggatccaggcggagaagcccaccgcggccaggacctaaggatgcagtacactgctgccaggatcttgtctgtggagcgcagcgcggccaggacctccggctgcagcacaccgctgccaggatcttatcggcagagcgctccgcggtccggaccccgccccgtgcgcgtccccgaccccgccccgtgcgcgtccccggcgttggcgtcttcgtcctgttgctggtctccgtccggtcgccggccgtctaggtctccggccctccccagccgctcctgcgcccttgccggccccgccgcccgcagccctggcgctccctgcgggccccgccgaggccgcctgcgccctgtgccagcgcgcgccccgggaaccggtgcgcgccgactgcggccaccgcttctgtcgggcgtgcgtggtgcgcttctgggccgaggaggacgggcccttcccgtgccccgagtgcgccgacgactgctggcagcgcgccgtggagcccggcaggcccccgctcagccgccgccttctggcgctcgaggaggcggccgcggcgcccgcgcgcgacggcccggccagcgaggccgcgctgcagctgctgtgccgcgccgacgccggcccgctctgcgccgcctgccgtatggctgcgggccccgagccgcccgagtgggaaccgcgctggaggaaggcgctgcgcggcaaggagaacaaggggtctgtggaaatcatgagaaaggacttgaatgacgcccgggacctgcatggccaggcagagtcagcagctgcagtgtggaagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcaggtgcgggagccccgctgggtctgcccaccatcgggccagggtggacgcaggcagcagcgagccattgggggaccattgcccgaagtcaaggcttaaaagcccagcctgactcccactgccgtggccttgcagggctgaatttcgggaatgggtgggtggtcagggaaggtgatgggaaggggttttaagttgaggagggtctgaggtgtccctgaccttcacaaaggagggcacttggcatcccgagtgcccgagcatggaaggctcctgcctcgccctggggtcctgaaggcagaagcagccaagaaacccaacctcagggcttttcttctgcctctgcccagggcctggcctgaaccccagaccctgcagcaacccagatggccctgaacggttcagttgcccgtgccagccataggtgacaaggctttggccctggggagacggaagtctgggccaggccctgggtttgttgtgctcaggacagtacctcatgcgctgtctcatgtgcgctctctctttcgctctctccttttgcctctgtctctgactctgtgtgtctctttctctttttgtctctctgtctttccctctcccctcccatgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacagatccttggcaggtacctgaggtgcaccattgagtgtcggatttggggttagcatccagaaagaagaatgcgcatgacgctctgtgaaggctggaactcaggtcttcagggagagaaaggaagactggattgcaccttgatgcctcctgaggaggcggcccccctcttgaggtgggcgtgggcccggcccagccttatccaagtcgctctgtccacctcccccttcctggcccccaccccactcctgtgcctcccaggagccctccctgtgctccacctgcctccgcagaaggaagcctctttctctgtttccctgggtgagggggctggcaggtggctaaccccatttagcatctccaggccctgccatggtgtctcatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtca

SEQ ID NO: 95768 - DNA, 1475 bp, Homo sapiens
  misc_feature (54)..(54): n is a, c, g, or t
  misc_feature (71)..(71): n is a, c, g, or t
taggctaggtacgaggctgggttgtggctgcccgagtgggaaccgcgctggagngtaagcgctgcgcggcnaggagaacaaggggtctgtggaaatcatgagaaaggacttgaatgacgcccgggacctgcatggccaggcagagtcagcagctgcagtgtggaagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacagatccttggcaggtacctgaggtgcaccattgagtgtcggatttggggttagcatccagaaagaagaatgcgcatgacgctctgtgaaggctggaactcaggtcttcagggagagaaaggaagactggattgcaccttgatgcctcctgaggaggcggcccccctcttgaggtgggcgtgggcccggcccagccttatccaagtcgctctgtccacctcccccttcctggcccccaccccactcctgtgcctcccaggagccctccctgtgctccacctgcctccgcagaaggaagcctctttctctgtttccctgggtgagggggctggcaggtggctaaccccatttagcatctccaggccctgccatggtgtctcatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtca

SEQ ID NO: 95769 - DNA, 2867 bp, Homo sapiens
tcacgcctgtaatcccagcactttgggaggccgaggcgggtggattacgagtcaggattcgagccacctgccaacatggtgaaaccccgtctgtactaaaataccaaaattagccggcgtcgtggcaggcgcctgcaataccggctactcggggggctgaggcaggagaatcgcttgaacccgggacgcggaggttgcagtgagccgagatcgcgccactgcactcaagcctgcctggcaacagagcgaggctgtctcaaaaaagaaagaaaagcaaagcaaagctaacaaatgctcttctgtcatgcatcatcacagaatcaatgagagctccccccagccaggagacagcggacaaccagggtagcttcccagggggccagagggaggctgcgcgagaagaggctcagcgggatgggtccacgcagggagatcccacgcagggtgggcgtatacgagtgtccacgtccggagggccgttcaagggcgggtccctgaaggaagggtgcacgcagggcacgtccacgcgggcaggcccgtgcacgcagggcgtgcccatgcagggcgggtccgtgcaggatgagagcagcggaggaggcccacgcaggccatttcccgccccgtccccagcccacgcgggcgagctaccgcgggggtacgcgcagctcagatcctagcagcttacaaaaacaaccttttaaaaatggaaccttcaagtaaaaataaaactttgtttccctctttcgcaggagttactgaagtaggaagggacagcccagtaagatttcaggatacgacttgggccggtccgcaggcagtagagtgaagcgcgcagctgccaggacttgcgcggtgacgtgcgccgctgccaggaccttgcaggtggagagcatagttgccaaaatcaaggcggaggagcgcaccgccgctaggatccaggcggagaagcccaccgcggccaggacctaaggatgcagtacactgctgccaggatcttgtctgtggagcgcagcgcggccaggacctccggctgcagcacaccgctgccaggatcttatcggcagagcgctccgcggtccggaccccgccccgtgcgcgtccccgaccccgccccgtgcgcgtccccggcgttggcgtcttcgtcctgttgctggtctccgtccggtcgccggccgtctaggtctccggccctccccagccgctcctgcgcccttgccggccccgccgcccgcagccctggcgctccctgcgggccccgccgaggccgcctgcgccctgtgccagcgcgcgccccgggaaccggtgcgcgccgactgcggccaccgcttctgtcgggcgtgcgtggtgcgcttctgggccgaggaggacgggcccttcccgtgccccgagtgcgccgacgactgctggcagcgcgccgtggagcccggcaggcccccgctcagccgccgccttctggcgctcgaggaggcggccgcggcgcccgcgcgcgacggcccggccagcgaggccgcgctgcagctgctgtgccgcgccgacgccggcccgctctgcgccgcctgccgtatggctgcgggccccgagccgcccgagtgggaaccgcgctggaggaaggcgctgcgcggcaaggagaacaaggggtctgtggaaatcatgagaaaggacttgaatgacgcccgggacctgcatggctgaccccactgagcggttcaggtcactgctgcaggcggtctcggagctggagaagaagcatcgcaacctgggcctcagcatgctgctgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacagatccttggcaggtacctgaggtgcaccattgagtgtcggatttggggttagcatccagaaagaagaatgcgcatgacgctctgtgaaggctggaactcaggtcttcagggagagaaaggaagactggattgcaccttgatgcctcctgaggaggcggcccccctcttgaggtgggcgtgggcccggcccagccttatccaagtcgctctgtccacctcccccttcctggcccccaccccactcctgtgcctcccaggagccctccctgtgctccacctgcctccgcagaaggaagcctctttctctgtttccctgggtgagggggctggcaggtggctaaccccatttagcatctccaggccctgccatggtgtctcatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtca

SEQ ID NO: 95770 - DNA, 1418 bp, Homo sapiens
aaaatactgaaacaacatacacacaacaaacagaagaacacacactactaaaatacatcataagaaattaggctaggacgaggcccggggtttaatcggcaccgaggagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacagatccttggcaggtacctgaggtgcaccattgagtgtcggatttggggttagcatccagaaagaagaatgcgcatgacgctctgtgaaggctggaactcaggtcttcagggagagaaaggaagactggattgcaccttgatgcctcctgaggaggcggcccccctcttgaggtgggcgtgggcccggcccagccttatccaagtcgctctgtccacctcccccttcctggcccccaccccactcctgtgcctcccaggagccctccctgtgctccacctgcctccgcagaaggaagcctctttctctgtttccctgggtgagggggctggcaggtggctaaccccatttagcatctccaggccctgccatggtgtctcatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtca

SEQ ID NO: 95771 - DNA, 2878 bp, Homo sapiens
tcacgcctgtaatcccagcactttgggaggccgaggcgggtggattacgagtcaggattcgagccacctgccaacatggtgaaaccccgtctgtactaaaataccaaaattagccggcgtcgtggcaggcgcctgcaataccggctactcggggggctgaggcaggagaatcgcttgaacccgggacgcggaggttgcagtgagccgagatcgcgccactgcactcaagcctgcctggcaacagagcgaggctgtctcaaaaaagaaagaaaagcaaagcaaagctaacaaatgctcttctgtcatgcatcatcacagaatcaatgagagctccccccagccaggagacagcggacaaccagggtagcttcccagggggccagagggaggctgcgcgagaagaggctcagcgggatgggtccacgcagggagatcccacgcagggtgggcgtatacgagtgtccacgtccggagggccgttcaagggcgggtccctgaaggaagggtgcacgcagggcacgtccacgcgggcaggcccgtgcacgcagggcgtgcccatgcagggcgggtccgtgcaggatgagagcagcggaggaggcccacgcaggccatttcccgccccgtccccagcccacgcgggcgagctaccgcgggggtacgcgcagctcagatcctagcagcttacaaaaacaaccttttaaaaatggaaccttcaagtaaaaataaaactttgtttccctctttcgcaggagttactgaagtaggaagggacagcccagtaagatttcaggatacgacttgggccggtccgcaggcagtagagtgaagcgcgcagctgccaggacttgcgcggtgacgtgcgccgctgccaggaccttgcaggtggagagcatagttgccaaaatcaaggcggaggagcgcaccgccgctaggatccaggcggagaagcccaccgcggccaggacctaaggatgcagtacactgctgccaggatcttgtctgtggagcgcagcgcggccaggacctccggctgcagcacaccgctgccaggatcttatcggcagagcgctccgcggtccggaccccgccccgtgcgcgtccccgaccccgccccgtgcgcgtccccggcgttggcgtcttcgtcctgttgctggtctccgtccggtcgccggccgtctaggtctccggccctccccagccgctcctgcgcccttgccggccccgccgcccgcagccctggcgctccctgcgggccccgccgaggccgcctgcgccctgtgccagcgcgcgccccgggaaccggtgcgcgccgactgcggccaccgcttctgtcgggcgtgcgtggtgcgcttctgggccgaggaggacgggcccttcccgtgccccgagtgcgccgacgactgctggcagcgcgccgtggagcccggcaggcccccgctcagccgccgccttctggcgctcgaggaggcggccgcggcgcccgcgcgcgacggcccggccagcgaggccgcgctgcagctgctgtgccgcgccgacgccggcccgctctgcgccgcctgccgtatggctgcgggccccgagccgcccgagtgggaaccgcgctggaggaaggcgctgcgcggcaaggagaacaaggggtctgtggaaatcatgagaaaggacttgaatgacgcccgggacctgcatggccaggcagagtcagcagctgcagtgtggaagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacagatccttggcaggtacctgaggtgcaccattgagtgtcggatttggggttagcatccagaaagaagaatgcgcatgacgctctgtgaaggctggaactcaggtcttcagggagagaaaggaagactggattgcaccttgatgcctcctgaggaggcggcccccctcttgaggtgggcgtgggcccggcccagccttatccaagtcgctctgtccacctcccccttcctggcccccaccccactcctgtgcctcccaggagccctccctgtgctccacctgcctccgcagaaggaagcctctttctctgtttccctgggtgagggggctggcaggtggctaaccccatttagcatctccaggccctgccatggtgtctcatcttgctgttatctctagctctttccctcctcccatttcctttagtagttgaattttgcaaagcttgtagcagtagctcagttgcctgcagcatccttgtgtgtagataaattagtcgacagaaactcagcactggggaccagaactgggatcctctagaacgcgcagacagactgcgtatt

SEQ ID NO: 95772 - DNA, 2584 bp, Homo sapiens
tcacgcctgtaatcccagcactttgggaggccgaggcgggtggattacgagtcaggattcgagccacctgccaacatggtgaaaccccgtctgtactaaaataccaaaattagccggcgtcgtggcaggcgcctgcaataccggctactcggggggctgaggcaggagaatcgcttgaacccgggacgcggaggttgcagtgagccgagatcgcgccactgcactcaagcctgcctggcaacagagcgaggctgtctcaaaaaagaaagaaaagcaaagcaaagctaacaaatgctcttctgtcatgcatcatcacagaatcaatgagagctccccccagccaggagacagcggacaaccagggtagcttcccagggggccagagggaggctgcgcgagaagaggctcagcgggatgggtccacgcagggagatcccacgcagggtgggcgtatacgagtgtccacgtccggagggccgttcaagggcgggtccctgaaggaagggtgcacgcagggcacgtccacgcgggcaggcccgtgcacgcagggcgtgcccatgcagggcgggtccgtgcaggatgagagcagcggaggaggcccacgcaggccatttcccgccccgtccccagcccacgcgggcgagctaccgcgggggtacgcgcagctcagatcctagcagcttacaaaaacaaccttttaaaaatggaaccttcaagtaaaaataaaactttgtttccctctttcgcaggagttactgaagtaggaagggacagcccagtaagatttcaggatacgacttgggccggtccgcaggcagtagagtgaagcgcgcagctgccaggacttgcgcggtgacgtgcgccgctgccaggaccttgcaggtggagagcatagttgccaaaatcaaggcggaggagcgcaccgccgctaggatccaggcggagaagcccaccgcggccaggacctaaggatgcagtacactgctgccaggatcttgtctgtggagcgcagcgcggccaggacctccggctgcagcacaccgctgccaggatcttatcggcagagcgctccgcggtccggaccccgccccgtgcgcgtccccgaccccgccccgtgcgcgtccccggcgttggcgtcttcgtcctgttgctggtctccgtccggtcgccggccgtctaggtctccggccctccccagccgctcctgcgcccttgccggccccgccgcccgcagccctggcgctccctgcgggccccgccgaggccgcctgcgccctgtgccagcgcgcgccccgggaaccggtgcgcgccgactgcggccaccgcttctgtcgggcgtgcgtggtgcgcttctgggccgaggaggacgggcccttcccgtgccccgagtgcgccgacgactgctggcagcgcgccgtggagcccggcaggcccccgctcagccgccgccttctggcgctcgaggaggcggccgcggcgcccgcgcgcgacggcccggccagcgaggccgcgctgcagctgctgtgccgcgccgacgccggcccgctctgcgccgcctgccgtatggctgcgggccccgagccgcccgagtgggaaccgcgctggaggaaggcgctgcgcggcaaggagaacaaggggtctgtggaaatcatgagaaaggacttgaatgacgcccgggacctgcatggccaggcagagtcagcagctgcagtgtggaagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacaccctccctgtgctccacctgcctccgcagaaggaagcctctttctctgtttccctgggtgagggggctggcaggtggctaaccccatttagcatctccaggccctgccatggtgtctcatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtca

SEQ ID NO: 95773 - DNA, 2818 bp, Homo sapiens
tcacgcctgtaatcccagcactttgggaggccgaggcgggtggattacgagtcaggattcgagccacctgccaacatggtgaaaccccgtctgtactaaaataccaaaattagccggcgtcgtggcaggcgcctgcaataccggctactcggggggctgaggcaggagaatcgcttgaacccgggacgcggaggttgcagtgagccgagatcgcgccactgcactcaagcctgcctggcaacagagcgaggctgtctcaaaaaagaaagaaaagcaaagcaaagctaacaaatgctcttctgtcatgcatcatcacagaatcaatgagagctccccccagccaggagacagcggacaaccagggtagcttcccagggggccagagggaggctgcgcgagaagaggctcagcgggatgggtccacgcagggagatcccacgcagggtgggcgtatacgagtgtccacgtccggagggccgttcaagggcgggtccctgaaggaagggtgcacgcagggcacgtccacgcgggcaggcccgtgcacgcagggcgtgcccatgcagggcgggtccgtgcaggatgagagcagcggaggaggcccacgcaggccatttcccgccccgtccccagcccacgcgggcgagctaccgcgggggtacgcgcagctcagatcctagcagcttacaaaaacaaccttttaaaaatggaaccttcaagtaaaaataaaactttgtttccctctttcgcaggagttactgaagtaggaagggacagcccagtaagatttcaggatacgacttgggccggtccgcaggcagtagagtgaagcgcgcagctgccaggacttgcgcggtgacgtgcgccgctgccaggaccttgcaggtggagagcatagttgccaaaatcaaggcggaggagcgcaccgccgctaggatccaggcggagaagcccaccgcggccaggacctaaggatgcagtacactgctgccaggatcttgtctgtggagcgcagcgcggccaggacctccggctgcagcacaccgctgccaggatcttatcggcagagcgctccgcggtccggaccccgccccgtgcgcgtccccgaccccgccccgtgcgcgtccccggcgttggcgtcttcgtcctgttgctggtctccgtccggtcgccggccgtctaggtctccggccctccccagccgctcctgcgcccttgccggccccgccgcccgcagccctggcgctccctgcgggccccgccgaggccgcctgcgccctgtgccagcgcgcgccccgggaaccggtgcgcgccgactgcggccaccgcttctgtcgggcgtgcgtggtgcgcttctgggccgaggaggacgggcccttcccgtgccccgagtgcgccgacgactgctggcagcgcgccgtggagcccggcaggcccccgctcagccgccgccttctggcgctcgaggaggcggccgcggcgcccgcgcgcgacggcccggccagcgaggccgcgctgcagctgctgtgccgcgccgacgccggcccgctctgcgccgcctgccgtatggctgcgggccccgagccgcccgagtgggaaccgcgctggaggaaggcgctgcgcggcaaggagaacaaggggtctgtggaaatcatgagaaaggacttgaatgacgcccgggacctgcatggccaggcagagtcagcagctgcagtgtggaagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacagatccttggcaggtacctgaggtgcaccattgagtgtcggatttggggttagcatccagaaagaagaatgcgcatgacgctctgtgaaggctggaactcaggtcttcagggagagaaaggaagactggattgcaccttgatgcctcctgaggaggcggcccccctcttgaggtgggcgtgggcccggcccagccttatccaagtcgctctgtccacctcccccttcctggcccccaccccagcatccaatccacacccagcagacccttcggcatgccgccctctaccaggaagccagaggcctaggagctcgccatccatatttatttgaaaaggtcaaaaggagcatctatgagacaagggaggggtgcaggctgaagcagcgcctcaacagccagggacatgtaggcaacacgagcaggcacagcgcggccaccactgtccacacgctcacacaagccaggcccgcagggccttcggagagctagcaggttacattca

SEQ ID NO: 95774 - DNA, 2565 bp, Homo sapiens
tcacgcctgtaatcccagcactttgggaggccgaggcgggtggattacgagtcaggattcgagccacctgccaacatggtgaaaccccgtctgtactaaaataccaaaattagccggcgtcgtggcaggcgcctgcaataccggctactcggggggctgaggcaggagaatcgcttgaacccgggacgcggaggttgcagtgagccgagatcgcgccactgcactcaagcctgcctggcaacagagcgaggctgtctcaaaaaagaaagaaaagcaaagcaaagctaacaaatgctcttctgtcatgcatcatcacagaatcaatgagagctccccccagccaggagacagcggacaaccagggtagcttcccagggggccagagggaggctgcgcgagaagaggctcagcgggatgggtccacgcagggagatcccacgcagggtgggcgtatacgagtgtccacgtccggagggccgttcaagggcgggtccctgaaggaagggtgcacgcagggcacgtccacgcgggcaggcccgtgcacgcagggcgtgcccatgcagggcgggtccgtgcaggatgagagcagcggaggaggcccacgcaggccatttcccgccccgtccccagcccacgcgggcgagctaccgcgggggtacgcgcagctcagatcctagcagcttacaaaaacaaccttttaaaaatggaaccttcaagtaaaaataaaactttgtttccctctttcgcaggagttactgaagtaggaagggacagcccagtaagatttcaggatacgacttgggccggtccgcaggcagtagagtgaagcgcgcagctgccaggacttgcgcggtgacgtgcgccgctgccaggaccttgcaggtggagagcatagttgccaaaatcaaggcggaggagcgcaccgccgctaggatccaggcggagaagcccaccgcggccaggacctaaggatgcagtacactgctgccaggatcttgtctgtggagcgcagcgcggccaggacctccggctgcagcacaccgctgccaggatcttatcggcagagcgctccgcggtccggaccccgccccgtgcgcgtccccgaccccgccccgtgcgcgtccccggcgttggcgtcttcgtcctgttgctggtctccgtccggtcgccggccgtctaggtctccggccctccccagccgctcctgcgcccttgccggccccgccgcccgcagccctggcgctccctgcgggccccgccgaggccgcctgcgccctgtgccagcgcgcgccccgggaaccggtgcgcgccgactgcggccaccgcttctgtcgggcgtgcgtggtgcgcttctgggccgaggaggacgggcccttcccgtgccccgagtgcgccgacgactgctggcagcgcgccgtggagcccggcaggcccccgctcagccgccgccttctggcgctcgaggaggcggccgcggcgcccgcgcgcgacggcccggccagcgaggccgcgctgcagctgctgtgccgcgccgacgccggcccgctctgcgccgcctgccgtatggctgcgggccccgagccgcccgagtgggaaccgcgctggaggaaggcgctgcgcggcaaggagaacaaggggtctgtggaaatcatgagaaaggacttgaatgacgcccgggacctgcatggccaggcagagtcagcagctgcagtgtggaagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacagatccttggcaggtacctgaggtgcaccattgagtgtcggatttggggttagcatccagaaagaagaatgcgcatgacgctctgtgaaggctggaactcaggtcttcagggagagaaaggaagactggattgcaccttgatgcctcctgaggaggcggcccccctcttgaggtgggcgtgtgtaccccgccaccgtttcaatctcgcgtcgttttacaatccgcaaccgtatcactcccgctcgtaca

SEQ ID NO: 95775 - DNA, 562 bp, Homo sapiens
  misc_feature (2)..(2): n is a, c, g, or t
  misc_feature (11)..(11): n is a, c, g, or t
  misc_feature (17)..(17): n is a, c, g, or t
  misc_feature (19)..(19): n is a, c, g, or t
gngagagaganagagananagagagagagagggcccggcccagccttatccaagtcgctctgtccacctcccccttcctggcccccaccccactcctgtgcctcccaggagccctccctgtgctccacctgcctccgcagaaggaagcctctttctctgtttccctgggtgagggggctggcaggtggctaaccccatttagcatctccaggccctgccatggtgtctcatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtca

SEQ ID NO: 95776 - DNA, 373 bp, Homo sapiens
atccccacctgtgtgctcctgtgtgctctcccccctgtgcatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtca

SEQ ID NO: 95777 - DNA, 1445 bp, Homo sapiens
tcacgcctgtaatcccagcactttgggaggccgaggcgggtggattacgagtcaggattcgagccacctgccaacatggtgaaaccccgtctgtactaaaataccaaaattagccggcgtcgtggcaggcgcctgcaataccggctactcggggggctgaggcaggagaatcgcttgaacccgggacgcggaggttgcagtgagccgagatcgcgccactgcactcaagcctgcctggcaacagagcgaggctgtctcaaaaaagaaagaaaagcaaagcaaagctaacaaatgctcttctgtcatgcatcatcacagaatcaatgagagctccccccagccaggagacagcggacaaccagggtagcttcccagggggccagagggaggctgcgcgagaagaggctcagcgggatgggtccacgcagggagatcccacgcagggtgggcgtatacgagtgtccacgtccggagggccgttcaagggcgggtccctgaaggaagggtgcacgcagggcacgtccacgcgggcaggcccgtgcacgcagggcgtgcccatgcagggcgggtccgtgcaggatgagagcagcggaggaggcccacgcaggccatttcccgccccgtccccagcccacgcgggcgagctaccgcgggggtacgcgcagctcagatcctagcagcttacaaaaacaaccttttaaaaatggaaccttcaagtaaaaataaaactttgtttccctctttcgcaggagttactgaagtaggaagggacagcccagtaagatttcaggatacgacttgggccggtccgcaggcagtagagtgaagcgcgcagctgccaggacttgcgcggtgacgtgcgccgctgccaggaccttgcaggtggagagcatagttgccaaaatcaaggcggaggagcgcaccgccgctaggatccaggcggagaagcccaccgcggccaggacctaaggatgcagtacactgctgccaggatcttgtctgtggagcgcagcgcggccaggacctccggctgcagcacaccgctgccaggatcttatcggcagagcgctccgcggtccggaccccgccccgtgcgcgtccccgaccccgccccgtgcgcgtccccggcgttggcgtcttcgtcctgttgctggtctccgtccggtcgccggccgtctaggtctccggccctccccagccgctcctgcgcccttgccggccccgccgcccgcagccctggcgctccctgcgggccccgccgaggccgcctgcgccctgtgccagcgcgcgccccgggaaccggtgcgcgccgactcccctcccccgctatgtgaggatgtgccctgtgcgcttcagccctgaggagatggtgcctgtcctgtgcccatatagcatgaactgtggctgagtgtgcaatgtgtatgccggttatgaggccaagtgac

SEQ ID NO: 95778 - DNA, 4318 bp, Homo sapiens
tcacgcctgtaatcccagcactttgggaggccgaggcgggtggattacgagtcaggattcgagccacctgccaacatggtgaaaccccgtctgtactaaaataccaaaattagccggcgtcgtggcaggcgcctgcaataccggctactcggggggctgaggcaggagaatcgcttgaacccgggacgcggaggttgcagtgagccgagatcgcgccactgcactcaagcctgcctggcaacagagcgaggctgtctcaaaaaagaaagaaaagcaaagcaaagctaacaaatgctcttctgtcatgcatcatcacagaatcaatgagagctccccccagccaggagacagcggacaaccagggtagcttcccagggggccagagggaggctgcgcgagaagaggctcagcgggatgggtccacgcagggagatcccacgcagggtgggcgtatacgagtgtccacgtccggagggccgttcaagggcgggtccctgaaggaagggtgcacgcagggcacgtccacgcgggcaggcccgtgcacgcagggcgtgcccatgcagggcgggtccgtgcaggatgagagcagcggaggaggcccacgcaggccatttcccgccccgtccccagcccacgcgggcgagctaccgcgggggtacgcgcagctcagatcctagcagcttacaaaaacaaccttttaaaaatggaaccttcaagtaaaaataaaactttgtttccctctttcgcaggagttactgaagtaggaagggacagcccagtaagatttcaggatacgacttgggccggtccgcaggcagtagagtgaagcgcgcagctgccaggacttgcgcggtgacgtgcgccgctgccaggaccttgcaggtggagagcatagttgccaaaatcaaggcggaggagcgcaccgccgctaggatccaggcggagaagcccaccgcggccaggacctaaggatgcagtacactgctgccaggatcttgtctgtggagcgcagcgcggccaggacctccggctgcagcacaccgctgccaggatcttatcggcagagcgctccgcggtccggaccccgccccgtgcgcgtccccgaccccgccccgtgcgcgtccccggcgttggcgtcttcgtcctgttgctggtctccgtccggtcgccggccgtctaggtctccggccctccccagccgctcctgcgcccttgccggccccgccgcccgcagccctggcgctccctgcgggccccgccgaggccgcctgcgccctgtgccagcgcgcgccccgggaaccggtgcgcgccgactgcggccaccgcttctgtcgggcgtgcgtggtgcgcttctgggccgaggaggacgggcccttcccgtgccccgagtgcgccgacgactgctggcagcgcgccgtggagcccggcaggcccccgctcagccgccgccttctggcgctcgaggaggcggccgcggcgcccgcgcgcgacggcccggccagcgaggccgcgctgcagctgctgtgccgcgccgacgccggcccgctctgcgccgcctgccgtatggctgcgggccccgagccgcccgagtgggaaccgcgctggaggaaggcgctgcgcggcaaggagaacaaggggtctgtggaaatcatgagaaaggacttgaatgacgcccgggacctgcatggccaggcagagtcagcagctgcagtgtggaagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacagatccttggcaggtacctgaggtgcaccattgagtgtcggatttggggttagcatccagaaagaagaatgcgcatgacgctctgtgaaggctggaactcaggtcttcagggagagaaaggaagactggattgcaccttgatgcctcctgaggaggcggcccccctcttgaggtgggcgtgggcccggcccagccttatccaagtcgctctgtccacctcccccttcctggcccccaccccactcctgtgcctcccaggagccctccctgtgctccacctgcctccgcagaaggaagcctctttctctgtttccctgggtgagggggctggcaggtggctaaccccatttagcatctccaggccctgccatggtgtctcatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtcagctcgtttgcttcgtctccgtgtgtccacctggcctcttccccctgccctggccaccctccagtgtcaaaggaaacttcctcgtgacacgtgctaaagcatggtgaggaggactttgattgggaccattgagatgggtgtgggaccctttccttggggcctggggggagatggggctccaccccgacgtagcagggcaggggttggaggagcgaggagcagtatagggtccatgggtgggaatgactgtgaggagacatcagggctgagggggctctggctaaacccacctcacagagtccttgctgcaggcaggcagggcgatcagacattggctgcaaacggtcagagaggaacccagtcaggtaccattgagggtggtcagatattatggttaaccaaattagggttcttgctaaaactggatttcataagaaagggcaaagagggccctaggagaagattccagagcctggccagagtttggccaagtagagaatctttgtcagcacgccaacaacatcccgaccctgagacctccagtttgtctttctcactgtctccgcctgctgcagtctgctgtcatccctgagcatccctgcccctgccctgcacacctgtgatgcttgcccggacaggtcctgatggcagagtctcccacaacatcagtgtctccacatcaccaggtccgacagtggcttcaccatcctcacctaacctagctgaccagcaacatcccaccctgtcaatcacaacctctttctatttaagaaaattatatatttatggggcacagtgtgatgttttgatatctatgtacattgtggagtgacagattaatgtatccatctcatgttttttttggtggtgagaatatttgaaatctacactcagcaatttcaaatacagtcatccctctgtgcctaagggggattggttccaggaccccctcatggataccaaaatctgcagatactcaagtaccctgcagtcagccctccctctgcacatatgtgggacagtcagatacagagggccaactgcgtacagtacacggttatcagctgaagtcaccatgctgtgcaatagaccttgagtttattcttgtatagcagggactctgtaccctctgactagaatttccccaaatcctcttgtctcagcccctgctaaccaccgttctactctctaattctataaatcaacattttgattccacatataagtgagatcatgtgatatttgtcctgttcctggcttatttcacttaatataaatgtcctgtaaattc

SEQ ID NO: 95779 - DNA, 1352 bp, Homo sapiens
  misc_feature (37)..(37): n is a, c, g, or t
  misc_feature (43)..(43): n is a, c, g, or t
ccacacccccacaccaatacgcgctagtacgaggccngggtgnggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacagatccttggcaggtacctgaggtgcaccattgagtgtcggatttggggttagcatccagaaagaagaatgcgcatgacgctctgtgaaggctggaactcaggtcttcagggagagaaaggaagactggattgcaccttgatgcctcctgaggaggcggcccccctcttgaggtgggcgtgggcccggcccagccttatccaagtcgctctgtccacctcccccttcctggcccccaccccactcctgtgcctcccaggagccctccctgtgctccacctgcctccgcagaaggaagcctctttctctgtttccctgggtgagggggctggcaggtggctaaccccatttagcatctccaggccctgccatggtgtctcatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtca

SEQ ID NO: 95780 - DNA, 1533 bp, Homo sapiens
caggctggtcttgaactcctgacctcatgatccgcccgccttggcctcctggagtgctgggattacaagcgtgagccactgtgcctggcctaatagtcgatgtgcctgagcagcatgttttggagtggcatgttcttaactccttcaagagcaaacaggttccccttcccctggggagggtgggtgaggacacaggtcttttcctgccacccgtttgcagggacggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacagatccttggcaggtacctgaggtgcaccattgagtgtcggatttggggttagcatccagaaagaagaatgcgcatgacgctctgtgaaggctggaactcaggtcttcagggagagaaaggaagactggattgcaccttgatgcctcctgaggaggcggcccccctcttgaggtgggcgtgggcccggcccagccttatccaagtcgctctgtccacctcccccttcctggcccccaccccactcctgtgcctcccaggagccctccctgtgctccacctgcctccgcagaaggaagcctctttctctgtttccctgggtgagggggctggcaggtggctaaccccatttagcatctccaggccctgccatggtgtctcatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtca

SEQ ID NO: 95781 - DNA, 2778 bp, Homo sapiens
tcacgcctgtaatcccagcactttgggaggccgaggcgggtggattacgagtcaggattcgagccacctgccaacatggtgaaaccccgtctgtactaaaataccaaaattagccggcgtcgtggcaggcgcctgcaataccggctactcggggggctgaggcaggagaatcgcttgaacccgggacgcggaggttgcagtgagccgagatcgcgccactgcactcaagcctgcctggcaacagagcgaggctgtctcaaaaaagaaagaaaagcaaagcaaagctaacaaatgctcttctgtcatgcatcatcacagaatcaatgagagctccccccagccaggagacagcggacaaccagggtagcttcccagggggccagagggaggctgcgcgagaagaggctcagcgggatgggtccacgcagggagatcccacgcagggtgggcgtatacgagtgtccacgtccggagggccgttcaagggcgggtccctgaaggaagggtgcacgcagggcacgtccacgcgggcaggcccgtgcacgcagggcgtgcccatgcagggcgggtccgtgcaggatgagagcagcggaggaggcccacgcaggccatttcccgccccgtccccagcccacgcgggcgagctaccgcgggggtacgcgcagctcagatcctagcagcttacaaaaacaaccttttaaaaatggaaccttcaagtaaaaataaaactttgtttccctctttcgcaggagttactgaagtaggaagggacagcccagtaagatttcaggatacgacttgggccggtccgcaggcagtagagtgaagcgcgcagctgccaggacttgcgcggtgacgtgcgccgctgccaggaccttgcaggtggagagcatagttgccaaaatcaaggcggaggagcgcaccgccgctaggatccaggcggagaagcccaccgcggccaggacctaaggatgcagtacactgctgccaggatcttgtctgtggagcgcagcgcggccaggacctccggctgcagcacaccgctgccaggatcttatcggcagagcgctccgcggtccggaccccgccccgtgcgcgtccccgaccccgccccgtgcgcgtccccggcgttggcgtcttcgtcctgttgctggtctccgtccggtcgccggccgtctaggtctccggccctccccagccgctcctgcgcccttgccggccccgccgcccgcagccctggcgctccctgcgggccccgccgaggccgcctgcgccctgtgccagcgcgcgccccgggaaccggtgcgcgccgactgcggccaccgcttctgtcgggcgtgcgtggtgcgcttctgggccgaggaggacgggcccttcccgtgccccgagtgcgccgacgactgctggcagcgcgccgtggagcccggcaggcccccgctcagccgccgccttctggcgctcgaggaggcggccgcggcgcccgcgcgcgacggcccggccagcgaggccgcgctgcagctgctgtgccgcgccgacgccggcccgctctgcgccgcctgccgtatggctgcgggccccgagccgcccgagtgggaaccgcgctggaggaaggcgctgcgcggcaaggagaacaaggggtctgtggaaatcatgagaaaggacttgaatgacgcccgggacctgcatggccaggcagagtcagcagctgcagtgtggaagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctcctgaggaggcggcccccctcttgaggtgggcgtgggcccggcccagccttatccaagtcgctctgtccacctcccccttcctggcccccaccccactcctgtgcctcccaggagccctccctgtgctccacctgcctccgcagaaggaagcctctttctctgtttccctgggtgagggggctggcaggtggctaaccccatttagcatctccaggccctgccatggtgtctcatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtca

SEQ ID NO: 95782 - DNA, 3112 bp, Homo sapiens
tcacgcctgtaatcccagcactttgggaggccgaggcgggtggattacgagtcaggattcgagccacctgccaacatggtgaaaccccgtctgtactaaaataccaaaattagccggcgtcgtggcaggcgcctgcaataccggctactcggggggctgaggcaggagaatcgcttgaacccgggacgcggaggttgcagtgagccgagatcgcgccactgcactcaagcctgcctggcaacagagcgaggctgtctcaaaaaagaaagaaaagcaaagcaaagctaacaaatgctcttctgtcatgcatcatcacagaatcaatgagagctccccccagccaggagacagcggacaaccagggtagcttcccagggggccagagggaggctgcgcgagaagaggctcagcgggatgggtccacgcagggagatcccacgcagggtgggcgtatacgagtgtccacgtccggagggccgttcaagggcgggtccctgaaggaagggtgcacgcagggcacgtccacgcgggcaggcccgtgcacgcagggcgtgcccatgcagggcgggtccgtgcaggatgagagcagcggaggaggcccacgcaggccatttcccgccccgtccccagcccacgcgggcgagctaccgcgggggtacgcgcagctcagatcctagcagcttacaaaaacaaccttttaaaaatggaaccttcaagtaaaaataaaactttgtttccctctttcgcaggagttactgaagtaggaagggacagcccagtaagatttcaggatacgacttgggccggtccgcaggcagtagagtgaagcgcgcagctgccaggacttgcgcggtgacgtgcgccgctgccaggaccttgcaggtggagagcatagttgccaaaatcaaggcggaggagcgcaccgccgctaggatccaggcggagaagcccaccgcggccaggacctaaggatgcagtacactgctgccaggatcttgtctgtggagcgcagcgcggccaggacctccggctgcagcacaccgctgccaggatcttatcggcagagcgctccgcggtccggaccccgccccgtgcgcgtccccgaccccgccccgtgcgcgtccccggcgttggcgtcttcgtcctgttgctggtctccgtccggtcgccggccgtctaggtctccggccctccccagccgctcctgcgcccttgccggccccgccgcccgcagccctggcgctccctgcgggccccgccgaggccgcctgcgccctgtgccagcgcgcgccccgggaaccggtgcgcgccgactgcggccaccgcttctgtcgggcgtgcgtggtgcgcttctgggccgaggaggacgggcccttcccgtgccccgagtgcgccgacgactgctggcagcgcgccgtggagcccggcaggcccccgctcagccgccgccttctggcgctcgaggaggcggccgcggcgcccgcgcgcgacggcccggccagcgaggccgcgctgcagctgctgtgccgcgccgacgccggcccgctctgcgccgcctgccgtatggctgcgggccccgagccgcccgagtgggaaccgcgctggaggaaggcgctgcgcggcaaggagaacaaggggtctgtggaaatcatgagaaaggacttgaatgacgcccgggacctgcatggccaggcagagtcagcagctgcagtgtggaagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacagatccttggcaggtacctgaggtgcaccattgagtgtcggatttggggttagcatccagaaagaagaatgcgcatgacgctctgtgaaggctggaactcaggtcttcagggagagaaaggaagactggattgcaccttgatgcctcctgaggaggcggcccccctcttgaggtgggcgtgggcccggcccagccttatccaagtcgctctgtccacctcccccttcctggcccccaccccactcctgtgcctcccaggagccctccctgtgctccacctgcctccgcagaaggaagcctctttctctgtttccctgggtgagggggctggcaggtggctaaccccatttagcatctccaggccctgccatggtgtctcatcttgctgttatctctagctctttccctcctcccatttcctttagtagttgaattttgcaaagcttgtagcagtagctcagttgcctgcagcatccttgtgtgtagaaatacaccaaaatgccagtatgcaaaggacacttggggcagcctctcaacattttctgcctgactgatatgcagctgatttgtgggatctgtgctactcgtggggagcacaccaaacatgtcttctgttctattgaagatgcctatgctcaggaaagggatgcctttgagtccctcttccagagctttgagacctggcgtcggggagatgctctttctcgcttggataccttggaaactagtaagaggaaatccctacagttactgataaagacttcagatagtgtagcggatgaccaggttactctag

SEQ ID NO: 95783 - DNA, 1127 bp, Homo sapiens
gttcgcatcctgagctctaaaggaggccctgctggtgccgtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacagatccttggcaggtacctgaggtgcaccattgagtgtcggatttggggttagcatccagaaagaagaatgcgcatgacgctctgtgaaggctggaactcaggtcttcagggagagaaaggaagactggattgcaccttgatgcctcctgaggaggcggcccccctcttgaggtgggcgtgggcccggcccagccttatccaagtcgctctgtccacctcccccttcctggcccccaccccactcctgtgcctcccaggagccctccctgtgctccacctgcctccgcagaaggaagcctctttctctgtttccctgggtgagggggctggcaggtggctaaccccatttagcatctccaggccctgccatggtgtctcatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtca

SEQ ID NO: 95784 - DNA, 701 bp, Homo sapiens
gggatacttagtgatgccagtagtttttccaagcttgaatttatactgtgactatcaggcaatatttagatgggggtaatggaaacttttttaaagtataggaattttctccttatgctgacataagtaacatctgatgctgtagaagcttagtatcaaatattaattggactgaaatagttcagaatattttcccaaaatgatttcctcccactcagtttttacttttgcagagcttctacttaccatttgtagtaacctgaatgacaataaaatggtgaaaaaaagatttgaaatggtgaaaccgccttcttccagatatcattcaggtgactaaaatgcaaaaccaagtacaatagacaaataatagcaacactagaaaacaagaaatactaccgtcaatagagcagcaatttctaggtatttttggaagacaggagggacatagggattgacaggtgtttgttggtgtcagtgtgagcaaaccacgtaagctgagtgaagcagaaatggagaggtctcaccaattctgagtagtgagggctagtaacaaagattaaccctaaggtgggtggacatgggtgtgtggtggctggttcctgtagtcgcagctactcaggaggctgagatgggaggatcacttgacctaggagttcaagtcaagcctgggcaacatggcaggaccctatctttaaaaaaaa

SEQ ID NO: 95785 - DNA, 429 bp, Homo sapiens
aggggttgcagtcagccgagatcgcaccactgcacttcagccacctgggtgacagagcgagactctgtttcaaaaataaataaataaataaaatagaattctgaattttatttttaataattattttgtaaaaagaatgtcttgttttttggagttgttgaatttattgaattgacaaaaattatgtacaagagggtacaacatgatgtgattgaagtatgtatacgttacaaaatggctaaatcaagctaaataacatcacctcccagacttatttttttatggtgagaacacttaaaaaatctgctctcttagtgatttccaagtgtatgttatgttattaactataggtaccatgttgtcccatggatatcctgaacttattcttcctctctaaaaatgacattctgtgtcctttggcatctgccc

SEQ ID NO: 95786 - DNA, 782 bp, Homo sapiens
attttgggtaatgagatgggttattattttttactcttaaacttttcggtgttacttaaattctttataatgacagactccaagcaggtcactttttttggcagaagttttacataacacattctcatttcagaaattcattccaggccaggcgcgtgagccaccgcgcccggccaacagttatctctttatacatacacacaatattgtcatcttattcttcttggttcataccctccaccctcctgaacacctcacaatatagcttagagatctatctatgttggtaaaaacagttcttcttcctattttttattttttaattattattatttttaatttttttgagacagggtcttacttactctgttgcccaggctggagtgcagtggtgggatcatggctcactgcagcttccacctcccagacttaagcgatcctcccaccccagcttctcaagtagcaagaccctgtctcttaaaataattattaacaaaggattggaggccgggcgcggtggctcaggcctgtaatcccagcacttgggaggtcaaggtgagtggatcacctgaggtcaggagttcgcgaccagcttggccaacatggagaaaccccatctttactaaaaatacaaaattagccgggcatggtggcgcatgcctgtaatcccagctactcaggaggctgaggcaggagaatcgcttgaacccgggtggcggaggttgcagtgagccgagattgtgccactacactgcagcctggggcacagagagagactgcat

SEQ ID NO: 95787 - DNA, 432 bp, Homo sapiens
ggatgtatattttcactcctttcgaattccaagccactgatttgctgatgacaactatagctatattcatgagaaaaacagctgtaagtgaacaattttggaaacaaattggattttcttatcagcttatcacttcaacctgtttttattttatttctaattactttatgactggaaagggccctttgaggtcaggtctccatttcctgagtttctaactgaaatattctctaaacaaatacttaaatgactgaagaagttgatggcccatgaaaaattcattctttaagagaataaaagatgatttgttttttctttttttttgacacaggagaatcacttgaatctgggaggcagaggttgtgttgagccaagatcgtgccactgcactgcagcctggttaatagagcaagcttctatctcaaaaaaaaa

SEQ ID NO: 95788 - DNA, 508 bp, Homo sapiens
agtctgatataataatctggtacttagctttaaaagaaatttctcgagaatcttcacaagatgataggatggacaatgtcttcagcagcatcccgacaacacaggcagtaacagacgcgtttgtaagggagtggctcagtggtatcgcttgatgaaactggacaccatagctccagaactcaattgcagaagaggggcaaagggggaaaaggcagcacgatttattatcttgtacatgccagggcaggcctttaattttgtcttcatgttctacacacaggatggatttacctaaaatacaagtggcactgtataaacaaaattcactttggaaggctcagagtcatctctacaaaccaaaagaataaaaagtgaaactgaggcagaggcctgtggttgccagtgggaaaagccattccacgggtaggaagacctcatagacatcgaagacaaatgaaaatctgataaacaattccaggggaaaacgttataaaggtagacactcaac

SEQ ID NO: 95789 - DNA, 710 bp, Homo sapiens
gttttaccacgttggccaggctggtatcgaactcctgacctcaagtgatctccccaacttggcctcccaaagtgctgggattataagcatgagccaccacgccaggcctaattttgtatttttagtagagacggggtttcaccacgttggccaggctagtcttgaactcctgacctcaagtgatccacccccacctcggcctcccaaagtgctgggattacaggcgtgagccaccatgcccagctgttctgttggttcttttttgtttgagacagagtctcactctgtcaccaggctggagtgcagtggcacaatcttggctcactgcaacctccgactccctggttcaagtgattctcctgcctcagcctccgaagtagctcggattacgggcatgcgccaccacacccagctaatttttatatttttagtagagaacggggtttcaccatattggccaggatggtcttgatctcctgaccttgtgatccgcctgcctcggcctcccaaagtgctgggattacaggcgtgagccaccacgcctggcctctgttggttcttaaacaaagggcttattagccctggtaacactgggacaccccattgctataaaaggaaaaagaattagccaggtgtgggggcgcatatctgtgatcccagctacttcttgggagactgaggtgggaggatcccttcagcccaggaggtca

SEQ ID NO: 95790 - DNA, 751 bp, Homo sapiens
agcggaactgtgatacaaatgtatgccatcccctcagtggaggtggtggaaaaaaaatgaggcgttgacctaagtaattttggaaataacttgaaatcataagactaaggaaaatattaattgtatataagtactgcactctaattggtaatattgtttctaataggcacaggggttaacaattccaaaactgctgcccatcaatcctggcactgaacaaataagtagatggatgaagaatggtgagaaccaggtttctcactgttggagtgggagattatagataggctaggggagaaagatacaatgaaacacactattatcagagtatatatctacatctatgtatctgtgaatctatttatctgtctgtctgtgtatacactggctaaggtacttacatatgttacctatgtctgttcactgagggtgtggaagcaattataccactgtaaggggtaagtaaaagcacattcagcacctgaaccgtggtttataataccattctttaaaacaaggaatccactttgggaggccgaggtgggcagatcacgaggtcaagagatggagaacatcctggccaacatggtgaaaccctgtctctactgaaaatacaaaaattagctgggcgtggtggcacgtacctgtagtcccagctactcaggaggctgaggcaggagaatcgcttgaacccaggaggtggaggttgcagtgagccaagatctcgccactgcactccagcctagcgaca

SEQ ID NO: 95791 - DNA, 135 bp, Homo sapiens
tgcaggtgtggttcttctgactctgcctcattcttccccctgtcccctttgtctccactgtcagcatgtgtgcccatttctgtggcttcctccgccaccacggcctttacccgtcactatcttttcttctttgtt

SEQ ID NO: 95792 - DNA, 284 bp, Homo sapiens
aacactgtaagtggatgcagccgtgcattctctacagaaagatgggagtggggagagagaactaggccaaaaggccatggcagctccaaggctgccctggtcactgaccagcacttgttcttgaccctgatacgacacagtgggcagtggcaggcagccggccctccctgttggaacctgtcttccatctctccctccccagccactccagccccctttgtctcttttcctgcttcctccacctagttggctttctgcatcctgtcatccctgtcaccatctcc

SEQ ID NO: 95793 - DNA, 376 bp, Homo sapiens
ggtttagagctgcctcattcttaccagtgactgtgtaccgtggatggactgtcacttatttcagtagtcccctgctggttgacttttaggttgtttccaatctttagttattgtaaataatgctgatatgaggtggctttcaaaccttttcaaaaatctggttctgctgtaagaaaaactcattttacaccaccacccagccctcacaatataacaaaagtttcatgaagtcttacctacccttactgtatgtaacgcactctgatagtttgtatttcattctgttctatttcattttttaaaaattctggttgtaatccactaaatttatttcatagactgactagtggcccatggcctggtttgaaaatgcgtt

SEQ ID NO: 95794 - DNA, 467 bp, Homo sapiens
aatattctccccattgacttgatgtgctatccataagtatagtcatgaaccacataaccacattttggtcaacaacagatcgtatataacagtggtcccataaaattataatatcacatttttactgtaccttttctatgtttacatgcacaaatactcatggctgtgttacagctgcctactgtatccagcacagtgccatgctgtacacgtatgtagcctaggagctgcaggctacaccatatagcctaggtgtgtcggaggctggaccatctaggcttgtgtaagtgccctctgtgatgttctcataacaatgaaatcatctaacaacgcatttcttcgactgtgtccctgttgttaagtgaaacatgactattgctttttgtttaaagtcagtaaagaggcacagtttacactttacttacccatatatatgtatgggtgtatatatgtatgtattttttgcg

SEQ ID NO: 95795 - DNA, 378 bp, Homo sapiens
agcagttgaaacatacatgccaaggctgctggcacttagtgctgctgaaaagcctgggtgactttctctcactaatgctgtggagccctgggagtcagtgttgtggattgcctagccctctttccatgcacgcctgggagactgcgttatctttttgcagtggtgaaatgtggggctcatgccttcaagctgtatcttgcctcgtgacttgtccttcacaagggagttctgggttagtttaaaatgttctgttcttgtcttaccttccctttctcctgctaccacctcctctctctctccccttccttccccctcgattttcctgtgtcagactgcctcctccttatgctccccccagcccacctgtgcgctctcccc

SEQ ID NO: 95796 - DNA, 681 bp, Homo sapiens
tacaattttgttatccataaatttattaagtgttcatcttaattttcaataaaaatgctaaactcaggctcaggaatgacaccagcagaagcaccactgtttatgttatctctgcctcactcatcacaaggagactgatgttgtgccttccaaaggtcatttgattatgttattgttatgttaaaaacgaaaacacaaaaaagcaaaagaaaatatgtttattcattgccttatggttaataccttgatcccactccttatacctacctctgcctgtcaaaacttcacccattcttcatgattcctctcaagtgtaaaccttttcataaaatccatcctgacttccccttcccataggggcactctctctcttctgaatgccaaagcatgtgtctgttgcatagacttcagcaaatagtttatccctatgtatcccggattaaaccgcaagcttccccagagaaagacatcccactctcttctcttctaggcacttagaactgaactcaacaactattaggaattaatacactgtgataggatatcagccaatatgcaaaccatcactgacacagagagtagggcaacctgcttattttagtggtcacatggattcaatatctctgtctaaacggtaatagtaatagctatctttatcaggagactgtcctgcctggtcct

SEQ ID NO: 95797 - DNA, 2234 bp, Homo sapiens
cccgtgcggcccgggcatgcccagtgcgggcgcagcggccccggccctggaagcgccccggcggactggcccgcggtgggcatggggcagggccggagccgcggcggcggagctgtggatccttcatgatgtgatgatttggggacacttctctctcctgtgtgtagttgatagtttgggtggtgaagagatggctgacagtgtcaaaacctttctccaggaccttgccagaggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcagggaatgtttgtgagtctctttcccatccatcttgtcggtcagctggttagtctcctgcatatgtcccttctctactcactgtactgctttgaatatcgttggttcaataaaggaattgaaatgcaccagcggttgtctaacatagaaaggaattggccttactactttgggtttggtttgcccttggcttttctcacagcaatgcagtcctcatatattatcagtggctgccttttctctatcctctttcctttattcattatcagcgccaatgaagcaaagacccctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaagcctgaagagatgagataggaggaaagacctcacagcccagatctgctgggttttgaggagtgattttctttcttccccttgaaggggaaaaagctattttcattggtacatttaaagtcccccaactatggggaggtaccaattctggacaagtgccactacaacaacactaaacctgaactttttcaactccgttggtggtgggaggccagcgggcagaaatttactgttggccactgccaggtctatttccatatttcaaaggaatattgggtgctgcatataggaactgaaggggtcaatgtattaaacctgtgattaggttgttttcctgtcatttttgagagactaaaattgtgggggggcagatgttcaaaatacctggtacaagtttttaaaaaatggtcacaattaaacatgagctggtttcccaaataaaaaaaaaaaa

SEQ ID NO: 95798 - DNA, 341 bp, Homo sapiens
ccagtagacctaacaataccaagtgttggccagagcatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgttaggtctacctggccccatactagttattatcgaaaccatcagcctactcattcaaccaatagccctggccgtacgcctaaccgctaacattactgcaggccacctactcatgcacctaattggaagcgcca

SEQ ID NO: 95799 - DNA, 2122 bp, Homo sapiens
cccgtgcggcccgggcatgcccagtgcgggcgcagcggccccggccctggaagcgccccggcggactggcccgcggtgggcatggggcagggccggagccgcggcggcggagctgtggatccttcatgatgtgatgatttggggacacttctctctcctgtgtgtagttgatagtttgggtggtgaagagatggctgacagtgtcaaaacctttctccaggaccttgccagaggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcagggaatgtttgtgagtctctttcccatccatcttgtcggtcagctggttagtctcctgcatatgtcccttctctactcactgtactgctttgaatatcgttggttcaataaagtggctgccttttctctatcctctttcctttattcattatcagcgccaatgaagcaaagacccctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaagcctgaagagatgagataggaggaaagacctcacagcccagatctgctgggttttgaggagtgattttctttcttccccttgaaggggaaaaagctattttcattggtacatttaaagtcccccaactatggggaggtaccaattctggacaagtgccactacaacaacactaaacctgaactttttcaactccgttggtggtgggaggccagcgggcagaaatttactgttggccactgccaggtctatttccatatttcaaaggaatattgggtgctgcatataggaactgaaggggtcaatgtattaaacctgtgattaggttgttttcctgtcatttttgagagactaaaattgtgggggggcagatgttcaaaatacctggtacaagtttttaaaaaatggtcacaattaaacatgagctggtttcccaaataaaaaaaaaaaa

SEQ ID NO: 95800 - DNA, 1017 bp, Homo sapiens
  misc_feature (1009)..(1009): n is a, c, g, or t
cccgtgcggcccgggcatgcccagtgcgggcgcagcggccccggccctggaagcgccccggcggactggcccgcggtgggcatggggcagggccggagccgcggcggcggagctgtggatccttcatgatgtgatgatttggggacacttctctctcctgtgtgtagttgatagtttgggtggtgaagagatggctgacagtgtcaaaacctttctccaggaccttgccagaggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcagggaatgtttgtgagtctctttcccatccatcttgtcggtcagctggttagtctcctgcatatgtcccttctctactcactgtactgctttgaatatcgttggttcaataaagagaaagcaagtatttgatgataaaaatgtcgtgtagtgcatgctctgtgtggaattcagaggaaaacccagattcagtgattaacaatgccaaaaaatgcaagtaactagccattgttcaaatgacagtggtgctatttctctttngtggcatc

SEQ ID NO: 95801 - DNA, 1400 bp, Homo sapiens
ttccgagagggcggggcggcgtcccaaaacggaaggtggttgtcgtccgttcccaagctggtttgaaactaggggtcgggctcggccgtcgtcgttgtttgtcgccgcatccccgcttccgggttaggccgttcctgcccgccccctcctctcctcccttcggacccatagatctcaggctcggctccccgcccgccgcagcccactgttgacccggcccgtactgcggccccgtggccaccatgtccctgcacggcaaacggaaggagatctacaagtatgaagcgccctggacagtctacgcgatgaactggagtgtgcggcccgataagcgctttcgcttggcgctgggcagcttcgtggaggagtacaacaacaaggttcagcttgttggtttagatgaggagagttcagagtttatttgcagaaacacctttgaccacccataccccaccacaaagctcatgtggatccctgacacaaaaggcgtctatccagacctactggcaacaagcggtgactatctccgtgtgtggagggttggtgaaacagagaccaggctggagtgtttgctaaacaataataagaactctgatttctgtgctcccctgacctcctttgactggaatgaggtggatccttatcttttaggtacctcaagcattgatacgacatgcaccatctgggggctggagacagggcaggtgttagggcgagtgaatctcgtgtctggccacgtgaagacccagctgatcgcccatgacaaagaggtctatgatattgcatttagccgggccgggggtggcagggacatgtttgcctctgtgggtgctgatggctcggtgcggatgtttgacctccgccatctagaacacagcaccatcatttacgaagacccacagcatcacccactgcttcgcctctgctggaacaagcaggaccctaactacctggccaccatggccatggatggaatggaggtggtgattctagatgtccgggttccctgcacacctgtcgccaggttaaacaaccatcgagcatgtgtcaatggcattgcttgggccccacattcatcctgccacatctgcactgcagcggatgaccaccaggctctcatctgggacatccagcaaatgccccgagccattgaggaccctatcctggcctacacagctgaaggagagatcaacaatgtgcagtgggcatcaactcagcccgactggatcgccatctgctacaacaactgcctggagatactcagagtgtagtgttggtggcgctgtgcccacgaggcaggggcttttgtatttcctgcctctgccccacccccaaacctcctgtataagaagtaccgtattttctgcccatcatactttgtaataaaacttgaacatgta

SEQ ID NO: 95802 - DNA, 2400 bp, Homo sapiens
  misc_feature (1131)..(1131): n is a, c, g, or t
  misc_feature (1134)..(1134): n is a, c, g, or t
  misc_feature (1194)..(1194): n is a, c, g, or t
caaacatgcacacattgtcaaaaaacttctgaaaaggtggactaatgatggatattaaaacataatgcaaagatataataaataagatcgtttgatactctaagaactgatgtataaacagagtctagaaatgaactcagaatacaaaaagaaatgtagtctgtgctaaaggtgataggaaatgaagaaaaaatatttttaaggccaggcacagtggcttacgcctgtaattccagcactttgggaggcgggggcaggcagatcacgaggtcaggagttcgagaccagcctggccaacatagtgaaagcccgtctcaaaaaaaaaaaaagaaaaatatgctggttgtcaatgcacttttattgtagaaataatgccaatctgttatttaaattgaaaacagtacagaagcatatttaagagcaaggcgaaagtcatcttttctccttcctatatcatttctgcctccatccccctctgcatagatgacctctatcaacaggtaatgtgtctccttccagacccttttggtatactttcagggatgtacatctatgcctggccaggaaagaattttttaacagcacatatcagcactactttatcagtcttctatataacacctcactgaagcataaatgtccatcaaacagggaagaaacgctctcattatattgaatgatcagagaatgatctttgtaaccactcaagtattttaagtggctgcaaatgacatgtttggtatccccttgtccactcctgatacctgacccagatgagaaggactcattagtgcagtggatagggcctggggacatctgggagatggagtcagggcctagatttgagttctggctctgccactcacttggctgaatagctgtgtgatttggaacaagtgccttaacatttctgaatctcgatttcctcatcgatgaaatgggggcttaaaatagaaccgccatcacgggggtgctttgtaaactgtgacttgctcctgaaatgcagggatcatcatccgcattgcctcacttgtgaccttgcttgctggctttctttgtccctagcggatgaccaccaggctctcatctgggacatccagcaaatgccccgagccattgaggaccctatcntgncctgcactccagcctggtgacagggcatgctctgtctcaaaaaaaaagaaaaacaaatgncagctctctctagtctgttacttgattaaagaggtgaattgtgggtggggagaatgcattggttgtccttggtttggtggcgctagcacctcagattctgctttggctgggctctcattccattcatctgagatgcatagaattcttaccacatgcacctgctgggacccaggattacccagactcctgttgtctgtttctgcatctcccctatcagtctaaaggcccagtgttgctcaagatagagactatcaactacccgtgtcctttgtcttcttttccctcaatcctatggaaatcctgtctctagttctttaaatccacaaatgaaaaattatgcctaaaaagatttttgcatgtggatagtattttttgtttttttctatgaaactctgatgatcccaggccttttacttgttatttccgcaggtggtgattctagatgtccgggttccctgcacacctgtcgccaggttaaacaaccatcgagcatgtgtcaatggcattgcttgggccccacattcatcctgccacatctgcactgcaggtaatcatggtggggagaaagaaatctgggaaggatggaggaaatctgttctcttggctccttagaattgtagttgttactgttttctaagcacagtcttgagagatttatacaaaatgactagttggagcctctccacacttgtgaaattcaatcagtacaaatttttagacgatcttgtaccctcatggacatcagaacatcttccatatatgatttacatcatgtgtcagttatagggctgtgccttgtactgtgcccctgaaatctggatggcacagaggactcaattccaggaatatggggaaagggaggcatccctcatggatataacagaatctttgggactgtgaagatcaacatctccatgggacctttcaggtttcactataacaaacccacagtgtgctctggatgcatcggagggccccacagaactttgcctggttgtggtttgtgacttgtggttttcatttcactgtttcccagaccaaagctagcaccccttacgggctgggtgcagtggcacgcacctgtagtccaagctacttaggaggctgaggcaggagaagcacttcaacccaggaggtggaggttgcattgaccagagattatgccactgccctccagccagggcaacagagcaagactctgtctcc

SEQ ID NO: 95803 - DNA, 763 bp, Homo sapiens
gccatacatcctagaacaaggctcagtgggaagtaggctaggcgtggaatgtggttatttattaattcctttgtgtgggtgagctttccgtgtgtatagatcttgtctctccagttagaatctaaggtcctacggtgaggactgaagacttgactgcctcggtggctctgccggtagcccccaccttgttttctgtagtctttatggtatgctgctccctgggctgagcagatgagtaaacacaagagggaagcttgcatgagaaccttggtcccgtcagccctgacttgcactggttgtttgcaggtacctcaagcattgatacgacatgcaccatctgggggctggagacagggcaggtgttagggcgagtgaatctcgtgtctggccacgtgaagacccagctgatcgcccatgacaaagaggtctatgatattgcatttagccgggccgggggtggcagggacatgtttgcctctgtgggtgctgatggctcggtgcggatgtttgacctccgccatctagaacacagcaccatcatttacgaagacccacagcatcacccactgcttcgcctctgctggaacaagcaggaccctaactacctggccaccatggccatggatggaatggaggtggtgattctagatgtccgggttccctgcacattgttgatctctccttcagctgtgtaggccaggatagggtcctcaatggctcggggcatttgctggatgtcccagatgagagcctggtggtcatc

SEQ ID NO: 95804 - DNA, 496 bp, Homo sapiens
gccatacatcctagaacaaggctcagtgggaagtaggctaggcgtggaatgtggttatttattaattcctttgtgtgggtgagctttccgtgtgtatagatcttgtctctccagttagaatctaaggtcctacggtgaggactgaagacttgactgcctcggtggctctgccggtagcccccaccttgttttctgtagtctttatggtatgctgctccctgggctgagcagatgagtaaacacaagagggaagcttgcatgagaaccttggtcccgtcagccctgacttgcactggttgtttgcaggtacctcaagcattgatacgacatgcaccatctgggggctggagacagggcaggtgttagggcgagtgaatctcgtgtctggccacgtgaagaccccggatgttggatataccatagccgcctagttttaagagtactgcggccagtactattgaccccggccgctggactgaccccggatgttggactg

SEQ ID NO: 95805 - DNA, 6239 bp, Homo sapiens
ttccgagagggcggggcggcgtcccaaaacggaaggtggttgtcgtccgttcccaagctggtttgaaactaggggtcgggctcggccgtcgtcgttgtttgtcgccgcatccccgcttccgggttaggccgttcctgcccgccccctcctctcctcccttcggacccatagatctcaggctcggctccccgcccgccgcagcccactgttgacccggcccgtactgcggccccgtggccaccatgtccctgcacggcaaacggaaggagatctacaagtatgaagcgccctggacagtctacgcgatgaactggagtgtgcggcccgataagcgctttcgcttggcgctgggcagcttcgtggaggagtacaacaacaaggttcagcttgttggtttagatgaggagagttcagagtttatttgcagaaacacctttgaccacccataccccaccacaaagctcatgtggatccctgacacaaaaggcgtctatccagacctactggcaacaagcggtgactatctccgtgtgtggagggttggtgaaacagagaccaggctggagtgtttgctaaacaataataagaactctgatttctgtgctcccctgacctcctttgactggaatgaggtggatccttatcttttaggtacctcaagcattgatacgacatgcaccatctgggggctggagacagggcaggtgttagggcgagtgaatctcgtgtctggccacgtgaagacccagctgatcgcccatgacaaagaggtctatgatattgcatttagccgggccgggggtggcagggacatgtttgcctctgtgggtgctgatggctcggtgcggatgtttgacctccgccatctagaacacagcaccatcatttacgaagacccacagcatcacccactgcttcgcctctgctggaacaagcaggaccctaactacctggccaccatggccatggatggaatggaggtggtgattctagatgtccgggttccctgcacacctgtcgccaggttaaacaaccatcgagcatgtgtcaatggcattgcttgggccccacattcatcctgccacatctgcactgcagcggatgaccaccaggctctcatctgggacatccagcaaatgccccgagccattgaggaccctatcctggcctacacagctgaaggagagatcaacaatgtgcagtgggcatcaactcagcccgactggatcgccatctgctacaacaactgcctggagatactcagagtgtagtgttggtggcgctgtgcccacgaggcaggggcttttgtatttcctgcctctgccccacccccaaagtaagaagaaacatgtttccagtggccagtatgtctttcattgctttgcacccactgttaccagaagctgctctaggagttcctggccagtcaccccatcgccctctgtggcagactcagtgctgtgtggcgcctcctcagcccagggctgagttttaagattttctctcctttcctcttctcctttggttcctcaattaaaaaatgtgtgtatatttgtttgtcaggcgttgtgttgaggagcagttcacgcactggctgtgtctattcctctgcccaggtgtctctgtttgctgcccaaggcagcagttcatgtctcgtccatgtccatgttcgtgttagcacttacgtgggaacaaataccaatttgtcttttctcctagtatcagtgtgtttaacaaattttaactttgtatatttgttatctatcaggctaatttttttatgaaaagaattttactctcctgcttcatttctttgtcttatagtcctccctctttgcaccttcttctcttccctcagtgcctggagctggtactgggcccctggccccatgagcagtttgccttcttgagtcactgcctgtgtagtacatacctgaccgggagtccaaaccaccttggtgctctgaagtccactgactcatcacacctttcttagcctggctcctctcaagggcattctgggcttgtaaacagacataggaagcctctgtttaccctgaagcaccactgtccagcccattggttcccactggcagcatggtagagctgagagaaacaggctctcagggtacctgacttgaggggaatcgtttcatgaagctgaacttcaagcatatttccagtacattctttcagagtctgtttttccatccaaatataagccccaggccattccacttagtgtcttttcaatgataggcaagaatgatatctgagttgaacttcggtgcttctgttgtttgagtttactgtgcctggtggtatattgggcattctttggattgagtgttctgaggtgagagagtcttcccgaggcatcctgtctgtgcttccaaccctgaacaagaccttacatgagagatggactgatggactgcggcaatcctgggctgtcaagtggatagatagttaaaaagcattatactgtgggtaatgaaaagggaggaaaaaaaaagaaggaaaaggaattatagacccccagggtcagccagttaagagctctacccacacctgtcaacccctctctcccccagtttaggttctgagcagtattggacttgtagcctgcagttgtcttttgacttgcaggccgcaggtgtctttctgttatgtgaatgagttccatggaggggcatatgtgtgattccaccgttagatgagcccttggggcaggcagtttgggatgtgctcttgggggaaagttggctgtttccttgcgctctgctcctacccgaaggtttttaagtccctctgaattgctcatctgagattagtagagtagcaggcctgaaggatgatggttttgtcctctttggttctcacctgcttgagaagtaaaacagtaactttgttcttctgggcccttaagcttttttggttaagtcttccttttcagaagtagatgtcattatatgccaaaagtctagctctttgctttaccatacagggacctgtcccaaagaaaaaggctctttttttagccagcatatttccccttctacccttttactttgttgttctgattttaggactctggctggccatgtgcttgtggttgcctctcctgcatttgccactggatttgcactgcatcgtttggagatacaaagcgagcagttcttggtcagaaccctcctctgcttttcattgtgtttgataatggttactgggtccttctctcaagggtagcaaggccaagctgatggctgcttgtttaggaggccatcagttccttcctgtggagaagggtctgaaatggaagtcagtggtagaaggggctggtctgctgggcagggcttacatccactgagttctaagattcctttcctgatctgcacctacgcctggtctgtatggtggaatttgtcagctggaactcagaaacaacaacttgaaaaaaaaataataattagaacatatttgcataagatagctatttactctggaaaccaacaacttttgagatttcccttgccctgtggacgcccagctcctgtcatccttccttaggtcctgcagtacagtcttcccctgaatgccaccggggacccagggggactccacccccctaagcaagcacacacatactcacagttgatgagttgctggtctttgagtcccagctctcttaccctccctttactccaccagcccgacgacccatgactgaggaggggatttctacagtctcaggatttagaaagtctgtaagccatccatgctccagaaagcaccgatctgttgtagttgcaaaaacaactctgtaatttgttgaggttctcaaactgacagccagcgagactgggtgggaggccctggatctgttctccctgactgcgggaggagcagccactaggactttagcaggaagcccacatggaggctccgccaggctgtggcccagctggtgatggcccttttgctcctggcagcctgaggcacagctgcctgtattgtcctcatctgttctgactgaaggatggaggtgctgaataaattaggcctcaggcctctaccaccagagagctggagaatgggtccacgtcattcaaggacctgaattttttatgctcaggagcattggaatcctcttcttccagggaggaattagcctgcaaggttaggacttgaagagggaaggtatttaataactgggcgaggatgggtgtggtggctcacacctgtaatcccagcattttgggaggctgaggtggccagatcccaaggtcagaagatcgagaccatcctggctaacatggtgaaaccccatctctactaaaaatacaaaaaaaaattagccgggggtggtggcgggtacctgtagtcctagctacttgggaggctgaggcaggagaatggcgtgaacctgggaggtggagcttgcagtgagccaagatcgtgccactgcactccagcctgggcgacagagcaagactccgtctcaaaaaataaaaaaaaaaaaaaaataggtgaaaattccttataaatccaggattggctctgagagaactggctaagattcaggaagaaacaaaaaattcagaatcctacaaggttttgatgacaattagggccaaaattttaggaggagatgtaggatgcaggagaaaattaaagtgttttctttatatcagaggaggaaatagtagaggtcagtgaaggtctggggtagggaaacattcagactgtccattgcatggctgtggagtgagactgcccttagcctgggtcagccttcctgggccataaattgggcatccgtgatgctaggtaactgtgggaacaaaatgacagcttagagcagccatgggtgatgtttggtggtaaaaaacctacaggcgtttggggtcccatgattgttccagaccatgactcttcctggttgtgggtttgttacagagcaggagaagcagaggttatgacagttatgcagactttccccctcctttttctcttttctcttccccactttgagaatatggcagcccctttcattcctggcttggggtaggggagaccattgaagtagaagcctcaaagcagacttttccctttactgtgtgtactccaggacgaagaaggaagatcatgcttgatacttagattggttttcccagggaagagggcggagcagagcaaagtcactgtgaaccctgggccaggccctggctgggccagctcctgagagcgtctcgtgttgcagacccttgcccacttcacccacctgcaccttctccccctctcacagtgtcactgctgctaatggtcaaagtcaaatgtgtggccacatgggatgggccaggtcctctcaggctactttctggatgtcatttttaaaatatggaaacatgcaggtgccttcccaaagaggcttggactggtatatccaacgagaaacaaataagctaaagaaagtttaaactcaagaagaaagatgttgacagtctatgtaacagctggaaagtttataggcacccacctttgggacaacccagtgattatgaacatgtgatatctactatttaaaagaaatgttctcaccttgggttgattgtggtataccatgtgttatgaaaattgttgagctgaagctttgaatcgatttagttgagtctgactcacttgctttggttcctgtgtattttactacccctcttgtcagtgaccttccttccccaccccacccagagtgaatttgtagcatgattgtataaacctctatgtagaaaatggagatttcttgctctgaaatgttaagctctaactgatccatttctgtgtcctttagcctagtatgtctgaacttccattcttgttatatatttaaactttccctctatattataggttttgtggcatccacggtcaggtgtagaggaagctgccccttgcagaactgtactgtaatatttttcttttataaatattttcacaggactgattgtacacagggcttgtaataaaattttaacactgtgctgtgaaacaactatggggaatctccattgaaggctacttcatgggcacctgaaagtggagtgttatagctatgactttctatttcttgtttcctaagtaaattaaacctaattttcaccctttcattctgtttcagcctcctgtataagaagtaccgtattttctgcccatcatactttgtaataaaacttgaacatgta

SEQ ID NO: 95806 - DNA, 6306 bp, Homo sapiens
ttccgagagggcggggcggcgtcccaaaacggaaggtggttgtcgtccgttcccaagctggtttgaaactaggggtcgggctcggccgtcgtcgttgtttgtcgccgcatccccgcttccgggttaggccgttcctgcccgccccctcctctcctcccttcggacccatagatctcaggctcggctccccgcccgccgcagcccactgttgacccggcccgtactgcggccccgtggccaccatgtccctgcacggcaaacggaaggagatctacaagtatgaagcgccctggacagtctacgcgatgaactggagtgtgcggcccgataagcgctttcgcttggcgctgggcagcttcgtggaggagtacaacaacaaggttcagcttgttggtttagatgaggagagttcagagtttatttgcagaaacacctttgaccacccataccccaccacaaagctcatgtggatccctgacacaaaaggcgtctatccagacctactggcaacaagcggtgactatctccgtgtgtggagggttggtgaaacagagaccaggctggagtgtttgctaaacaataataagaactctgatttctgtgctcccctgacctcctttgactggaatgaggtggatccttatcttttaggtacctcaagcattgatacgacatgcaccatctgggggctggagacagggcaggtgttagggcgagtgaatctcgtgtctggccacgtgaagacccagctgatcgcccatgacaaagaggtctatgatattgcatttagccgggccgggggtggcagggacatgtttgcctctgtgggtgctgatggctcggtgcggatgtttgacctccgccatctagaacacagcaccatcatttacgaagacccacagcatcacccactgcttcgcctctgctggaacaagcaggaccctaactacctggccaccatggccatggatggaatggaggtggtgattctagatgtccgggttccctgcacacctgtcgccaggttaaacaaccatcgagcatgtgtcaatggcattgcttgggccccacattcatcctgccacatctgcactgcagcggatgaccaccaggctctcatctgggacatccagcaaatgccccgagccattgaggaccctatcctggcctacacagctgaaggagagatcaacaatgtgcagtgggcatcaactcagcccgactggatcgccatctgctacaacaactgcctggagatactcagagtgtagtgttggtggcgctgtgcccacgaggcaggggcttttgtatttcctgcctctgccccacccccaaagtaagaagaaacatgtttccagtggccagtatgtctttcattgctttgcacccactgttaccagaagctgctctaggagttcctggccagtcaccccatcgccctctgtggcagactcagtgctgtgtggcgcctcctcagcccagggctgagttttaagattttctctcctttcctcttctcctttggttcctcaattaaaaaatgtgtgtatatttgtttgtcaggcgttgtgttgaggagcagttcacgcactggctgtgtctattcctctgcccaggtgtctctgtttgctgcccaaggcagcagttcatgtctcgtccatgtccatgttcgtgttagcacttacgtgggaacaaataccaatttgtcttttctcctagtatcagtgtgtttaacaaattttaactttgtatatttgttatctatcaggctaatttttttatgaaaagaattttactctcctgcttcatttctttgtcttatagtcctccctctttgcaccttcttctcttccctcagtgcctggagctggtactgggcccctggccccatgagcagtttgccttcttgagtcactgcctgtgtagtacatacctgaccgggagtccaaaccaccttggtgctctgaagtccactgactcatcacacctttcttagcctggctcctctcaagggcattctgggcttgtaaacagacataggaagcctctgtttaccctgaagcaccactgtccagcccattggttcccactggcagcatggtagagctgagagaaacaggctctcagggtacctgacttgaggggaatcgtttcatgaagctgaacttcaagcatatttccagtacattctttcagagtctgtttttccatccaaatataagccccaggccattccacttagtgtcttttcaatgataggcaagaatgatatctgagttgaacttcggtgcttctgttgtttgagtttactgtgcctggtggtatattgggcattctttggattgagtgttctgaggtgagagagtcttcccgaggcatcctgtctgtgcttccaaccctgaacaagaccttacatgagagatggactgatggactgcggcaatcctgggctgtcaagtggatagatagttaaaaagcattatactgtgggtaatgaaaagggaggaaaaaaaaagaaggaaaaggaattatagacccccagggtcagccagttaagagctctacccacacctgtcaacccctctctcccccagtttaggttctgagcagtattggacttgtagcctgcagttgtcttttgacttgcaggccgcaggtgtctttctgttatgtgaatgagttccatggaggggcatatgtgtgattccaccgttagatgagcccttggggcaggcagtttgggatgtgctcttgggggaaagttggctgtttccttgcgctctgctcctacccgaaggtttttaagtccctctgaattgctcatctgagattagtagagtagcaggcctgaaggatgatggttttgtcctctttggttctcacctgcttgagaagtaaaacagtaactttgttcttctgggcccttaagcttttttggttaagtcttccttttcagaagtagatgtcattatatgccaaaagtctagctctttgctttaccatacagggacctgtcccaaagaattttaggactctggctggccatgtgcttgtggttgcctctcctgcatttgccactggatttgcactgcatcgtttggagatacaaagcgagcagttcttggtcagaaccctcctctgcttttcattgtgtttgataatggttactgggtccttctctcaagggtagcaaggccaagctgatggctgcttgtttaggaggccatcagttccttcctgtggagaagggtctgaaatggaagtcagtggtagaaggggctggtctgctgggcagggcttacatccactgagttctaagattcctttcctgatctgcacctacgcctggtctgtatggtggaatttgtcagctggaactcagaaacaacaacttgaaaaaaaaataataattagaacatatttgcataagatagctatttactctggaaaccaacaacttttgagatttcccttgccctgtggacgcccagctcctgtcatccttccttaggtcctgcagtacagtcttcccctgaatgccaccggggacccagggggactccacccccctaagcaagcacacacatactcacagttgatgagttgctggtctttgagtcccagctctcttaccctccctttactccaccagcccgacgacccatgactgaggaggggatttctacagtctcaggatttagaaagtctgtaagccatccatgctccagaaagcaccgatctgttgtagttgcaaaaacaactctgtaatttgttgaggttctcaaactgacagccagcgagactgggtgggaggccctggatctgttctccctgactgcgggaggagcagccactaggactttagcaggaagcccacatggaggctccgccaggctgtggcccagctggtgatggcccttttgctcctggcagcctgaggcacagctgcctgtattgtcctcatctgttctgactgaaggatggaggtgctgaataaattaggcctcaggcctctaccaccagagagctggagaatgggtccacgtcattcaaggacctgaattttttatgctcaggagcattggaatcctcttcttccagggaggaattagcctgcaaggttaggacttgaagagggaaggtatttaataactgggcgaggatgggtgtggtggctcacacctgtaatcccagcattttgggaggctgaggtggccagatcccaaggtcagaagatcgagaccatcctggctaacatggtgaaaccccatctctactaaaaatacaaaaaaaaattagccgggggtggtggcgggtacctgtagtcctagctacttgggaggctgaggcaggagaatggcgtgaacctgggaggtggagcttgcagtgagccaagatcgtgccactgcactccagcctgggcgacagagcaagactccgtctcaaaaaataaaaaaaaaaaaaaaataggtgaaaattccttataaatccaggattggctctgagagaactggctaagattcaggaagaaacaaaaaattcagaatcctacaaggttttgatgacaattagggccaaaattttaggaggagatgtaggatgcaggagaaaattaaagtgttttctttatatcagaggaggaaatagtagaggtcagtgaaggtctggggtagggaaacattcagactgtccattgcatggctgtggagtgagactgcccttagcctgggtcagccttcctgggccataaattgggcatccgtgatgctaggtaactgtgggaacaaaatgacagcttagagcagccatgggtgatgtttggtggtaaaaaacctacaggcgtttggggtcccatgattgttccagaccatgactcttcctggttgtgggtttgttacagagcaggagaagcagaggttatgacagttatgcagactttccccctcctttttctcttttctcttccccttgcttttccactgtttcttcctgctgccacctgggccttgaattcctgggctgtgaagacatgtagcagctgcagggtttaccacacgtgggagggcagcccagtactgtccctctgccttccccactttgagaatatggcagcccctttcattcctggcttggggtaggggagaccattgaagtagaagcctcaaagcagacttttccctttactgtgtgtactccaggacgaagaaggaagatcatgcttgatacttagattggttttcccagggaagagggcggagcagagcaaagtcactgtgaaccctgggccaggccctggctgggccagctcctgagagcgtctcgtgttgcagacccttgcccacttcacccacctgcaccttctccccctctcacagtgtcactgctgctaatggtcaaagtcaaatgtgtggccacatgggatgggccaggtcctctcaggctactttctggatgtcatttttaaaatatggaaacatgcaggtgccttcccaaagaggcttggactggtatatccaacgagaaacaaataagctaaagaaagtttaaactcaagaagaaagatgttgacagtctatgtaacagctggaaagtttataggcacccacctttgggacaacccagtgattatgaacatgtgatatctactatttaaaagaaatgttctcaccttgggttgattgtggtataccatgtgttatgaaaattgttgagctgaagctttgaatcgatttagttgagtctgactcacttgctttggttcctgtgtattttactacccctcttgtcagtgaccttccttccccaccccacccagagtgaatttgtagcatgattgtataaacctctatgtagaaaatggagatttcttgctctgaaatgttaagctctaactgatccatttctgtgtcctttagcctagtatgtctgaacttccattcttgttatatatttaaactttccctctatattataggttttgtggcatccacggtcaggtgtagaggaagctgccccttgcagaactgtactgtaatatttttcttttataaatattttcacaggactgattgtacacagggcttgtaataaaattttaacactgtgctgtgaaacaactatggggaatctccattgaaggctacttcatgggcacctgaaagtggagtgttatagctatgactttctatttcttgtttcctaagtaaattaaacctaattttcaccctttcattctgtttcagcctcctgtataagaagtaccgtattttctgcccatcatactttgtaataaaacttgaacatgta

SEQ ID NO: 95807 - DNA, 6342 bp, Homo sapiens
ttccgagagggcggggcggcgtcccaaaacggaaggtggttgtcgtccgttcccaagctggtttgaaactaggggtcgggctcggccgtcgtcgttgtttgtcgccgcatccccgcttccgggttaggccgttcctgcccgccccctcctctcctcccttcggacccatagatctcaggctcggctccccgcccgccgcagcccactgttgacccggcccgtactgcggccccgtggccaccatgtccctgcacggcaaacggaaggagatctacaagtatgaagcgccctggacagtctacgcgatgaactggagtgtgcggcccgataagcgctttcgcttggcgctgggcagcttcgtggaggagtacaacaacaaggttcagcttgttggtttagatgaggagagttcagagtttatttgcagaaacacctttgaccacccataccccaccacaaagctcatgtggatccctgacacaaaaggcgtctatccagacctactggcaacaagcggtgactatctccgtgtgtggagggttggtgaaacagagaccaggctggagtgtttgctaaacaataataagaactctgatttctgtgctcccctgacctcctttgactggaatgaggtggatccttatcttttaggtacctcaagcattgatacgacatgcaccatctgggggctggagacagggcaggtgttagggcgagtgaatctcgtgtctggccacgtgaagacccagctgatcgcccatgacaaagaggtctatgatattgcatttagccgggccgggggtggcagggacatgtttgcctctgtgggtgctgatggctcggtgcggatgtttgacctccgccatctagaacacagcaccatcatttacgaagacccacagcatcacccactgcttcgcctctgctggaacaagcaggaccctaactacctggccaccatggccatggatggaatggaggtggtgattctagatgtccgggttccctgcacacctgtcgccaggttaaacaaccatcgagcatgtgtcaatggcattgcttgggccccacattcatcctgccacatctgcactgcagcggatgaccaccaggctctcatctgggacatccagcaaatgccccgagccattgaggaccctatcctggcctacacagctgaaggagagatcaacaatgtgcagtgggcatcaactcagcccgactggatcgccatctgctacaacaactgcctggagatactcagagtgtagtgttggtggcgctgtgcccacgaggcaggggcttttgtatttcctgcctctgccccacccccaaagtaagaagaaacatgtttccagtggccagtatgtctttcattgctttgcacccactgttaccagaagctgctctaggagttcctggccagtcaccccatcgccctctgtggcagactcagtgctgtgtggcgcctcctcagcccagggctgagttttaagattttctctcctttcctcttctcctttggttcctcaattaaaaaatgtgtgtatatttgtttgtcaggcgttgtgttgaggagcagttcacgcactggctgtgtctattcctctgcccaggtgtctctgtttgctgcccaaggcagcagttcatgtctcgtccatgtccatgttcgtgttagcacttacgtgggaacaaataccaatttgtcttttctcctagtatcagtgtgtttaacaaattttaactttgtatatttgttatctatcaggctaatttttttatgaaaagaattttactctcctgcttcatttctttgtcttatagtcctccctctttgcaccttcttctcttccctcagtgcctggagctggtactgggcccctggccccatgagcagtttgccttcttgagtcactgcctgtgtagtacatacctgaccgggagtccaaaccaccttggtgctctgaagtccactgactcatcacacctttcttagcctggctcctctcaagggcattctgggcttgtaaacagacataggaagcctctgtttaccctgaagcaccactgtccagcccattggttcccactggcagcatggtagagctgagagaaacaggctctcagggtacctgacttgaggggaatcgtttcatgaagctgaacttcaagcatatttccagtacattctttcagagtctgtttttccatccaaatataagccccaggccattccacttagtgtcttttcaatgataggcaagaatgatatctgagttgaacttcggtgcttctgttgtttgagtttactgtgcctggtggtatattgggcattctttggattgagtgttctgaggtgagagagtcttcccgaggcatcctgtctgtgcttccaaccctgaacaagaccttacatgagagatggactgatggactgcggcaatcctgggctgtcaagtggatagatagttaaaaagcattatactgtgggtaatgaaaagggaggaaaaaaaaagaaggaaaaggaattatagacccccagggtcagccagttaagagctctacccacacctgtcaacccctctctcccccagtttaggttctgagcagtattggacttgtagcctgcagttgtcttttgacttgcaggccgcaggtgtctttctgttatgtgaatgagttccatggaggggcatatgtgtgattccaccgttagatgagcccttggggcaggcagtttgggatgtgctcttgggggaaagttggctgtttccttgcgctctgctcctacccgaaggtttttaagtccctctgaattgctcatctgagattagtagagtagcaggcctgaaggatgatggttttgtcctctttggttctcacctgcttgagaagtaaaacagtaactttgttcttctgggcccttaagcttttttggttaagtcttccttttcagaagtagatgtcattatatgccaaaagtctagctctttgctttaccatacagggacctgtcccaaagaaaaaggctctttttttagccagcatatttccccttctacccttttactttgttgttctgattttaggactctggctggccatgtgcttgtggttgcctctcctgcatttgccactggatttgcactgcatcgtttggagatacaaagcgagcagttcttggtcagaaccctcctctgcttttcattccttctctcaagggtagcaaggccaagctgatggctgcttgtttaggaggccatcagttccttcctgtggagaagggtctgaaatggaagtcagtggtagaaggggctggtctgctgggcagggcttacatccactgagttctaagattcctttcctgatctgcacctacgcctggtctgtatggtggaatttgtcagctggaactcagaaacaacaacttgaaaaaaaaataataattagaacatatttgcataagatagctatttactctggaaaccaacaacttttgagatttcccttgccctgtggacgcccagctcctgtcatccttccttaggtcctgcagtacagtcttcccctgaatgccaccggggacccagggggactccacccccctaagcaagcacacacatactcacagttgatgagttgctggtctttgagtcccagctctcttaccctccctttactccaccagcccgacgacccatgactgaggaggggatttctacagtctcaggatttagaaagtctgtaagccatccatgctccagaaagcaccgatctgttgtagttgcaaaaacaactctgtaatttgttgaggttctcaaactgacagccagcgagactgggtgggaggccctggatctgttctccctgactgcgggaggagcagccactaggactttagcaggaagcccacatggaggctccgccaggctgtggcccagctggtgatggcccttttgctcctggcagcctgaggcacagctgcctgtattgtcctcatctgttctgactgaaggatggaggtgctgaataaattaggcctcaggcctctaccaccagagagctggagaatgggtccacgtcattcaaggacctgaattttttatgctcaggagcattggaatcctcttcttccagggaggaattagcctgcaaggttaggacttgaagagggaaggtatttaataactgggcgaggatgggtgtggtggctcacacctgtaatcccagcattttgggaggctgaggtggccagatcccaaggtcagaagatcgagaccatcctggctaacatggtgaaaccccatctctactaaaaatacaaaaaaaaattagccgggggtggtggcgggtacctgtagtcctagctacttgggaggctgaggcaggagaatggcgtgaacctgggaggtggagcttgcagtgagccaagatcgtgccactgcactccagcctgggcgacagagcaagactccgtctcaaaaaataaaaaaaaaaaaaaaataggtgaaaattccttataaatccaggattggctctgagagaactggctaagattcaggaagaaacaaaaaattcagaatcctacaaggttttgatgacaattagggccaaaattttaggaggagatgtaggatgcaggagaaaattaaagtgttttctttatatcagaggaggaaatagtagaggtcagtgaaggtctggggtagggaaacattcagactgtccattgcatggctgtggagtgagactgcccttagcctgggtcagccttcctgggccataaattgggcatccgtgatgctaggtaactgtgggaacaaaatgacagcttagagcagccatgggtgatgtttggtggtaaaaaacctacaggcgtttggggtcccatgattgttccagaccatgactcttcctggttgtgggtttgttacagagcaggagaagcagaggttatgacagttatgcagactttccccctcctttttctcttttctcttccccttgcttttccactgtttcttcctgctgccacctgggccttgaattcctgggctgtgaagacatgtagcagctgcagggtttaccacacgtgggagggcagcccagtactgtccctctgccttccccactttgagaatatggcagcccctttcattcctggcttggggtaggggagaccattgaagtagaagcctcaaagcagacttttccctttactgtgtgtactccaggacgaagaaggaagatcatgcttgatacttagattggttttcccagggaagagggcggagcagagcaaagtcactgtgaaccctgggccaggccctggctgggccagctcctgagagcgtctcgtgttgcagacccttgcccacttcacccacctgcaccttctccccctctcacagtgtcactgctgctaatggtcaaagtcaaatgtgtggccacatgggatgggccaggtcctctcaggctactttctggatgtcatttttaaaatatggaaacatgcaggtgccttcccaaagaggcttggactggtatatccaacgagaaacaaataagctaaagaaagtttaaactcaagaagaaagatgttgacagtctatgtaacagctggaaagtttataggcacccacctttgggacaacccagtgattatgaacatgtgatatctactatttaaaagaaatgttctcaccttgggttgattgtggtataccatgtgttatgaaaattgttgagctgaagctttgaatcgatttagttgagtctgactcacttgctttggttcctgtgtattttactacccctcttgtcagtgaccttccttccccaccccacccagagtgaatttgtagcatgattgtataaacctctatgtagaaaatggagatttcttgctctgaaatgttaagctctaactgatccatttctgtgtcctttagcctagtatgtctgaacttccattcttgttatatatttaaactttccctctatattataggttttgtggcatccacggtcaggtgtagaggaagctgccccttgcagaactgtactgtaatatttttcttttataaatattttcacaggactgattgtacacagggcttgtaataaaattttaacactgtgctgtgaaacaactatggggaatctccattgaaggctacttcatgggcacctgaaagtggagtgttatagctatgactttctatttcttgtttcctaagtaaattaaacctaattttcaccctttcattctgtttcagcctcctgtataagaagtaccgtattttctgcccatcatactttgtaataaaacttgaacatgta

SEQ ID NO: 95808 - DNA, 5336 bp, Homo sapiens
  misc_feature (17)..(17): n is a, c, g, or t
  misc_feature (34)..(34): n is a, c, g, or t
agagcgacatgctgaantggcatccgggattttnttgagccagacaaagaacaattgcagttgtttgagcggatgaccaccaggctctcatctgggacatccagcaaatgccccgagccattgaggaccctatcctggcctacacagctgaaggagagatcaacaatgtgcagtgggcatcaactcagcccgactggatcgccatctgctacaacaactgcctggagatactcagagtgtagtgttggtggcgctgtgcccacgaggcaggggcttttgtatttcctgcctctgccccacccccaaagtaagaagaaacatgtttccagtggccagtatgtctttcattgctttgcacccactgttaccagaagctgctctaggagttcctggccagtcaccccatcgccctctgtggcagactcagtgctgtgtggcgcctcctcagcccagggctgagttttaagattttctctcctttcctcttctcctttggttcctcaattaaaaaatgtgtgtatatttgtttgtcaggcgttgtgttgaggagcagttcacgcactggctgtgtctattcctctgcccaggtgtctctgtttgctgcccaaggcagcagttcatgtctcgtccatgtccatgttcgtgttagcacttacgtgggaacaaataccaatttgtcttttctcctagtatcagtgtgtttaacaaattttaactttgtatatttgttatctatcaggctaatttttttatgaaaagaattttactctcctgcttcatttctttgtcttatagtcctccctctttgcaccttcttctcttccctcagtgcctggagctggtactgggcccctggccccatgagcagtttgccttcttgagtcactgcctgtgtagtacatacctgaccgggagtccaaaccaccttggtgctctgaagtccactgactcatcacacctttcttagcctggctcctctcaagggcattctgggcttgtaaacagacataggaagcctctgtttaccctgaagcaccactgtccagcccattggttcccactggcagcatggtagagctgagagaaacaggctctcagggtacctgacttgaggggaatcgtttcatgaagctgaacttcaagcatatttccagtacattctttcagagtctgtttttccatccaaatataagccccaggccattccacttagtgtcttttcaatgataggcaagaatgatatctgagttgaacttcggtgcttctgttgtttgagtttactgtgcctggtggtatattgggcattctttggattgagtgttctgaggtgagagagtcttcccgaggcatcctgtctgtgcttccaaccctgaacaagaccttacatgagagatggactgatggactgcggcaatcctgggctgtcaagtggatagatagttaaaaagcattatactgtgggtaatgaaaagggaggaaaaaaaaagaaggaaaaggaattatagacccccagggtcagccagttaagagctctacccacacctgtcaacccctctctcccccagtttaggttctgagcagtattggacttgtagcctgcagttgtcttttgacttgcaggccgcaggtgtctttctgttatgtgaatgagttccatggaggggcatatgtgtgattccaccgttagatgagcccttggggcaggcagtttgggatgtgctcttgggggaaagttggctgtttccttgcgctctgctcctacccgaaggtttttaagtccctctgaattgctcatctgagattagtagagtagcaggcctgaaggatgatggttttgtcctctttggttctcacctgcttgagaagtaaaacagtaactttgttcttctgggcccttaagcttttttggttaagtcttccttttcagaagtagatgtcattatatgccaaaagtctagctctttgctttaccatacagggacctgtcccaaagaaaaaggctctttttttagccagcatatttccccttctacccttttactttgttgttctgattttaggactctggctggccatgtgcttgtggttgcctctcctgcatttgccactggatttgcactgcatcgtttggagatacaaagcgagcagttcttggtcagaaccctcctctgcttttcattgtgtttgataatggttactgggtccttctctcaagggtagcaaggccaagctgatggctgcttgtttaggaggccatcagttccttcctgtggagaagggtctgaaatggaagtcagtggtagaaggggctggtctgctgggcagggcttacatccactgagttctaagattcctttcctgatctgcacctacgcctggtctgtatggtggaatttgtcagctggaactcagaaacaacaacttgaaaaaaaaataataattagaacatatttgcataagatagctatttactctggaaaccaacaacttttgagatttcccttgccctgtggacgcccagctcctgtcatccttccttaggtcctgcagtacagtcttcccctgaatgccaccggggacccagggggactccacccccctaagcaagcacacacatactcacagttgatgagttgctggtctttgagtcccagctctcttaccctccctttactccaccagcccgacgacccatgactgaggaggggatttctacagtctcaggatttagaaagtctgtaagccatccatgctccagaaagcaccgatctgttgtagttgcaaaaacaactctgtaatttgttgaggttctcaaactgacagccagcgagactgggtgggaggccctggatctgttctccctgactgcgggaggagcagccactaggactttagcaggaagcccacatggaggctccgccaggctgtggcccagctggtgatggcccttttgctcctggcagcctgaggcacagctgcctgtattgtcctcatctgttctgactgaaggatggaggtgctgaataaattaggcctcaggcctctaccaccagagagctggagaatgggtccacgtcattcaaggacctgaattttttatgctcaggagcattggaatcctcttcttccagggaggaattagcctgcaaggttaggacttgaagagggaaggtatttaataactgggcgaggatgggtgtggtggctcacacctgtaatcccagcattttgggaggctgaggtggccagatcccaaggtcagaagatcgagaccatcctggctaacatggtgaaaccccatctctactaaaaatacaaaaaaaaattagccgggggtggtggcgggtacctgtagtcctagctacttgggaggctgaggcaggagaatggcgtgaacctgggaggtggagcttgcagtgagccaagatcgtgccactgcactccagcctgggcgacagagcaagactccgtctcaaaaaataaaaaaaaaaaaaaaataggtgaaaattccttataaatccaggattggctctgagagaactggctaagattcaggaagaaacaaaaaattcagaatcctacaaggttttgatgacaattagggccaaaattttaggaggagatgtaggatgcaggagaaaattaaagtgttttctttatatcagaggaggaaatagtagaggtcagtgaaggtctggggtagggaaacattcagactgtccattgcatggctgtggagtgagactgcccttagcctgggtcagccttcctgggccataaattgggcatccgtgatgctaggtaactgtgggaacaaaatgacagcttagagcagccatgggtgatgtttggtggtaaaaaacctacaggcgtttggggtcccatgattgttccagaccatgactcttcctggttgtgggtttgttacagagcaggagaagcagaggttatgacagttatgcagactttccccctcctttttctcttttctcttccccttgcttttccactgtttcttcctgctgccacctgggccttgaattcctgggctgtgaagacatgtagcagctgcagggtttaccacacgtgggagggcagcccagtactgtccctctgccttccccactttgagaatatggcagcccctttcattcctggcttggggtaggggagaccattgaagtagaagcctcaaagcagacttttccctttactgtgtgtactccaggacgaagaaggaagatcatgcttgatacttagattggttttcccagggaagagggcggagcagagcaaagtcactgtgaaccctgggccaggccctggctgggccagctcctgagagcgtctcgtgttgcagacccttgcccacttcacccacctgcaccttctccccctctcacagtgtcactgctgctaatggtcaaagtcaaatgtgtggccacatgggatgggccaggtcctctcaggctactttctggatgtcatttttaaaatatggaaacatgcaggtgccttcccaaagaggcttggactggtatatccaacgagaaacaaataagctaaagaaagtttaaactcaagaagaaagatgttgacagtctatgtaacagctggaaagtttataggcacccacctttgggacaacccagtgattatgaacatgtgatatctactatttaaaagaaatgttctcaccttgggttgattgtggtataccatgtgttatgaaaattgttgagctgaagctttgaatcgatttagttgagtctgactcacttgctttggttcctgtgtattttactacccctcttgtcagtgaccttccttccccaccccacccagagtgaatttgtagcatgattgtataaacctctatgtagaaaatggagatttcttgctctgaaatgttaagctctaactgatccatttctgtgtcctttagcctagtatgtctgaacttccattcttgttatatatttaaactttccctctatattataggttttgtggcatccacggtcaggtgtagaggaagctgccccttgcagaactgtactgtaatatttttcttttataaatattttcacaggactgattgtacacagggcttgtaataaaattttaacactgtgctgtgaaacaactatggggaatctccattgaaggctacttcatgggcacctgaaagtggagtgttatagctatgactttctatttcttgtttcctaagtaaattaaacctaattttcaccctttcattctgtttcagcctcctgtataagaagtaccgtattttctgcccatcatactttgtaataaaacttgaacatgta

SEQ ID NO: 95809 - DNA, 5885 bp, Homo sapiens
ttccgagagggcggggcggcgtcccaaaacggaaggtggttgtcgtccgttcccaagctggtttgaaactaggggtcgggctcggccgtcgtcgttgtttgtcgccgcatccccgcttccgggttaggccgttcctgcccgccccctcctctcctcccttcggacccatagatctcaggctcggctccccgcccgccgcagcccactgttgacccggcccgtactgcggccccgtggccaccatgtccctgcacggcaaacggaaggagatctacaagtatgaagcgccctggacagtctacgcgatgaactggagtgtgcggcccgataagcgctttcgcttggcgctgggcagcttcgtggaggagtacaacaacaaggttcagcttgttggtttagatgaggagagttcagagtttatttgcagaaacacctttgaccacccataccccaccacaaagctcatgtggatccctgacacaaaaggcgtctatccagacctactggcaacaagcggtgactatctccgtgtgtggagggttggtgaaacagagaccaggctggagtgtttgctaaacaataataagaactctgatttctgtgctcccctgacctcctttgactggaatgaggtggatccttatcttttaggtacctcaagcattgatacgacatgcaccatctgggggctggagacagggcaggtgttagggcgagtgaatctcgtgtctggccacgtgaagacccagctgatcgcccatgacaaagaggtctatgatattgcatttagccgggccgggggtggcagggacatgtttgcctctgtgggtgctgatggctcggtgcggatgtttgacctccgccatctagaacacagcaccatcatttacgaagacccacagcatcacccactgcttcgcctctgctggaacaagcaggaccctaactacctggccaccatggccatggatggaatggaggtggtgattctagatgtccgggttccctgcacacctgtcgccaggttaaacaaccatcgagcatgtgtcaatggcattgcttgggccccacattcatcctgccacatctgcactgcagcggatgaccaccaggctctcatctgggacatccagcaaatgccccgagccattgaggaccctatcctggcctacacagctgaaggagagatcaacaatgtgcagtgggcatcaactcagcccgactggatcgccatctgctacaacaactgcctggagatactcagagtgtagtgttggtggcgctgtgcccacgaggcaggggcttttgtatttcctgcctctgccccacccccaaagtaagaagaaacatgtttccagtggccagtatgtctttcattgctttgcacccactgttaccagaagctgctctaggagttcctggccagtcaccccatcgccctctgtggcagactcagtgctgtgtggcgcctcctcagcccagggctgagttttaagattttctctcctttcctcttctcctttggttcctcaattaaaaaatgtgtgtatatttgtttgtcaggcgttgtgttgaggagcagttcacgcactggctgtgtctattcctctgcccaggtgtctctgtttgctgcccaaggcagcagttcatgtctcgtccatgtccatgttcgtgttagcacttacgtgggaacaaataccaatttgtcttttctcctagtatcagtgtgtttaacaaattttaactttgtatatttgttatctatcaggctaatttttttatgaaaagaattttactctcctgcttcatttctttgtcttatagtcctccctctttgcaccttcttctcttccctcagtgcctggagctggtactgggcccctggccccatgagcagtttgccttcttgagtcactgcctgtgtagtacatacctgaccgggagtccaaaccaccttggtgctctgaagtccactgactcatcacacctttcttagcctggctcctctcaagggcattctgggcttgtaaacagacataggaagcctctgtttaccctgaagcaccactgtccagcccattggttcccactggcagcatggtagagctgagagaaacaggctctcagggtacctgacttgaggggaatcgtttcatgaagctgaacttcaagcatatttccagtacattctttcagagtctgtttttccatccaaatataagccccaggccattccacttagtgtcttttcaatgataggcaagaatgatatctgagttgaacttcggtgcttctgttgtttgagtttactgtgcctggtggtatattgggcattctttggattgagtgttctgaggtgagagagtcttcccgaggcatcctgtctgtgcttccaaccctgaacaagaccttacatgagagatggactgatggactgcggcaatcctgggctgtcaagtggatagatagttaaaaagcattatactgtgggtaatgaaaagggaggaaaaaaaaagaaggaaaaggaattatagacccccagggtcagccagttaagagctctacccacacctgtcaacccctctctcccccagtttaggttctgagcagtattggacttgtagcctgcagttgtcttttgacttgcaggccgcaggtgtctttctgttatgtgaatgagttccatggaggggcatatgtgtgattccaccgttagatgagcccttggggcaggcagtttgggatgtgctcttgggggaaagttggctgtttccttgcgctctgctcctacccgaaggtttttaagtccctctgaattgctcatctgagattagtagagtagcaggcctgaaggatgatggttttgtcctctttggttctcacctgcttgagaagtaaaacagtaactttgttcttctgggcccttaagcttttttggttaagtcttccttttcagaagtagatgtcattatatgccaaaagtctagctctttgctttaccatacagggacctgtcccaaagaaaaaggctctttttttagccagcatatttccccttctacccttttactttgttgttctgattttaggactctggctggccatgtgcttgtggttgcctctcctgcatttgccactggatttgcactgcatcgtttggagatacaaagcgagcagttcttggtcagaaccctcctctgcttttcattgtgtttgataatggttactgggtccttctctcaagggtagcaaggccaagctgatggctgcttgtttaggaggccatcagttccttcctgtggagaagggtctgaaatggaagtcagtggtagaaggggctggtctgctgggcagggcttacatccactgagttctaagattcctttcctgatctgcacctacgcctggtctgtatggtggaatttgtcagctggaactcagaaacaacaacttgaaaaaaaaataataattagaacatatttgcataagatagctatttactctggaaaccaacaacttttgagatttcccttgccctgtggacgcccagctcctgtcatccttccttaggtcctgcagtacagtcttcccctgaatgccaccggggacccagggggactccacccccctaagcaagcacacacatactcacagttgatgagttgctggtctttgagtcccagctctcttaccctccctttactccaccagcccgacgacccatgactgaggaggggatttctacagtctcaggatttagaaagtctgtaagccatccatgctccagaaagcaccgatctgttgtagttgcaaaaacaactctgtaatttgttgaggttctcaaactgacagccagcgagactgggtgggaggccctggatctgttctccctgactgcgggaggagcagccactaggactttagcaggaagcccacatggaggctccgccaggctgtggcccagctggtgatggcccttttgctcctggcagcctgaggcacagctgcctgtattgtcctcatctgttctgactgaaggatggaggtgctgaataaattaggcctcaggcctctaccaccagagagctggagaatgggtccacgtcattcaaggacctgaattttttatgctcaggagcattggaatcctcttcttccagggaggaattagcctgcaaggttaggacttgaagagggaaggtatttaataactgggcgaggatgggtgtggtggctcacacctgtaatcccagcattttgggaggctgaggtggccagatcccaaggtcagaagatcgagaccatcctggctaacatggtgaaaccccatctctactaaaaatacaaaaaaaaattagccgggggtggtggcgggtacctgtagtcctagctacttgggaggctgaggcaggagaatggcgtgaacctgggaggtggagcttgcagtgagccaagatcgtgccactgcactccagcctgggcgacagagcaagactccgtctcaaaaaataaaaaaaaaaaaaaaataggtgaaaattccttataaatccaggattggctctgagagaactggctaagattcaggaagaaacaaaaaattcagaatcctacaaggttttgatgacaattagggccaaaattttaggaggagatgtaggatgcaggagaaaattaaagtgttttctttatatcagaggaggaaatagtagaggtcagtgaaggtctggggtagggaaacattcagactgtccattgcatggctgtggagtgagactgcccttagcctgggtcagccttcctgggccataaattgggcatccgtgatgctaggtaactgtgggaacaaaatgacagcttagagcagccatgggtgatgtttggtggtaaaaaacctacaggcgtttggggtcccatgattgttccagaccatgactcttcctggttgtgggtttgttacagagcaggagaagcagaggttatgacagttatgcagactttccccctcctttttctcttttctcttccccttgcttttccactgtttcttcctgctgccacctgggccttgaattcctgggctgtgaagacatgtagcagctgcagggtttaccacacgtgggagggcagcccagtactgtccctctgccttccccactttgagaatatggcagcccctttcattcctggcttggggtaggggagaccattgaagtagaagcctcaaagcagacttttccctttactgtgtgtactccaggacgaagaaggaagatcatgcttgatacttagattggttttcccagggaagagggcggagcagagcaaagtcactgtgaaccctgggccaggccctggctgggccagctcctgagagcgtctcgtgttgcagacccttgcccacttcacccacctgcaccttctccccctctcacagtgtcactgctgctaatggtcaaagtcaaatgtgtggccacatgggatgggccaggtcctctcaggctactttctggatgtcatttttaaaatatggaaacatgcaggtgccttcccaaagaggcttggactggtatatccaacgagaaacaaataagctaaagaaagtttaaactcaagaagaaagatgttgacagtctatgtaacagctggaaagtttataggcacccacctttgggacaacccagtgattatgaacatgtgatatctactatttaaaagaaatgttctcaccttgggttgattgtggtataccatgtgttatgaaaattgttgagctgaagctttgaatcgatttagttgagtctgactcacttgctttggttcctgtgtattttactacccctcttgtcagtgaccttccttctttctcttatttcgggccggctact

SEQ ID NO: 95810 - DNA, 3057 bp, Homo sapiens
cggacgcgtgggtcgacccacgcggtcgggctggtctgctgggcagggcttacatccactgagttctaagattcctttcctgatctgcacctacgcctggtctgtatggtggaatttgtcagctggaactcagaaacaacaacttgaaaaaaaaataataattagaacatatttgcataagatagctatttactctggaaaccaacaacttttgagatttcccttgccctgtggacgcccagctcctgtcatccttccttaggtcctgcagtacagtcttcccctgaatgccaccggggacccagggggactccacccccctaagcaagcacacacatactcacagttgatgagttgctggtctttgagtcccagctctcttaccctccctttactccaccagcccgacgacccatgactgaggaggggatttctacagtctcaggatttagaaagtctgtaagccatccatgctccagaaagcaccgatctgttgtagttgcaaaaacaactctgtaatttgttgaggttctcaaactgacagccagcgagactgggtgggaggccctggatctgttctccctgactgcgggaggagcagccactaggactttagcaggaagcccacatggaggctccgccaggctgtggcccagctggtgatggcccttttgctcctggcagcctgaggcacagctgcctgtattgtcctcatctgttctgactgaaggatggaggtgctgaataaattaggcctcaggcctctaccaccagagagctggagaatgggtccacgtcattcaaggacctgaattttttatgctcaggagcattggaatcctcttcttccagggaggaattagcctgcaaggttaggacttgaagagggaaggtatttaataactgggcgaggatgggtgtggtggctcacacctgtaatcccagcattttgggaggctgaggtggccagatcccaaggtcagaagatcgagaccatcctggctaacatggtgaaaccccatctctactaaaaatacaaaaaaaaattagccgggggtggtggcgggtacctgtagtcctagctacttgggaggctgaggcaggagaatggcgtgaacctgggaggtggagcttgcagtgagccaagatcgtgccactgcactccagcctgggcgacagagcaagactccgtctcaaaaaataaaaaaaaaaaaaaaataggtgaaaattccttataaatccaggattggctctgagagaactggctaagattcaggaagaaacaaaaaattcagaatcctacaaggttttgatgacaattagggccaaaattttaggaggagatgtaggatgcaggagaaaattaaagtgttttctttatatcagaggaggaaatagtagaggtcagtgaaggtctggggtagggaaacattcagactgtccattgcatggctgtggagtgagactgcccttagcctgggtcagccttcctgggccataaattgggcatccgtgatgctaggtaactgtgggaacaaaatgacagcttagagcagccatgggtgatgtttggtggtaaaaaacctacaggcgtttggggtcccatgattgttccagaccatgactcttcctggttgtgggtttgttacagagcaggagaagcagaggttatgacagttatgcagactttccccctcctttttctcttttctcttccccttgcttttccactgtttcttcctgctgccacctgggccttgaattcctgggctgtgaagacatgtagcagctgcagggtttaccacacgtgggagggcagcccagtactgtccctctgccttccccactttgagaatatggcagcccctttcattcctggcttggggtaggggagaccattgaagtagaagcctcaaagcagacttttccctttactgtgtgtactccaggacgaagaaggaagatcatgcttgatacttagattggttttcccagggaagagggcggagcagagcaaagtcactgtgaaccctgggccaggccctggctgggccagctcctgagagcgtctcgtgttgcagacccttgcccacttcacccacctgcaccttctccccctctcacagtgtcactgctgctaatggtcaaagtcaaatgtgtggccacatgggatgggccaggtcctctcaggctactttctggatgtcatttttaaaatatggaaacatgcaggtgccttcccaaagaggcttggactggtatatccaacgagaaacaaataagctaaagaaagtttaaactcaagaagaaagatgttgacagtctatgtaacagctggaaagtttataggcacccacctttgggacaacccagtgattatgaacatgtgatatctactatttaaaagaaatgttctcaccttgggttgattgtggtataccatgtgttatgaaaattgttgagctgaagctttgaatcgatttagttgagtctgactcacttgctttggttcctgtgtattttactacccctcttgtcagtgaccttccttccccaccccacccagagtgaatttgtagcatgattgtataaacctctatgtagaaaatggagatttcttgctctgaaatgttaagctctaactgatccatttctgtgtcctttagcctagtatgtctgaacttccattcttgttatatatttaaactttccctctatattataggttttgtggcatccacggtcaggtgtagaggaagctgccccttgcagaactgtactgtaatatttttcttttataaatattttcacaggactgattgtacacagggcttgtaataaaattttaacactgtgctgtgaaacaactatggggaatctccattgaaggctacttcatgggcacctgaaagtggagtgttatagctatgactttctatttcttgtttcctaagtaaattaaacctaattttcaccctttcattctgtttcagcctcctgtataagaagtaccgtattttctgcccatcatactttgtaataaaacttgaacatgta

SEQ ID NO: 95811 - DNA, 3351 bp, Homo sapiens
ttccgagagggcggggcggcgtcccaaaacggaaggtggttgtcgtccgttcccaagctggtttgaaactaggggtcgggctcggccgtcgtcgttgtttgtcgccgcatccccgcttccgggttaggccgttcctgcccgccccctcctctcctcccttcggacccatagatctcaggctcggctccccgcccgccgcagcccactgttgacccggcccgtactgcggccccgtggccaccatgtccctgcacggcaaacggaaggagatctacaagtatgaagcgccctggacagtctacgcgatgaactggagtgtgcggcccgataagcgctttcgcttggcgctgggcagcttcgtggaggagtacaacaacaaggttcagcttgttggtttagatgaggagagttcagagtttatttgcagaaacaacaacttgaaaaaaaaataataattagaacatatttgcataagatagctatttactctggaaaccaacaacttttgagatttcccttgccctgtggacgcccagctcctgtcatccttccttaggtcctgcagtacagtcttcccctgaatgccaccggggacccagggggactccacccccctaagcaagcacacacatactcacagttgatgagttgctggtctttgagtcccagctctcttaccctccctttactccaccagcccgacgacccatgactgaggaggggatttctacagtctcaggatttagaaagtctgtaagccatccatgctccagaaagcaccgatctgttgtagttgcaaaaacaactctgtaatttgttgaggttctcaaactgacagccagcgagactgggtgggaggccctggatctgttctccctgactgcgggaggagcagccactaggactttagcaggaagcccacatggaggctccgccaggctgtggcccagctggtgatggcccttttgctcctggcagcctgaggcacagctgcctgtattgtcctcatctgttctgactgaaggatggaggtgctgaataaattaggcctcaggcctctaccaccagagagctggagaatgggtccacgtcattcaaggacctgaattttttatgctcaggagcattggaatcctcttcttccagggaggaattagcctgcaaggttaggacttgaagagggaaggtatttaataactgggcgaggatgggtgtggtggctcacacctgtaatcccagcattttgggaggctgaggtggccagatcccaaggtcagaagatcgagaccatcctggctaacatggtgaaaccccatctctactaaaaatacaaaaaaaaattagccgggggtggtggcgggtacctgtagtcctagctacttgggaggctgaggcaggagaatggcgtgaacctgggaggtggagcttgcagtgagccaagatcgtgccactgcactccagcctgggcgacagagcaagactccgtctcaaaaaataaaaaaaaaaaaaaaataggtgaaaattccttataaatccaggattggctctgagagaactggctaagattcaggaagaaacaaaaaattcagaatcctacaaggttttgatgacaattagggccaaaattttaggaggagatgtaggatgcaggagaaaattaaagtgttttctttatatcagaggaggaaatagtagaggtcagtgaaggtctggggtagggaaacattcagactgtccattgcatggctgtggagtgagactgcccttagcctgggtcagccttcctgggccataaattgggcatccgtgatgctaggtaactgtgggaacaaaatgacagcttagagcagccatgggtgatgtttggtggtaaaaaacctacaggcgtttggggtcccatgattgttccagaccatgactcttcctggttgtgggtttgttacagagcaggagaagcagaggttatgacagttatgcagactttccccctcctttttctcttttctcttccccttgcttttccactgtttcttcctgctgccacctgggccttgaattcctgggctgtgaagacatgtagcagctgcagggtttaccacacgtgggagggcagcccagtactgtccctctgccttccccactttgagaatatggcagcccctttcattcctggcttggggtaggggagaccattgaagtagaagcctcaaagcagacttttccctttactgtgtgtactccaggacgaagaaggaagatcatgcttgatacttagattggttttcccagggaagagggcggagcagagcaaagtcactgtgaaccctgggccaggccctggctgggccagctcctgagagcgtctcgtgttgcagacccttgcccacttcacccacctgcaccttctccccctctcacagtgtcactgctgctaatggtcaaagtcaaatgtgtggccacatgggatgggccaggtcctctcaggctactttctggatgtcatttttaaaatatggaaacatgcaggtgccttcccaaagaggcttggactggtatatccaacgagaaacaaataagctaaagaaagtttaaactcaagaagaaagatgttgacagtctatgtaacagctggaaagtttataggcacccacctttgggacaacccagtgattatgaacatgtgatatctactatttaaaagaaatgttctcaccttgggttgattgtggtataccatgtgttatgaaaattgttgagctgaagctttgaatcgatttagttgagtctgactcacttgctttggttcctgtgtattttactacccctcttgtcagtgaccttccttccccaccccacccagagtgaatttgtagcatgattgtataaacctctatgtagaaaatggagatttcttgctctgaaatgttaagctctaactgatccatttctgtgtcctttagcctagtatgtctgaacttccattcttgttatatatttaaactttccctctatattataggttttgtggcatccacggtcaggtgtagaggaagctgccccttgcagaactgtactgtaatatttttcttttataaatattttcacaggactgattgtacacagggcttgtaataaaattttaacactgtgctgtgaaacaactatggggaatctccattgaaggctacttcatgggcacctgaaagtggagtgttatagctatgactttctatttcttgtttcctaagtaaattaaacctaattttcaccctttcattctgtttcagcctcctgtataagaagtaccgtattttctgcccatcatactttgtaataaaacttgaacatgta

SEQ ID NO: 95812 - DNA, 1930 bp, Homo sapiens
aagatttgactaaggactcaagtggatcaaaccccaggcgttatttaatacgaacgggcagtactatacggtctaggtagcgaggctgggtggcgtgaaaattccttataaatccaggattggctctgagagaactggctaagattcaggaagaaacaaaaaattcagaatcctacaaggttttgatgacaattagggccaaaattttaggaggagatgtaggatgcaggagaaaattaaagtgttttctttatatcagaggaggaaatagtagaggtcagtgaaggtctggggtagggaaacattcagactgtccattgcatggctgtggagtgagactgcccttagcctgggtcagccttcctgggccataaattgggcatccgtgatgctaggtaactgtgggaacaaaatgacagcttagagcagccatgggtgatgtttggtggtaaaaaacctacaggcgtttggggtcccatgattgttccagaccatgactcttcctggttgtgggtttgttacagagcaggagaagcagaggttatgacagttatgcagactttccccctcctttttctcttttctcttccccttgcttttccactgtttcttcctgctgccacctgggccttgaattcctgggctgtgaagacatgtagcagctgcagggtttaccacacgtgggagggcagcccagtactgtccctctgccttccccactttgagaatatggcagcccctttcattcctggcttggggtaggggagaccattgaagtagaagcctcaaagcagacttttccctttactgtgtgtactccaggacgaagaaggaagatcatgcttgatacttagattggttttcccagggaagagggcggagcagagcaaagtcactgtgaaccctgggccaggccctggctgggccagctcctgagagcgtctcgtgttgcagacccttgcccacttcacccacctgcaccttctccccctctcacagtgtcactgctgctaatggtcaaagtcaaatgtgtggccacatgggatgggccaggtcctctcaggctactttctggatgtcatttttaaaatatggaaacatgcaggtgccttcccaaagaggcttggactggtatatccaacgagaaacaaataagctaaagaaagtttaaactcaagaagaaagatgttgacagtctatgtaacagctggaaagtttataggcacccacctttgggacaacccagtgattatgaacatgtgatatctactatttaaaagaaatgttctcaccttgggttgattgtggtataccatgtgttatgaaaattgttgagctgaagctttgaatcgatttagttgagtctgactcacttgctttggttcctgtgtattttactacccctcttgtcagtgaccttccttccccaccccacccagagtgaatttgtagcatgattgtataaacctctatgtagaaaatggagatttcttgctctgaaatgttaagctctaactgatccatttctgtgtcctttagcctagtatgtctgaacttccattcttgttatatatttaaactttccctctatattataggttttgtggcatccacggtcaggtgtagaggaagctgccccttgcagaactgtactgtaatatttttcttttataaatattttcacaggactgattgtacacagggcttgtaataaaattttaacactgtgctgtgaaacaactatggggaatctccattgaaggctacttcatgggcacctgaaagtggagtgttatagctatgactttctatttcttgtttcctaagtaaattaaacctaattttcaccctttcattctgtttcagcctcctgtataagaagtaccgtattttctgcccatcatactttgtaataaaacttgaacatgta

SEQ ID NO: 95813 - DNA, 1501 bp, Homo sapiens
ttccgagagggcggggcggcgtcccaaaacggaaggtggttgtcgtccgttcccaagctggtttgaaactaggggtcgggctcggccgtcgtcgttgtttgtcgccgcatccccgcttccgggttaggccgttcctgcccgccccctcctctcctcccttcggacccatagatctcaggctcggctccccgcccgccgcagcccactgttgacccggcccgtactgcggccccgtggccaccatgtccctgcacggcaaacggaaggagatctacaagtatgaagcgccctggacagtctacgcgatgaactggagtgtgcggcccgataagcgctttcgcttggcgctgggcagcttcgtggaggagtacaacaacaaggttcagcttgttggtttagatgaggagagttcagagtttatttgcagaaacacctttgaccacccataccccaccacaaagctcatgtggatccctgacacaaaaggcgtctatccagacctactggcaacaagcggtgactatctccgtgtgtggagggttggtgaaacagagaccaggctggagtgtttgctaaacaataataagaactctgatttctgtgctcccctgacctcctttgactggaatgaggtggatccttatcttttaggtacctcaagcattgatacgacatgcaccatctgggggctggagacagggcaggtgttagggcgagtgaatctcgtgtctggccacgtgaagacccagctgatcgcccatgacaaagaggtctatgatattgcatttagccgggccgggggtggcagggacatgtttgcctctgtgggtgctgatggctcggtgcggatgtttgacctccgccatctagaacacagcaccatcatttacgaagacccacagcatcacccactgcttcgcctctgctggaacaagcaggaccctaactacctggccaccatggccatggatggaatggaggtggtgattctagatgtccgggttccctgcacacctgtcgccaggttaaacaaccatcgagcatgtgtcaatggcattgcttgggccccacattcatcctgccacatctgcactgcagcggatgaccaccaggctctcatctgggacatccagcaaatgccccgagccattgaggaccctatcctggcctacacagctgaaggagagatcaacaatgtgcagtgggcatcaactcagcccgactggatcgccatctgctacaacaactgcctggagatactcagagtgtagtgttggtggcgctgtgcccacgaggcaggggcttttgtatttcctgcctctgccccacccccaaaattttaggactctggctggccatgtgcttgtggttgcctctcctgcatttgccactggatttgcactgcatcgtttggagatacaaagcgagcagttcttgcctcctgtataagaagtaccgtattttctgcccatcatactttgtaataaaacttgaacatgta

SEQ ID NO: 95814 - DNA, 909 bp, Homo sapiens
ttccgagagggcggggcggcgtcccaaaacggaaggtggttgtcgtccgttcccaagctggtttgaaactaggggtcgggctcggccgtcgtcgttgtttgtcgccgcatccccgcttccgggttaggccgttcctgcccgccccctcctctcctcccttcggacccatagatctcaggctcggctccccgcccgccgcagcccactgttgacccggcccgtactgcggccccgtggccaccatgtccctgcacggcaaacggaaggagatctacaagtatgaagcgccctggacagtctacgcgatgaactggagtgtgcggcccgataagcgctttcgcttggcgctgggcagcttcgtggaggagtacaacaacaaggttcagcttgttggtttagatgaggagagttcagagtttatttgcagaaacacctttgaccacccataccccaccacaaagctcatgtggatccctgacacaaaaggcgtctatccagacctactggcaacaagcggtgactatctccgtgtgtggagggttggtgaaacagagaccaggctggagtgtttgctaaacaataataagaactctgatttctgtgctcccctgacctcctttgactggaatgaggtggatccttatcttttaggtacctcaagcattgatacgacatgcaccatctgggggctggagacagggcaggtgttagggcgagtgaatctcgtgtctggccacgtgaagacccagctgatcgcccatgacaaagaggtctatgatattgcatttagccgggccgggggtggcagggaacccggacatctagaatcaccacctccattccatccatggccatggtggccaggtagttagggtcctgcttgttccagcagaggcgaagcagtgggtg

SEQ ID NO: 95815 - DNA, 6365 bp, Homo sapiens
ttccgagagggcggggcggcgtcccaaaacggaaggtggttgtcgtccgttcccaagctggtttgaaactaggggtcgggctcggccgtcgtcgttgtttgtcgccgcatccccgcttccgggttaggccgttcctgcccgccccctcctctcctcccttcggacccatagatctcaggctcggctccccgcccgccgcagcccactgttgacccggcccgtactgcggccccgtggccaccatgtccctgcacggcaaacggaaggagatctacaagtatgaagcgccctggacagtctacgcgatgaactggagtgtgcggcccgataagcgctttcgcttggcgctgggcagcttcgtggaggagtacaacaacaaggttcagcttgttggtttagatgaggagagttcagagtttatttgcagaaacacctttgaccacccataccccaccacaaagctcatgtggatccctgacacaaaaggcgtctatccagacctactggcaacaagcggtgactatctccgtgtgtggagggttggtgaaacagagaccaggctggagtgtttgctaaacaataataagaactctgatttctgtgctcccctgacctcctttgactggaatgaggtggatccttatcttttaggtacctcaagcattgatacgacatgcaccatctgggggctggagacagggcaggtgttagggcgagtgaatctcgtgtctggccacgtgaagacccagctgatcgcccatgacaaagaggtctatgatattgcatttagccgggccgggggtggcagggacatgtttgcctctgtgggtgctgatggctcggtgcggatgtttgacctccgccatctagaacacagcaccatcatttacgaagacccacagcatcacccactgcttcgcctctgctggaacaagcaggaccctaactacctggccaccatggccatggatggaatggaggtggtgattctagatgtccgggttccctgcacacctgtcgccaggttaaacaaccatcgagcatgtgtcaatggcattgcttgggccccacattcatcctgccacatctgcactgcagcggatgaccaccaggctctcatctgggacatccagcaaatgccccgagccattgaggaccctatcctggcctacacagctgaaggagagatcaacaatgtgcagtgggcatcaactcagcccgactggatcgccatctgctacaacaactgcctggagatactcagagtgtagtgttggtggcgctgtgcccacgaggcaggggcttttgtatttcctgcctctgccccacccccaaagtaagaagaaacatgtttccagtggccagtatgtctttcattgctttgcacccactgttaccagaagctgctctaggagttcctggccagtcaccccatcgccctctgtggcagactcagtgctgtgtggcgcctcctcagcccagggctgagttttaagattttctctcctttcctcttctcctttggttcctcaattaaaaaatgtgtgtatatttgtttgtcaggcgttgtgttgaggagcagttcacgcactggctgtgtctattcctctgcccaggtgtctctgtttgctgcccaaggcagcagttcatgtctcgtccatgtccatgttcgtgttagcacttacgtgggaacaaataccaatttgtcttttctcctagtatcagtgtgtttaacaaattttaactttgtatatttgttatctatcaggctaatttttttatgaaaagaattttactctcctgcttcatttctttgtcttatagtcctccctctttgcaccttcttctcttccctcagtgcctggagctggtactgggcccctggccccatgagcagtttgccttcttgagtcactgcctgtgtagtacatacctgaccgggagtccaaaccaccttggtgctctgaagtccactgactcatcacacctttcttagcctggctcctctcaagggcattctgggcttgtaaacagacataggaagcctctgtttaccctgaagcaccactgtccagcccattggttcccactggcagcatggtagagctgagagaaacaggctctcagggtacctgacttgaggggaatcgtttcatgaagctgaacttcaagcatatttccagtacattctttcagagtctgtttttccatccaaatataagccccaggccattccacttagtgtcttttcaatgataggcaagaatgatatctgagttgaacttcggtgcttctgttgtttgagtttactgtgcctggtggtatattgggcattctttggattgagtgttctgaggtgagagagtcttcccgaggcatcctgtctgtgcttccaaccctgaacaagaccttacatgagagatggactgatggactgcggcaatcctgggctgtcaagtggatagatagttaaaaagcattatactgtgggtaatgaaaagggaggaaaaaaaaagaaggaaaaggaattatagacccccagggtcagccagttaagagctctacccacacctgtcaacccctctctcccccagtttaggttctgagcagtattggacttgtagcctgcagttgtcttttgacttgcaggccgcaggtgtctttctgttatgtgaatgagttccatggaggggcatatgtgtgattccaccgttagatgagcccttggggcaggcagtttgggatgtgctcttgggggaaagttggctgtttccttgcgctctgctcctacccgaaggtttttaagtccctctgaattgctcatctgagattagtagagtagcaggcctgaaggatgatggttttgtcctctttggttctcacctgcttgagaagtaaaacagtaactttgttcttctgggcccttaagcttttttggttaagtcttccttttcagaagtagatgtcattatatgccaaaagtctagctctttgctttaccatacagggacctgtcccaaagaaaaaggctctttttttagccagcatatttccccttctacccttttactttgttgttctgattttaggactctggctggccatgtgcttgtggttgcctctcctgcatttgccactggatttgcactgcatcgtttggagatacaaagcgagcagttcttggtcagaaccctcctctgcttttcattgtgtttgataatggttactgggtccttctctcaagggtagcaaggccaagctgatggctgcttgtttaggaggccatcagttccttcctgtggagaagggtctgaaatggaagtcagtggtagaaggggctggtctgctgggcagggcttacatccactgagttctaagattcctttcctgatctgcacctacgcctggtctgtatggtggaatttgtcagctggaactcagaaacaacaacttgaaaaaaaaataataattagaacatatttgcataagatagctatttactctggaaaccaacaacttttgagatttcccttgccctgtggacgcccagctcctgtcatccttccttaggtcctgcagtacagtcttcccctgaatgccaccggggacccagggggactccacccccctaagcaagcacacacatactcacagttgatgagttgctggtctttgagtcccagctctcttaccctccctttactccaccagcccgacgacccatgactgaggaggggatttctacagtctcaggatttagaaagtctgtaagccatccatgctccagaaagcaccgatctgttgtagttgcaaaaacaactctgtaatttgttgaggttctcaaactgacagccagcgagactgggtgggaggccctggatctgttctccctgactgcgggaggagcagccactaggactttagcaggaagcccacatggaggctccgccaggctgtggcccagctggtgatggcccttttgctcctggcagcctgaggcacagctgcctgtattgtcctcatctgttctgactgaaggatggaggtgctgaataaattaggcctcaggcctctaccaccagagagctggagaatgggtccacgtcattcaaggacctgaattttttatgctcaggagcattggaatcctcttcttccagggaggaattagcctgcaaggttaggacttgaagagggaaggtatttaataactgggcgaggatgggtgtggtggctcacacctgtaatcccagcattttgggaggctgaggtggccagatcccaaggtcagaagatcgagaccatcctggctaacatggtgaaaccccatctctactaaaaatacaaaaaaaaattagccgggggtggtggcgggtacctgtagtcctagctacttgggaggctgaggcaggagaatggcgtgaacctgggaggtggagcttgcagtgagccaagatcgtgccactgcactccagcctgggcgacagagcaagactccgtctcaaaaaataaaaaaaaaaaaaaaataggtgaaaattccttataaatccaggattggctctgagagaactggctaagattcaggaagaaacaaaaaattcagaatcctacaaggttttgatgacaattagggccaaaattttaggaggagatgtaggatgcaggagaaaattaaagtgttttctttatatcagaggaggaaatagtagaggtcagtgaaggtctggggtagggaaacattcagactgtccattgcatggctgtggagtgagactgcccttagcctgggtcagccttcctgggccataaattgggcatccgtgatgctaggtaactgtgggaacaaaatgacagcttagagcagccatgggtgatgtttggtggtaaaaaacctacaggcgtttggggtcccatgattgttccagaccatgactcttcctggttgtgggtttgttacagagcaggagaagcagaggttatgacagttatgcagactttccccctcctttttctcttttctcttccccttgcttttccactgtttcttcctgctgccacctgggccttgaattcctgggctgtgaagacatgtagcagctgcagggtttaccacacgtgggagggcagcccagtactgtccctctgccttccccactttgagaatatggcagcccctttcattcctggcttggggtaggggagaccattgaagtagaagcctcaaagcagacttttccctttactgtgtgtactccaggacgaagaaggaagatcatgcttgatacttagattggttttcccagggaagagggcggagcagagcaaagtcactgtgaaccctgggccaggccctggctgggccagctcctgagagcgtctcgtgttgcagacccttgcccacttcacccacctgcaccttctccccctctcacagtgtcactgctgctaatggtcaaagtcaaatgtgtggccacatgggatgggccaggtcctctcaggctactttctggatgtcatttttaaaatatggaaacatgcaggtgccttcccaaagaggcttggactggtatatccaacgagaaacaaataagctaaagaaagtttaaactcaagaagaaagatgttgacagtctatgtaacagctggaaagtttataggcacccacctttgggacaacccagtgattatgaacatgtgatatctactatttaaaagaaatgttctcaccttgggttgattgtggtataccatgtgttatgaaaattgttgagctgaagctttgaatcgatttagttgagtctgactcacttgctttggttcctgtgtattttactacccctcttgtcagtgaccttccttccccaccccacccagagtgaatttgtagcatgattgtataaacctctatgtagaaaatggagatttcttgctctgaaatgttaagctctaactgatccatttctgtgtcctttagcctagtatgtctgaacttccattcttgttatatatttaaactttccctctatattataggttttgtggcatccacggtcaggtgtagaggaagctgccccttgcagaactgtactgtaatatttttcttttataaatattttcacaggactgattgtacacagggcttgtaataaaattttaacactgtgctgtgaaacaactatggggaatctccattgaaggctacttcatgggcacctgaaagtggagtgttatagctatgactttctatttcttgtttcctaagtaaattaaacctaattttcaccctttcattctgtttcagcctcctgtataagaagtaccgtattttctgcccatcatactttgtaataaaacttgaacatgta

SEQ ID NO: 95816 - DNA, 5613 bp, Homo sapiens
  misc_feature (5592)..(5592): n is a, c, g, or t
ttccgagagggcggggcggcgtcccaaaacggaaggtggttgtcgtccgttcccaagctggtttgaaactaggggtcgggctcggccgtcgtcgttgtttgtcgccgcatccccgcttccgggttaggccgttcctgcccgccccctcctctcctcccttcggacccatagatctcaggctcggctccccgcccgccgcagcccactgttgacccggcccgtactgcggccccgtggccaccatgtccctgcacggcaaacggaaggagatctacaagtatgaagcgccctggacagtctacgcgatgaactggagtgtgcggcccgataagcgctttcgcttggcgctgggcagcttcgtggaggagtacaacaacaaggttcagcttgttggtttagatgaggagagttcagagtttatttgcagaaacacctttgaccacccataccccaccacaaagctcatgtggatccctgacacaaaaggcgtctatccagacctactggcaacaagcggtgactatctccgtgtgtggagggttggtgaaacagagaccaggctggagtgtttgctaaacaataataagaactctgatttctgtgctcccctgacctcctttgactggaatgaggtggatccttatcttttaggtacctcaagcattgatacgacatgcaccatctgggggctggagacagggcaggtgttagggcgagtgaatctcgtgtctggccacgtgaagacccagctgatcgcccatgacaaagaggtctatgatattgcatttagccgggccgggggtggcagggacatgtttgcctctgtgggtgctgatggctcggtgcggatgtttgacctccgccatctagaacacagcaccatcatttacgaagacccacagcatcacccactgcttcgcctctgctggaacaagcaggaccctaactacctggccaccatggccatggatggaatggaggtggtgattctagatgtccgggttccctgcacacctgtcgccaggttaaacaaccatcgagcatgtgtcaatggcattgcttgggccccacattcatcctgccacatctgcactgcagcggatgaccaccaggctctcatctgggacatccagcaaatgccccgagccattgaggaccctatcctggcctacacagctgaaggagagatcaacaatgtgcagtgggcatcaactcagcccgactggatcgccatctgctacaacaactgcctggagatactcagagtgtagtgttggtggcgctgtgcccacgaggcaggggcttttgtatttcctgcctctgccccacccccaaagtaagaagaaacatgtttccagtggccagtatgtctttcattgctttgcacccactgttaccagaagctgctctaggagttcctggccagtcaccccatcgccctctgtggcagactcagtgctgtgtggcgcctcctcagcccagggctgagttttaagattttctctcctttcctcttctcctttggttcctcaattaaaaaatgtgtgtatatttgtttgtcaggcgttgtgttgaggagcagttcacgcactggctgtgtctattcctctgcccaggtgtctctgtttgctgcccaaggcagcagttcatgtctcgtccatgtccatgttcgtgttagcacttacgtgggaacaaataccaatttgtcttttctcctagtatcagtgtgtttaacaaattttaactttgtatatttgttatctatcaggctaatttttttatgaaaagaattttactctcctgcttcatttctttgtcttatagtcctccctctttgcaccttcttctcttccctcagtgcctggagctggtactgggcccctggccccatgagcagtttgccttcttgagtcactgcctgtgtagtacatacctgaccgggagtccaaaccaccttggtgctctgaagtccactgactcatcacacctttcttagcctggctcctctcaagggcattctgggcttgtaaacagacataggaagcctctgtttaccctgaagcaccactgtccagcccattggttcccactggcagcatggtagagctgagagaaacaggctctcagggtacctgacttgaggggaatcgtttcatgaagctgaacttcaagcatatttccagtacattctttcagagtctgtttttccatccaaatataagccccaggccattccacttagtgtcttttcaatgataggcaagaatgatatctgagttgaacttcggtgcttctgttgtttgagtttactgtgcctggtggtatattgggcattctttggattgagtgttctgaggtgagagagtcttcccgaggcatcctgtctgtgcttccaaccctgaacaagaccttacatgagagatggactgatggactgcggcaatcctgggctgtcaagtggatagatagttaaaaagcattatactgtgggtaatgaaaagggaggaaaaaaaaagaaggaaaaggaattatagacccccagggtcagccagttaagagctctacccacacctgtcaacccctctctcccccagtttaggttctgagcagtattggacttgtagcctgcagttgtcttttgacttgcaggccgcaggtgtctttctgttatgtgaatgagttccatggaggggcatatgtgtgattccaccgttagatgagcccttggggcaggcagtttgggatgtgctcttgggggaaagttggctgtttccttgcgctctgctcctacccgaaggtttttaagtccctctgaattgctcatctgagattagtagagtagcaggcctgaaggatgatggttttgtcctctttggttctcacctgcttgagaagtaaaacagtaactttgttcttctgggcccttaagcttttttggttaagtcttccttttcagaagtagatgtcattatatgccaaaagtctagctctttgctttaccatacagggacctgtcccaaagaaaaaggctctttttttagccagcatatttccccttctacccttttactttgttgttctgattttaggactctggctggccatgtgcttgtggttgcctctcctgcatttgccactggatttgcactgcatcgtttggagatacaaagcgagcagttcttggtcagaaccctcctctgcttttcattgtgtttgataatggttactgggtccttctctcaagggtagcaaggccaagctgatggctgcttgtttaggaggccatcagttccttcctgtggagaagggtctgaaatggaagtcagtggtagaaggggctggtctgctgggcagggcttacatccactgagttctaagattcctttcctgatctgcacctacgcctggtctgtatggtggaatttgtcagctggaactcagaaacaacaacttgaaaaaaaaataataattagaacatatttgcataagatagctatttactctggaaaccaacaacttttgagatttcccttgccctgtggacgcccagctcctgtcatccttccttaggtcctgcagtacagtcttcccctgaatgccaccggggacccagggggactccacccccctaagcaagcacacacatactcacagttgatgagttgctggtctttgagtcccagctctcttaccctccctttactccaccagcccgacgacccatgactgaggaggggatttctacagtctcaggatttagaaagtctgtaagccatccatgctccagaaagcaccgatctgttgtagttgcaaaaacaactctgtaatttgttgaggttctcaaactgacagccagcgagactgggtgggaggccctggatctgttctccctgactgcgggaggagcagccactaggactttagcaggaagcccacatggaggctccgccaggctgtggcccagctggtgatggcccttttgctcctggcagcctgaggcacagctgcctgtattgtcctcatctgttctgactgaaggatggaggtgctgaataaattaggcctcaggcctctaccaccagagagctggagaatgggtccacgtcattcaaggacctgaattttttatgctcaggagcattggaatcctcttcttccagggaggaattagcctgcaaggttaggacttgaagagggaaggtatttaataactgggcgaggatgggtgtggtggctcacacctgtaatcccagcattttgggaggctgaggtggccagatcccaaggtcagaagatcgagaccatcctggctaacatggtgaaaccccatctctactaaaaatacaaaaaaaaattagccgggggtggtggcgggtacctgtagtcctagctacttgggaggctgaggcaggagaatggcgtgaacctgggaggtggagcttgcagtgagccaagatcgtgccactgcactccagcctgggcgacagagcaagactccgtctcaaaaaataaaaaaaaaaaaaaaataggtgaaaattccttataaatccaggattggctctgagagaactggctaagattcaggaagaaacaaaaaattcagaatcctacaaggttttgatgacaattagggccaaaattttaggaggagatgtaggatgcaggagaaaattaaagtgttttctttatatcagaggaggaaatagtagaggtcagtgaaggtctggggtagggaaacattcagactgtccattgcatggctgtggagtgagactgcccttagcctgggtcagccttcctgggccataaattgggcatccgtgatgctaggtaactgtgggaacaaaatgacagcttagagcagccatgggtgatgtttggtggtaaaaaacctacaggcgtttggggtcccatgattgttccagaccatgactcttcctggttgtgggtttgttacagagcaggagaagcagaggttatgacagttatgcagactttccccctcctttttctcttttctcttccccttgcttttccactgtttcttcctgctgccacctgggccttgaattcctgggctgtgaagacatgtagcagctgcagggtttaccacacgtgggagggcagcccagtactgtccctctgccttccccactttgagaatatggcagcccctttcattcctggcttggggtaggggagaccattgaagtagaagcctcaaagcagacttttccctttactgtgtgtactccaggacgaagaaggaagatcatgcttgatacttagattggttttcccagggaagagggcggagcagagcaaagtcactgtgaaccctgggccaggccctggctgggccagctcctgagagcgtctcgtgttgcagacctgccatttacactgactttccccttaaagtgtatgtgtaatgtcaagttatgtggggccatgatggagggcctaggtaatggagtatttaattggaaggggtgttccaaagggggtgttcaaggaagtgtaaggtaatcaaaagtggggtgtgaggagttgcctggacggttaagttaaaagcggggagggaaagtatgnaaggtgtttgagggatatgta

SEQ ID NO: 95817 - DNA, 1575 bp, Homo sapiens
ttccgagagggcggggcggcgtcccaaaacggaaggtggttgtcgtccgttcccaagctggtttgaaactaggggtcgggctcggccgtcgtcgttgtttgtcgccgcatccccgcttccgggttaggccgttcctgcccgccccctcctctcctcccttcggacccatagatctcaggctcggctccccgcccgccgcagcccactgttgacccggcccgtactgcggccccgtggccaccatgtccctgcacggcaaacggaaggagatctacaagtatgaagcgccctggacagtctacgcgatgaactggagtgtgcggcccgataagcgctttcgcttggcgctgggcagcttcgtggaggagtacaacaacaaggttcagcttgttggtttagatgaggagagttcagagtttatttgcagaaacacctttgaccacccataccccaccacaaagctcatgtggatccctgacacaaaaggcgtctatccagacctactggcaacaagcggtgactatctccgtgtgtggagggttggtgaaacagagaccaggctggagtgtttgctaaacaataataagaactctgatttctgtgctcccctgacctcctttgactggaatgaggtggatccttatcttttaggtacctcaagcattgatacgacatgcaccatctgggggctggagacagggcaggtgttagggcgagtgaatctcgtgtctggccacgtgaagacccagctgatcgcccatgacaaagaggtctatgatattgcatttagccgggccgggggtggcagggacatgtttgcctctgtgggtgctgatggctcggtgcggatgtttgacctccgccatctagaacacagcaccatcatttacgaagacccacagcatcacccactgcttcgcctctgctggaacaagcaggaccctaactacctggccaccatggccatggatggaatggaggtggtgattctagatgtccgggttccctgcacacctgtcgccaggttaaacaaccatcgagcatgtgtcaatggcattgcttgggccccacattcatcctgccacatctgcactgcagcggatgaccaccaggctctcatctgggacatccagcaaatgccccgagccattgaggaccctatcctggcctacacagctgaaggagagatcaacaatgtgcagtgggcatcaactcagcccgactggatcgccatctgctacaacaactgcctggagatactcagagtgtagtgttggtggcgctgtgcccacgaggcaggggcttttgtatttcctgcctctgccccacccccaaacctcctgtataagaagtaccgtattttctgcccatcatactttgtaataaaacttgaacatgtaaaaacagaaacaaataaagacacacaacaaaaaaaacaaacgggggcgtgccgccaatagaaatacacccagggccccagtgactacacgtccccgttttttttgataaagaggacccaaaaagggagccagaaaaacaacaccggccccgtttcaaacgctaactgggaaaatg

SEQ ID NO: 95818 - DNA, 1757 bp, Homo sapiens
ttccgagagggcggggcggcgtcccaaaacggaaggtggttgtcgtccgttcccaagctggtttgaaactaggggtcgggctcggccgtcgtcgttgtttgtcgccgcatccccgcttccgggttaggccgttcctgcccgccccctcctctcctcccttcggacccatagatctcaggctcggctccccgcccgccgcagcccactgttgacccggcccgtactgcggccccgtggccaccatgtccctgcacggcaaacggaaggagatctacaagtatgaagcgccctggacagtctacgcgatgaactggagtgtgcggcccgataagcgctttcgcttggcgctgggcagcttcgtggaggagtacaacaacaaggttcagcttgttggtttagatgaggagagttcagagtttatttgcagaaacacctttgaccacccataccccaccacaaagctcatgtggatccctgacacaaaaggcgtctatccagacctactggcaacaagcggtgactatctccgtgtgtggagggttggtgaaacagagaccaggctggagtgtttgctaaacaataataagaactctgatttctgtgctcccctgacctcctttgactggaatgaggtggatccttatcttttaggtacctcaagcattgatacgacatgcaccatctgggggctggagacagggcaggtgttagggcgagtgaatctcgtgtctggccacgtgaagacccagctgatcgcccatgacaaagaggtctatgatattgcatttagccgggccgggggtggcagggacatgtttgcctctgtgggtgctgatggctcggtgcggatgtttgacctccgccatctagaacacagcaccatcatttacgaagacccacagcatcacccactgcttcgcctctgctggaacaagcaggaccctaactacctggccaccatggccatggatggaatggaggtggtgattctagatgtccgggttccctgcacacctgtcgccaggttaaacaaccatcgagcatgtgtcaatggcattgcttgggccccacattcatcctgccacatctgcactgcaggtaatcatggtggggagaaagaaatctgggaaggatggaggaaatctgttctcttggctccttagaattgtagttgttactgttttctaagcacagtcttgagagatttatacaaaatgactagttggagcctctccacacttgtgaaattcaatcagtacaaatttttagacgatcttgtaccctcatggacatcagaacatcttccatatatgatttacatcatgtgtcagttatagggctgtgccttgtactgtgcccctgaaatctggatggcacagaggactcaattccaggaatatggggaaagggaggcatccctcatggatataacagaatctttgggactgtgaagatcaacatctccatgggacctttcaggtttcactataacaaacccacagtgtgctctggatgcatcggagggccccacagaactttgcctggttgtggtttgtgacttgtggttttcatttcactgtttcccagaccaaagctagcaccccttacgggctgggtgcagtggcacgcacctgtagtccaagctacttaggaggctgaggcaggagaagcacttcaacccaggaggtggaggttgcattgaccagagattatgccactgccctccagccagggcaacagagcaagactctgtctcc

SEQ ID NO: 95819 - DNA, 3015 bp, Homo sapiens
  misc_feature (2583)..(2583): n is a, c, g, or t
  misc_feature (2585)..(2585): n is a, c, g, or t
gaggggcgggggcggagacagtgggcgggggcgggcgggggcgctgtgaggcccggagggggtgtgtgcggggggccggaggcggcggctgtcagagtcggctcagcctgcgccggggaacatcggccgcctccagctcccggcgcggcccggcccggcccggctcggccgcctcagacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtgctggtgggtgtggtgaaggatgagggctcgtattttctggtttacggggccccaggcttcagcaaagacaacgagtctctcatcagccgggccgagttcctggccggggtgcgggtcggggttccccaggtaagtgacctggcagccgaggctgtggtcctgcattacacagactggctgcatcccgaggacccggcacgcctgagggaggccctgagcgatgtggtgggcgaccacaatgtcgtgtgccccgtggcccagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgcctcggaggctcccagcacctgcccaggcttcacccatggggaggctgctccgaggcccggcctccccctgcccctcctcctcctccaccagcttctcctcctcttcctctcccacctccggcggctgtgaacacggcctcttcccctacggccacaggggcccctcctctaatgagtggtcggaccgtggggaagggccccactcagggatctcagacctagtgctcccttcctcctcaaaccgagagactcacactggacagggcaggaggagggggccgtgcctcccacccttctcagggacccccacgcctttgttgtttgaatggaaatggaaaagccagtattcttttataaaattatcttttggaacctgagcctgacattggggggaagtgggaggccccggacggggtagcaccccccattggggctataacggtcaaccatttctgtctcttctttttcccccaacctccccctcctgtcccctctgttcccgtcttccggtcattcttttctcctcctctctccttcctgctgtccttctccggccccgcctctgccctcatcctccctctcgtctttcgcacattctcctgatcctcttgccaccgtcccacgtggtcgcctgcatttctccgtgcgtcctccctgcactnanacccccccttcaacccgcccaaatgtccgatccccgaccttcctcgtgccgtcctcccctcccgcctcgctgggcgccctggccgcagacacgctcgacgaggcggagcgccagtggaaggccgagttccaccgctggagctcctacatggtgcactggaagaaccagttcgaccactacagcaagcaggatcgctgctcagacctgtgaccccggcgggacccccatgtcctccgctccgcccggccccctagctgtatatactatttatttcagggctgggctataacacagacgagccccagactctgcccatccccaccccaccccgacgtcccccggggctcccggtcctctgcatgtctcaggctgagctccctcccccgcggtgccttcgcccctctgggctgccaataaactgttacaggcc

SEQ ID NO: 95820 - DNA, 2262 bp, Homo sapiens
gaggggcgggggcggagacagtgggcgggggcgggcgggggcgctgtgaggcccggagggggtgtgtgcggggggccggaggcggcggctgtcagagtcggctcagcctgcgccggggaacatcggccgcctccagctcccggcgcggcccggcccggcccggctcggccgcctcagacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtgctggtgggtgtggtgaaggatgagggctcgtattttctggtttacggggccccaggcttcagcaaagacaacgagtctctcatcagccgggccgagttcctggccggggtgcgggtcggggttccccaggtaagtgacctggcagccgaggctgtggtcctgcattacacagactggctgcatcccgaggacccggcacgcctgagggaggccctgagcgatgtggtgggcgaccacaatgtcgtgtgccccgtggcccagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgacacgctcgacgaggcggagcgccagtggaaggccgagttccaccgctggagctcctacatggtgcactggaagaaccagttcgaccactacagcaagcaggatcgctgctcagacctgtgaccccggcgggacccccatgtcctccgctccgcccggccccctagctgtatatactatttatttcagggctgggctataacacagacgagccccagactctgcccatccccaccccaccccgacgtcccccggggctcccggtcctctgcatgtctcaggctgagctccctcccccgcggtgccttcgcccctctgggctgccaataaactgttacaggcc

SEQ ID NO: 95821 - DNA, 2221 bp, Homo sapiens
ctctcccctcatctttgccaacctgccccacctcctctgcagctgagcgataacccttgggccgacagtgccctaatctcctccctcctggcttctcgaccgacccttcaccctttccctttctttctcccagcagacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtgctggtgggtgtggtgaaggatgagggctcgtattttctggtttacggggccccaggcttcagcaaagacaacgagtctctcatcagccgggccgagttcctggccggggtgcgggtcggggttccccaggtaagtgacctggcagccgaggctgtggtcctgcattacacagactggctgcatcccgaggacccggcacgcctgagggaggccctgagcgatgtggtgggcgaccacaatgtcgtgtgccccgtggcccagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgacacgctcgacgaggcggagcgccagtggaaggccgagttccaccgctggagctcctacatggtgcactggaagaaccagttcgaccactacagcaagcaggatcgctgctcagacctgtgaccccggcgggacccccatgtcctccgctccgcccggccccctagctgtatatactatttatttcagggctgggctataacacagacgagccccagactctgcccatccccaccccaccccgacgtcccccggggctcccggtcctctgcatgtctcaggctgagctccctcccccgcggtgccttcgcccctctgggctgccaataaactgttacaggcc

SEQ ID NO: 95822 - DNA, 2608 bp, Homo sapiens
gaggggcgggggcggagacagtgggcgggggcgggcgggggcgctgtgaggcccggagggggtgtgtgcggggggccggaggcggcggctgtcagagtcggctcagcctgcgccggggaacatcggccgcctccagctcccggcgcggcccggcccggcccggctcggccgcctcagacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtaactagtggctagctggcgtgaagctggctcctctgggtcccaacggtccctcccctccctgcagggacccaggcatgagggcttctccaggcccattcccagaagtcccagaagtcctccctgagggctcagatcccagggtggtcagcagggcagacaggaaagccaccatgggtctattttctctttctctgcatccctcccctgatctcgtcctctctctgtccatggttccgggtctgtaactgttcatctctctggctctttgtctgtccatctgtttctgtctacttgtctgtctgtgcctgtcgctccatcccacccccctctccctcacccccaggtgctggtgggtgtggtgaaggatgagggctcgtattttctggtttacggggccccaggcttcagcaaagacaacgagtctctcatcagccgggccgagttcctggccggggtgcgggtcggggttccccaggtaagtgacctggcagccgaggctgtggtcctgcattacacagactggctgcatcccgaggacccggcacgcctgagggaggccctgagcgatgtggtgggcgaccacaatgtcgtgtgccccgtggcccagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgacacgctcgacgaggcggagcgccagtggaaggccgagttccaccgctggagctcctacatggtgcactggaagaaccagttcgaccactacagcaagcaggatcgctgctcagacctgtgaccccggcgggacccccatgtcctccgctccgcccggccccctagctgtatatactatttatttcagggctgggctataacacagacgagccccagactctgcccatccccaccccaccccgacgtcccccggggctcccggtcctctgcatgtctcaggctgagctccctcccccgcggtgccttcgcccctctgggctgccaataaactgttacaggcc

SEQ ID NO: 95823 - DNA, 3321 bp, Homo sapiens
  misc_feature (2889)..(2889): n is a, c, g, or t
  misc_feature (2891)..(2891): n is a, c, g, or t
gaggggcgggggcggagacagtgggcgggggcgggcgggggcgctgtgaggcccggagggggtgtgtgcggggggccggaggcggcggctgtcagagtcggctcagcctgcgccggggaacatcggccgcctccagctcccggcgcggcccggcccggcccggctcggccgcctcagacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtaactagtggctagctggcgtgaagctggctcctctgggtcccaacggtccctcccctccctgcagggacccaggcatgagggcttctccaggcccattcccagaagtcccagaagtcctccctgagggctcagatcccagggtggtcagcagggcagacaggaaagccaccatgggtctattttctctttctctgcatccctcccctgatctcgtcctctctctgtccatggttccgggtctgtaactgttcatctctctggctctttgtctgtccatctgtttctgtctacttgtctgtctgtgcctgtcgctccatcccacccccctctccctcacccccaggtgctggtgggtgtggtgaaggatgagggctcgtattttctggtttacggggccccaggcttcagcaaagacaacgagtctctcatcagccgggccgagttcctggccggggtgcgggtcggggttccccaggtaagtgacctggcagccgaggctgtggtcctgcattacacagactggctgcatcccgaggacccggcacgcctgagggaggccctgagcgatgtggtgggcgaccacaatgtcgtgtgccccgtggcccagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgcctcggaggctcccagcacctgcccaggcttcacccatggggaggctgctccgaggcccggcctccccctgcccctcctcctcctccaccagcttctcctcctcttcctctcccacaggggcccctcctctaatgagtggtcggaccgtggggaagggccccactcagggatctcagacctagtgctcccttcctcctcaaaccgagagactcacactggacagggcaggaggagggggccgtgcctcccacccttctcagggacccccacgcctttgttgtttgaatggaaatggaaaagccagtattcttttataaaattatcttttggaacctgagcctgacattggggggaagtgggaggccccggacggggtagcaccccccattggggctataacggtcaaccatttctgtctcttctttttcccccaacctccccctcctgtcccctctgttcccgtcttccggtcattcttttctcctcctctctccttcctgctgtccttctccggccccgcctctgccctcatcctccctctcgtctttcgcacattctcctgatcctcttgccaccgtcccacgtggtcgcctgcatttctccgtgcgtcctccctgcactnanacccccccttcaacccgcccaaatgtccgatccccgaccttcctcgtgccgtcctcccctcccgcctcgctgggcgccctggccgcagacacgctcgacgaggcggagcgccagtggaaggccgagttccaccgctggagctcctacatggtgcactggaagaaccagttcgaccactacagcaagcaggatcgctgctcagacctgtgaccccggcgggacccccatgtcctccgctccgcccggccccctagctgtatatactatttatttcagggctgggctataacacagacgagccccagactctgcccatccccaccccaccccgacgtcccccggggctcccggtcctctgcatgtctcaggctgagctccctcccccgcggtgccttcgcccctctgggctgccaataaactgttacaggcc

SEQ ID NO: 95824 - DNA, 2455 bp, Homo sapiens
ctccaggaagcaggcgccgcgcggtattgccgcatgcacctcggtcgtggggaccccgctgcagcagccctgtccacacgggtgaactcctggagggcggggcggggggcaatctgcgcgggtcaggcccctcggagcaggctgggggcgcccgagccaggccgctcccacctgccagccgcgtggccaatgaatgctaggcctggtgatgtcatgccccgaccggaccctggtgacgaaagtccgaagtcacccgtcagggaaccagcacagacccacccgcgggggttccagaagtttccactgccgccgcggagtgcgcctcgcccagcagccttgcgcgtgctaccacgctgtcctgccttctcagacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtgctggtgggtgtggtgaaggatgagggctcgtattttctggtttacggggccccaggcttcagcaaagacaacgagtctctcatcagccgggccgagttcctggccggggtgcgggtcggggttccccaggtaagtgacctggcagccgaggctgtggtcctgcattacacagactggctgcatcccgaggacccggcacgcctgagggaggccctgagcgatgtggtgggcgaccacaatgtcgtgtgccccgtggcccagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgacacgctcgacgaggcggagcgccagtggaaggccgagttccaccgctggagctcctacatggtgcactggaagaaccagttcgaccactacagcaagcaggatcgctgctcagacctgtgaccccggcgggacccccatgtcctccgctccgcccggccccctagctgtatatactatttatttcagggctgggctataacacagacgagccccagactctgcccatccccaccccaccccgacgtcccccggggctcccggtcctctgcatgtctcaggctgagctccctcccccgcggtgccttcgcccctctgggctgccaataaactgttacaggcc

SEQ ID NO: 95825 - DNA, 2125 bp, Homo sapiens
tgtcactgcgctctgtcgtcggtcggcgtctggcactggaacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtgctggtgggtgtggtgaaggatgagggctcgtattttctggtttacggggccccaggcttcagcaaagacaacgagtctctcatcagccgggccgagttcctggccggggtgcgggtcggggttccccaggtaagtgacctggcagccgaggctgtggtcctgcattacacagactggctgcatcccgaggacccggcacgcctgagggaggccctgagcgatgtggtgggcgaccacaatgtcgtgtgccccgtggcccagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgacacgctcgacgaggcggagcgccagtggaaggccgagttccaccgctggagctcctacatggtgcactggaagaaccagttcgaccactacagcaagcaggatcgctgctcagacctgtgaccccggcgggacccccatgtcctccgctccgcccggccccctagctgtatatactatttatttcagggctgggctataacacagacgagccccagactctgcccatccccaccccaccccgacgtcccccggggctcccggtcctctgcatgtctcaggctgagctccctcccccgcggtgccttcgcccctctgggctgccaataaactgttacaggcc

SEQ ID NO: 95826 - DNA, 1059 bp, Homo sapiens
ctaaaattagaacgatacagagaagattagcatggcccctgcgcgacttccacggcctgcaggtgctggtgggtgtggtgaaggatgagggctcgtattttctggtttacggggccccaggcttcagcaaagacaacgagtctctcatcagccgggccgagttcctggccggggtgcgggtcggggttccccaggtaagtgacctggcagccgaggctgtggtcctgcattacacagactggctgcatcccgaggacccggcacgcctgagggaggccctgagcgatgtggtgggcgaccacaatgtcgtgtgccccgtggcccagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgacacgctcgacgaggcggagcgccagtggaaggccgagttccaccgctggagctcctacatggtgcactggaagaaccagttcgaccactacagcaagcaggatcgctgctcagacctgtgaccccggcgggacccccatgtcctccgctccgcccggccccctagctgtatatactatttatttcagggctgggctataacacagacgagccccagactctgcccatccccaccccaccccgacgtcccccggggctcccggtcctctgcatgtctcaggctgagctccctcccccgcggtgccttcgcccctctgggctgccaataaactgttacaggcc

SEQ ID NO: 95827 - DNA, 10999 bp, Homo sapiens
gcgcgggcttgtggcgcgagcttctgaaactaggcggcagaggcggagccgctgtggcactgctgcgcctctgctgcgcctcgggtgtcttttgcggcggtgggtcgccgccgggagaagcgtgaggggacagatttgtgaccggcgcggtttttgtcagcttactccggccaaaaaagaactgcacctctggagcggacttatttaccaagcattggaggaatatcgtaggtaaaaatgcctattggatccaaagagaggccaacattttttgaaatttttaagacacgctgcaacaaagcagatttaggaccaataagtcttaattggtttgaagaactttcttcagaagctccaccctataattctgaacctgcagaagaatctgaacataaaaacaacaattacgaaccaaacctatttaaaactccacaaaggaaaccatcttataatcagctggcttcaactccaataatattcaaagagcaagggctgactctgccgctgtaccaatctcctgtaaaagaattagataaattcaaattagacttaggaaggaatgttcccaatagtagacataaaagtcttcgcacagtgaaaactaaaatggatcaagcagatgatgtttcctgtccacttctaaattcttgtcttagtgaaagtcctgttgttctacaatgtacacatgtaacaccacaaagagataagtcagtggtatgtgggagtttgtttcatacaccaaagtttgtgaagggtcgtcagacaccaaaacatatttctgaaagtctaggagctgaggtggatcctgatatgtcttggtcaagttctttagctacaccacccacccttagttctactgtgctcatagtcagaaatgaagaagcatctgaaactgtatttcctcatgatactactgctaatgtgaaaagctatttttccaatcatgatgaaagtctgaagaaaaatgatagatttatcgcttctgtgacagacagtgaaaacacaaatcaaagagaagctgcaagtcatggatttggaaaaacatcagggaattcatttaaagtaaatagctgcaaagaccacattggaaagtcaatgccaaatgtcctagaagatgaagtatatgaaacagttgtagatacctctgaagaagatagtttttcattatgtttttctaaatgtagaacaaaaaatctacaaaaagtaagaactagcaagactaggaaaaaaattttccatgaagcaaacgctgatgaatgtgaaaaatctaaaaaccaagtgaaagaaaaatactcatttgtatctgaagtggaaccaaatgatactgatccattagattcaaatgtagcacatcagaagccctttgagagtggaagtgacaaaatctccaaggaagttgtaccgtctttggcctgtgaatggtctcaactaaccctttcaggtctaaatggagcccagatggagaaaatacccctattgcatatttcttcatgtgaccaaaatatttcagaaaaagacctattagacacagagaacaaaagaaagaaagattttcttacttcagagaattctttgccacgtatttctagcctaccaaaatcagagaagccattaaatgaggaaacagtggtaaataagagagatgaagagcagcatcttgaatctcatacagactgcattcttgcagtaaagcaggcaatatctggaacttctccagtggcttcttcatttcagggtatcaaaaagtctatattcagaataagagaatcacctaaagagactttcaatgcaagtttttcaggtcatatgactgatccaaactttaaaaaagaaactgaagcctctgaaagtggactggaaatacatactgtttgctcacagaaggaggactccttatgtccaaatttaattgataatggaagctggccagccaccaccacacagaattctgtagctttgaagaatgcaggtttaatatccactttgaaaaagaaaacaaataagtttatttatgctatacatgatgaaacattttataaaggaaaaaaaataccgaaagaccaaaaatcagaactaattaactgttcagcccagtttgaagcaaatgcttttgaagcaccacttacatttgcaaatgctgattcaggtttattgcattcttctgtgaaaagaagctgttcacagaatgattctgaagaaccaactttgtccttaactagctcttttgggacaattctgaggaaatgttctagaaatgaaacatgttctaataatacagtaatctctcaggatcttgattataaagaagcaaaatgtaataaggaaaaactacagttatttattaccccagaagctgattctctgtcatgcctgcaggaaggacagtgtgaaaatgatccaaaaagcaaaaaagtttcagatataaaagaagaggtcttggctgcagcatgtcacccagtacaacattcaaaagtggaatacagtgatactgactttcaatcccagaaaagtcttttatatgatcatgaaaatgccagcactcttattttaactcctacttccaaggatgttctgtcaaacctagtcatgatttctagaggcaaagaatcatacaaaatgtcagacaagctcaaaggtaacaattatgaatctgatgttgaattaaccaaaaatattcccatggaaaagaatcaagatgtatgtgctttaaatgaaaattataaaaacgttgagctgttgccacctgaaaaatacatgagagtagcatcaccttcaagaaaggtacaattcaaccaaaacacaaatctaagagtaatccaaaaaaatcaagaagaaactacttcaatttcaaaaataactgtcaatccagactctgaagaacttttctcagacaatgagaataattttgtcttccaagtagctaatgaaaggaataatcttgctttaggaaatactaaggaacttcatgaaacagacttgacttgtgtaaacgaacccattttcaagaactctaccatggttttatatggagacacaggtgataaacaagcaacccaagtgtcaattaaaaaagatttggtttatgttcttgcagaggagaacaaaaatagtgtaaagcagcatataaaaatgactctaggtcaagatttaaaatcggacatctccttgaatatagataaaataccagaaaaaaataatgattacatgaacaaatgggcaggactcttaggtccaatttcaaatcacagttttggaggtagcttcagaacagcttcaaataaggaaatcaagctctctgaacataacattaagaagagcaaaatgttcttcaaagatattgaagaacaatatcctactagtttagcttgtgttgaaattgtaaataccttggcattagataatcaaaagaaactgagcaagcctcagtcaattaatactgtatctgcacatttacagagtagtgtagttgtttctgattgtaaaaatagtcatataacccctcagatgttattttccaagcaggattttaattcaaaccataatttaacacctagccaaaaggcagaaattacagaactttctactatattagaagaatcaggaagtcagtttgaatttactcagtttagaaaaccaagctacatattgcagaagagtacatttgaagtgcctgaaaaccagatgactatcttaaagaccacttctgaggaatgcagagatgctgatcttcatgtcataatgaatgccccatcgattggtcaggtagacagcagcaagcaatttgaaggtacagttgaaattaaacggaagtttgctggcctgttgaaaaatgactgtaacaaaagtgcttctggttatttaacagatgaaaatgaagtggggtttaggggcttttattctgctcatggcacaaaactgaatgtttctactgaagctctgcaaaaagctgtgaaactgtttagtgatattgagaatattagtgaggaaacttctgcagaggtacatccaataagtttatcttcaagtaaatgtcatgattctgttgtttcaatgtttaagatagaaaatcataatgataaaactgtaagtgaaaaaaataataaatgccaactgatattacaaaataatattgaaatgactactggcacttttgttgaagaaattactgaaaattacaagagaaatactgaaaatgaagataacaaatatactgctgccagtagaaattctcataacttagaatttgatggcagtgattcaagtaaaaatgatactgtttgtattcataaagatgaaacggacttgctatttactgatcagcacaacatatgtcttaaattatctggccagtttatgaaggagggaaacactcagattaaagaagatttgtcagatttaacttttttggaagttgcgaaagctcaagaagcatgtcatggtaatacttcaaataaagaacagttaactgctactaaaacggagcaaaatataaaagattttgagacttctgatacattttttcagactgcaagtgggaaaaatattagtgtcgccaaagagtcatttaataaaattgtaaatttctttgatcagaaaccagaagaattgcataacttttccttaaattctgaattacattctgacataagaaagaacaaaatggacattctaagttatgaggaaacagacatagttaaacacaaaatactgaaagaaagtgtcccagttggtactggaaatcaactagtgaccttccagggacaacccgaacgtgatgaaaagatcaaagaacctactctgttgggttttcatacagctagcgggaaaaaagttaaaattgcaaaggaatctttggacaaagtgaaaaacctttttgatgaaaaagagcaaggtactagtgaaatcaccagttttagccatcaatgggcaaagaccctaaagtacagagaggcctgtaaagaccttgaattagcatgtgagaccattgagatcacagctgccccaaagtgtaaagaaatgcagaattctctcaataatgataaaaaccttgtttctattgagactgtggtgccacctaagctcttaagtgataatttatgtagacaaactgaaaatctcaaaacatcaaaaagtatctttttgaaagttaaagtacatgaaaatgtagaaaaagaaacagcaaaaagtcctgcaacttgttacacaaatcagtccccttattcagtcattgaaaattcagccttagctttttacacaagttgtagtagaaaaacttctgtgagtcagacttcattacttgaagcaaaaaaatggcttagagaaggaatatttgatggtcaaccagaaagaataaatactgcagattatgtaggaaattatttgtatgaaaataattcaaacagtactatagctgaaaatgacaaaaatcatctctccgaaaaacaagatacttatttaagtaacagtagcatgtctaacagctattcctaccattctgatgaggtatataatgattcaggatatctctcaaaaaataaacttgattctggtattgagccagtattgaagaatgttgaagatcaaaaaaacactagtttttccaaagtaatatccaatgtaaaagatgcaaatgcatacccacaaactgtaaatgaagatatttgcgttgaggaacttgtgactagctcttcaccctgcaaaaataaaaatgcagccattaaattgtccatatctaatagtaataattttgaggtagggccacctgcatttaggatagccagtggtaaaatcgtttgtgtttcacatgaaacaattaaaaaagtgaaagacatatttacagacagtttcagtaaagtaattaaggaaaacaacgagaataaatcaaaaatttgccaaacgaaaattatggcaggttgttacgaggcattggatgattcagaggatattcttcataactctctagataatgatgaatgtagcacgcattcacataaggtttttgctgacattcagagtgaagaaattttacaacataaccaaaatatgtctggattggagaaagtttctaaaatatcaccttgtgatgttagtttggaaacttcagatatatgtaaatgtagtatagggaagcttcataagtcagtctcatctgcaaatacttgtgggatttttagcacagcaagtggaaaatctgtccaggtatcagatgcttcattacaaaacgcaagacaagtgttttctgaaatagaagatagtaccaagcaagtcttttccaaagtattgtttaaaagtaacgaacattcagaccagctcacaagagaagaaaatactgctatacgtactccagaacatttaatatcccaaaaaggcttttcatataatgtggtaaattcatctgctttctctggatttagtacagcaagtggaaagcaagtttccattttagaaagttccttacacaaagttaagggagtgttagaggaatttgatttaatcagaactgagcatagtcttcactattcacctacgtctagacaaaatgtatcaaaaatacttcctcgtgttgataagagaaacccagagcactgtgtaaactcagaaatggaaaaaacctgcagtaaagaatttaaattatcaaataacttaaatgttgaaggtggttcttcagaaaataatcactctattaaagtttctccatatctctctcaatttcaacaagacaaacaacagttggtattaggaaccaaagtctcacttgttgagaacattcatgttttgggaaaagaacaggcttcacctaaaaacgtaaaaatggaaattggtaaaactgaaactttttctgatgttcctgtgaaaacaaatatagaagtttgttctacttactccaaagattcagaaaactactttgaaacagaagcagtagaaattgctaaagcttttatggaagatgatgaactgacagattctaaactgccaagtcatgccacacattctctttttacatgtcccgaaaatgaggaaatggttttgtcaaattcaagaattggaaaaagaagaggagagccccttatcttagtgggagaaccctcaatcaaaagaaacttattaaatgaatttgacaggataatagaaaatcaagaaaaatccttaaaggcttcaaaaagcactccagatggcacaataaaagatcgaagattgtttatgcatcatgtttctttagagccgattacctgtgtaccctttcgcacaactaaggaacgtcaagagatacagaatccaaattttaccgcacctggtcaagaatttctgtctaaatctcatttgtatgaacatctgactttggaaaaatcttcaagcaatttagcagtttcaggacatccattttatcaagtttctgctacaagaaatgaaaaaatgagacacttgattactacaggcagaccaaccaaagtctttgttccaccttttaaaactaaatcacattttcacagagttgaacagtgtgttaggaatattaacttggaggaaaacagacaaaagcaaaacattgatggacatggctctgatgatagtaaaaataagattaatgacaatgagattcatcagtttaacaaaaacaactccaatcaagcagcagctgtaactttcacaaagtgtgaagaagaacctttagatttaattacaagtcttcagaatgccagagatatacaggatatgcgaattaagaagaaacaaaggcaacgcgtctttccacagccaggcagtctgtatcttgcaaaaacatccactctgcctcgaatctctctgaaagcagcagtaggaggccaagttccctctgcgtgttctcataaacagctgtatacgtatggcgtttctaaacattgcataaaaattaacagcaaaaatgcagagtcttttcagtttcacactgaagattattttggtaaggaaagtttatggactggaaaaggaatacagttggctgatggtggatggctcataccctccaatgatggaaaggctggaaaagaagaattttatagggctctgtgtgacactccaggtgtggatccaaagcttatttctagaatttgggtttataatcactatagatggatcatatggaaactggcagctatggaatgtgcctttcctaaggaatttgctaatagatgcctaagcccagaaagggtgcttcttcaactaaaatacagatatgatacggaaattgatagaagcagaagatcggctataaaaaagataatggaaagggatgacacagctgcaaaaacacttgttctctgtgtttctgacataatttcattgagcgcaaatatatctgaaacttctagcaataaaactagtagtgcagatacccaaaaagtggccattattgaacttacagatgggtggtatgctgttaaggcccagttagatcctcccctcttagctgtcttaaagaatggcagactgacagttggtcagaagattattcttcatggagcagaactggtgggctctcctgatgcctgtacacctcttgaagccccagaatctcttatgttaaagatttctgctaacagtactcggcctgctcgctggtataccaaacttggattctttcctgaccctagaccttttcctctgcccttatcatcgcttttcagtgatggaggaaatgttggttgtgttgatgtaattattcaaagagcataccctatacagtggatggagaagacatcatctggattatacatatttcgcaatgaaagagaggaagaaaaggaagcagcaaaatatgtggaggcccaacaaaagagactagaagccttattcactaaaattcaggaggaatttgaagaacatgaagaaaacacaacaaaaccatatttaccatcacgtgcactaacaagacagcaagttcgtgctttgcaagatggtgcagagctttatgaagcagtgaagaatgcagcagacccagcttaccttgagggttatttcagtgaagagcagttaagagccttgaataatcacaggcaaatgttgaatgataagaaacaagctcagatccagttggaaattaggaaggccatggaatctgctgaacaaaaggaacaaggtttatcaagggatgtcacaaccgtgtggaagttgcgtattgtaagctattcaaaaaaagaaaaagattcagttatactgagtatttggcgtccatcatcagatttatattctctgttaacagaaggaaagagatacagaatttatcatcttgcaacttcaaaatctaaaagtaaatctgaaagagctaacatacagttagcagcgacaaaaaaaactcagtatcaacaactaccggtttcagatgaaattttatttcagatttaccagccacgggagccccttcacttcagcaaatttttagatccagactttcagccatcttgttctgaggtggacctaataggatttgtcgtttctgttgtgaaaaaaacaggacttgcccctttcgtctatttgtcagacgaatgttacaatttactggcaataaagttttggatagaccttaatgaggacattattaagcctcatatgttaattgctgcaagcaacctccagtggcgaccagaatccaaatcaggccttcttactttatttgctggagatttttctgtgttttctgctagtccaaaagagggccactttcaagagacattcaacaaaatgaaaaatactgttgagaatattgacatactttgcaatgaagcagaaaacaagcttatgcatatactgcatgcaaatgatcccaagtggtccaccccaactaaagactgtacttcagggccgtacactgctcaaatcattcctggtacaggaaacaagcttctgatgtcttctcctaattgtgagatatattatcaaagtcctttatcactttgtatggccaaaaggaagtctgtttccacacctgtctcagcccagatgacttcaaagtcttgtaaaggggagaaagagattgatgaccaaaagaactgcaaaaagagaagagccttggatttcttgagtagactgcctttacctccacctgttagtcccatttgtacatttgtttctccggctgcacagaaggcatttcagccaccaaggagttgtggcaccaaatacgaaacacccataaagaaaaaagaactgaattctcctcagatgactccatttaaaaaattcaatgaaatttctcttttggaaagtaattcaatagctgacgaagaacttgcattgataaatacccaagctcttttgtctggttcaacaggagaaaaacaatttatatctgtcagtgaatccactaggactgctcccaccagttcagaagattatctcagactgaaacgacgttgtactacatctctgatcaaagaacaggagagttcccaggccagtacggaagaatgtgagaaaaataagcaggacacaattacaactaaaaaatatatctaagcatttgcaaaggcgacaataaattattgacgcttaacctttccagtttataagactggaatataatttcaaaccacacattagtacttatgttgcacaatgagaaaagaaattagtttcaaatttacctcagcgtttgtgtatcgggcaaaaatcgttttgcccgattccgtattggtatacttttgcttcagttgcatatcttaaaactaaatgtaatttattaactaatcaagaaaaacatctttggctgagctcggtggctcatgcctgtaatcccaacactttgagaagctgaggtgggaggagtgcttgaggccaggagttcaagaccagcctgggcaacatagggagacccccatctttacaaagaaaaaaaaaaaggggaaaagaaaatcttttaaatctttggatttgatcactacaagtattattttacaatcaacaaaatggtcatccaaactcaaacttgagaaaatatcttgctttcaaattgacactgatt

SEQ ID NO: 95828 - DNA, 656 bp, Homo sapiens
catccccctttttctccccccgttttccctctgaaccccctcttgtccccctttccctctaccccactgggcccccccccccaaacaatttgttttcacaaaactttttctcaaggcccaagcccgcccaaccaaattttttttttttttttttcttttttttggatttgatcactacaagtattattttacaagtgaaataaacataccattttcttttagattgtgtcattaaatggaatgaggtctcttagtacagttattttgatgcagataattccttttagtttagctactattttaggggattttttttagaggtaactcactatgaaatagttctccttaatgcaaatatgttggttctgctatagttccatcctgttcaaaagtcaggatgaatatgaagagtggtgtttccttttgagcaattcttcatccttaagtcagcatgattataagaaaaatagaaccctcagtgtaactctaattcctttttactattccagtgtgatctctgaaattaaattacttcaactaaaaattcaaatactttaaatcagaagatttcatagttaatttattttttttttcaacaaaatggtcatccaaactcaaacttgagaaaatatcttgctttcaaattgacactgatt

SEQ ID NO: 95829 - DNA, 365 bp, Homo sapiens
tatcttttactgtgattattcttcatcttccttccttttcatgtcattttatatgttcttatgtaaaattactttcatctagaataggaataatgtgaactgaaatcacctaacctattaggagttaggggagggagactgtgtgtaatatttgcgtgcttaaatattttcaatgaaaagttactttgatttagttttttatgttactacataattatgataggctacgttttcatttttttatcagatgtcttctcctaattgtgagatatattatcaaagtcctttatcactttgtatggccaaaaggaagtctgtttccacacctgtctcagcccagatgacttcaaagtcttgtaaagggg

SEQ ID NO: 95830 - DNA, 351 bp, Homo sapiens
tatatctaagcatttgcaaaggcgacaataaattattgacgcttaacctttccagtttataagactggaatataatttcaaaccacacattagtacttatgttgcacaatgagaaaagaaattagtttcaaatttacctcagcgtttgtgtatcgggcaaaaatcgttttgcccgattccgtattggtatacttttgcttcagttgcatatcttaaaactaaatgtaatttattaactaatcaagaaaaacatctttggctgagctcggtggctcatgcctgtaatcccaacactttgagaagctgaggtgggaggagtgcttgaggccaggagttcaagaccagcctggg

SEQ ID NO: 95831 - DNA, 11523 bp, Homo sapiens
gcgcgggcttgtggcgcgagcttctgaaactaggcggcagaggcggagccgctgtggcactgctgcgcctctgctgcgcctcgggtgtcttttgcggcggtgggtcgccgccgggagaagcgtgaggggacagatttgtgaccggcgcggtttttgtcagcttactccggccaaaaaagaactgcacctctggagcggacttatttaccaagcattggaggaatatcgtaggtaaaaatgcctattggatccaaagagaggccaacattttttgaaatttttaagacacgctgcaacaaagcagatttaggaccaataagtcttaattggtttgaagaactttcttcagaagctccaccctataattctgaacctgcagaagaatctgaacataaaaacaacaattacgaaccaaacctatttaaaactccacaaaggaaaccatcttataatcagctggcttcaactccaataatattcaaagagcaagggctgactctgccgctgtaccaatctcctgtaaaagaattagataaattcaaattagacttaggaaggaatgttcccaatagtagacataaaagtcttcgcacagtgaaaactaaaatggatcaagcagatgatgtttcctgtccacttctaaattcttgtcttagtgaaagtcctgttgttctacaatgtacacatgtaacaccacaaagagataagtcagtggtatgtgggagtttgtttcatacaccaaagtttgtgaagggtcgtcagacaccaaaacatatttctgaaagtctaggagctgaggtggatcctgatatgtcttggtcaagttctttagctacaccacccacccttagttctactgtgctcatagtcagaaatgaagaagcatctgaaactgtatttcctcatgatactactgctaatgtgaaaagctatttttccaatcatgatgaaagtctgaagaaaaatgatagatttatcgcttctgtgacagacagtgaaaacacaaatcaaagagaagctgcaagtcatggatttggaaaaacatcagggaattcatttaaagtaaatagctgcaaagaccacattggaaagtcaatgccaaatgtcctagaagatgaagtatatgaaacagttgtagatacctctgaagaagatagtttttcattatgtttttctaaatgtagaacaaaaaatctacaaaaagtaagaactagcaagactaggaaaaaaattttccatgaagcaaacgctgatgaatgtgaaaaatctaaaaaccaagtgaaagaaaaatactcatttgtatctgaagtggaaccaaatgatactgatccattagattcaaatgtagcacatcagaagccctttgagagtggaagtgacaaaatctccaaggaagttgtaccgtctttggcctgtgaatggtctcaactaaccctttcaggtctaaatggagcccagatggagaaaatacccctattgcatatttcttcatgtgaccaaaatatttcagaaaaagacctattagacacagagaacaaaagaaagaaagattttcttacttcagagaattctttgccacgtatttctagcctaccaaaatcagagaagccattaaatgaggaaacagtggtaaataagagagatgaagagcagcatcttgaatctcatacagactgcattcttgcagtaaagcaggcaatatctggaacttctccagtggcttcttcatttcagggtatcaaaaagtctatattcagaataagagaatcacctaaagagactttcaatgcaagtttttcaggtcatatgactgatccaaactttaaaaaagaaactgaagcctctgaaagtggactggaaatacatactgtttgctcacagaaggaggactccttatgtccaaatttaattgataatggaagctggccagccaccaccacacagaattctgtagctttgaagaatgcaggtttaatatccactttgaaaaagaaaacaaataagtttatttatgctatacatgatgaaacattttataaaggaaaaaaaataccgaaagaccaaaaatcagaactaattaactgttcagcccagtttgaagcaaatgcttttgaagcaccacttacatttgcaaatgctgattcaggtttattgcattcttctgtgaaaagaagctgttcacagaatgattctgaagaaccaactttgtccttaactagctcttttgggacaattctgaggaaatgttctagaaatgaaacatgttctaataatacagtaatctctcaggatcttgattataaagaagcaaaatgtaataaggaaaaactacagttatttattaccccagaagctgattctctgtcatgcctgcaggaaggacagtgtgaaaatgatccaaaaagcaaaaaagtttcagatataaaagaagaggtcttggctgcagcatgtcacccagtacaacattcaaaagtggaatacagtgatactgactttcaatcccagaaaagtcttttatatgatcatgaaaatgccagcactcttattttaactcctacttccaaggatgttctgtcaaacctagtcatgatttctagaggcaaagaatcatacaaaatgtcagacaagctcaaaggtaacaattatgaatctgatgttgaattaaccaaaaatattcccatggaaaagaatcaagatgtatgtgctttaaatgaaaattataaaaacgttgagctgttgccacctgaaaaatacatgagagtagcatcaccttcaagaaaggtacaattcaaccaaaacacaaatctaagagtaatccaaaaaaatcaagaagaaactacttcaatttcaaaaataactgtcaatccagactctgaagaacttttctcagacaatgagaataattttgtcttccaagtagctaatgaaaggaataatcttgctttaggaaatactaaggaacttcatgaaacagacttgacttgtgtaaacgaacccattttcaagaactctaccatggttttatatggagacacaggtgataaacaagcaacccaagtgtcaattaaaaaagatttggtttatgttcttgcagaggagaacaaaaatagtgtaaagcagcatataaaaatgactctaggtcaagatttaaaatcggacatctccttgaatatagataaaataccagaaaaaaataatgattacatgaacaaatgggcaggactcttaggtccaatttcaaatcacagttttggaggtagcttcagaacagcttcaaataaggaaatcaagctctctgaacataacattaagaagagcaaaatgttcttcaaagatattgaagaacaatatcctactagtttagcttgtgttgaaattgtaaataccttggcattagataatcaaaagaaactgagcaagcctcagtcaattaatactgtatctgcacatttacagagtagtgtagttgtttctgattgtaaaaatagtcatataacccctcagatgttattttccaagcaggattttaattcaaaccataatttaacacctagccaaaaggcagaaattacagaactttctactatattagaagaatcaggaagtcagtttgaatttactcagtttagaaaaccaagctacatattgcagaagagtacatttgaagtgcctgaaaaccagatgactatcttaaagaccacttctgaggaatgcagagatgctgatcttcatgtcataatgaatgccccatcgattggtcaggtagacagcagcaagcaatttgaaggtacagttgaaattaaacggaagtttgctggcctgttgaaaaatgactgtaacaaaagtgcttctggttatttaacagatgaaaatgaagtggggtttaggggcttttattctgctcatggcacaaaactgaatgtttctactgaagctctgcaaaaagctgtgaaactgtttagtgatattgagaatattagtgaggaaacttctgcagaggtacatccaataagtttatcttcaagtaaatgtcatgattctgttgtttcaatgtttaagatagaaaatcataatgataaaactgtaagtgaaaaaaataataaatgccaactgatattacaaaataatattgaaatgactactggcacttttgttgaagaaattactgaaaattacaagagaaatactgaaaatgaagataacaaatatactgctgccagtagaaattctcataacttagaatttgatggcagtgattcaagtaaaaatgatactgtttgtattcataaagatgaaacggacttgctatttactgatcagcacaacatatgtcttaaattatctggccagtttatgaaggagggaaacactcagattaaagaagatttgtcagatttaacttttttggaagttgcgaaagctcaagaagcatgtcatggtaatacttcaaataaagaacagttaactgctactaaaacggagcaaaatataaaagattttgagacttctgatacattttttcagactgcaagtgggaaaaatattagtgtcgccaaagagtcatttaataaaattgtaaatttctttgatcagaaaccagaagaattgcataacttttccttaaattctgaattacattctgacataagaaagaacaaaatggacattctaagttatgaggaaacagacatagttaaacacaaaatactgaaagaaagtgtcccagttggtactggaaatcaactagtgaccttccagggacaacccgaacgtgatgaaaagatcaaagaacctactctgttgggttttcatacagctagcgggaaaaaagttaaaattgcaaaggaatctttggacaaagtgaaaaacctttttgatgaaaaagagcaaggtactagtgaaatcaccagttttagccatcaatgggcaaagaccctaaagtacagagaggcctgtaaagaccttgaattagcatgtgagaccattgagatcacagctgccccaaagtgtaaagaaatgcagaattctctcaataatgataaaaaccttgtttctattgagactgtggtgccacctaagctcttaagtgataatttatgtagacaaactgaaaatctcaaaacatcaaaaagtatctttttgaaagttaaagtacatgaaaatgtagaaaaagaaacagcaaaaagtcctgcaacttgttacacaaatcagtccccttattcagtcattgaaaattcagccttagctttttacacaagttgtagtagaaaaacttctgtgagtcagacttcattacttgaagcaaaaaaatggcttagagaaggaatatttgatggtcaaccagaaagaataaatactgcagattatgtaggaaattatttgtatgaaaataattcaaacagtactatagctgaaaatgacaaaaatcatctctccgaaaaacaagatacttatttaagtaacagtagcatgtctaacagctattcctaccattctgatgaggtatataatgattcaggatatctctcaaaaaataaacttgattctggtattgagccagtattgaagaatgttgaagatcaaaaaaacactagtttttccaaagtaatatccaatgtaaaagatgcaaatgcatacccacaaactgtaaatgaagatatttgcgttgaggaacttgtgactagctcttcaccctgcaaaaataaaaatgcagccattaaattgtccatatctaatagtaataattttgaggtagggccacctgcatttaggatagccagtggtaaaatcgtttgtgtttcacatgaaacaattaaaaaagtgaaagacatatttacagacagtttcagtaaagtaattaaggaaaacaacgagaataaatcaaaaatttgccaaacgaaaattatggcaggttgttacgaggcattggatgattcagaggatattcttcataactctctagataatgatgaatgtagcacgcattcacataaggtttttgctgacattcagagtgaagaaattttacaacataaccaaaatatgtctggattggagaaagtttctaaaatatcaccttgtgatgttagtttggaaacttcagatatatgtaaatgtagtatagggaagcttcataagtcagtctcatctgcaaatacttgtgggatttttagcacagcaagtggaaaatctgtccaggtatcagatgcttcattacaaaacgcaagacaagtgttttctgaaatagaagatagtaccaagcaagtcttttccaaagtattgtttaaaagtaacgaacattcagaccagctcacaagagaagaaaatactgctatacgtactccagaacatttaatatcccaaaaaggcttttcatataatgtggtaaattcatctgctttctctggatttagtacagcaagtggaaagcaagtttccattttagaaagttccttacacaaagttaagggagtgttagaggaatttgatttaatcagaactgagcatagtcttcactattcacctacgtctagacaaaatgtatcaaaaatacttcctcgtgttgataagagaaacccagagcactgtgtaaactcagaaatggaaaaaacctgcagtaaagaatttaaattatcaaataacttaaatgttgaaggtggttcttcagaaaataatcactctattaaagtttctccatatctctctcaatttcaacaagacaaacaacagttggtattaggaaccaaagtctcacttgttgagaacattcatgttttgggaaaagaacaggcttcacctaaaaacgtaaaaatggaaattggtaaaactgaaactttttctgatgttcctgtgaaaacaaatatagaagtttgttctacttactccaaagattcagaaaactactttgaaacagaagcagtagaaattgctaaagcttttatggaagatgatgaactgacagattctaaactgccaagtcatgccacacattctctttttacatgtcccgaaaatgaggaaatggttttgtcaaattcaagaattggaaaaagaagaggagagccccttatcttagtgggagaaccctcaatcaaaagaaacttattaaatgaatttgacaggataatagaaaatcaagaaaaatccttaaaggcttcaaaaagcactccagatggcacaataaaagatcgaagattgtttatgcatcatgtttctttagagccgattacctgtgtaccctttcgcacaactaaggaacgtcaagagatacagaatccaaattttaccgcacctggtcaagaatttctgtctaaatctcatttgtatgaacatctgactttggaaaaatcttcaagcaatttagcagtttcaggacatccattttatcaagtttctgctacaagaaatgaaaaaatgagacacttgattactacaggcagaccaaccaaagtctttgttccaccttttaaaactaaatcacattttcacagagttgaacagtgtgttaggaatattaacttggaggaaaacagacaaaagcaaaacattgatggacatggctctgatgatagtaaaaataagattaatgacaatgagattcatcagtttaacaaaaacaactccaatcaagcagcagctgtaactttcacaaagtgtgaagaagaacctttagatttaattacaagtcttcagaatgccagagatatacaggatatgcgaattaagaagaaacaaaggcaacgcgtctttccacagccaggcagtctgtatcttgcaaaaacatccactctgcctcgaatctctctgaaagcagcagtaggaggccaagttccctctgcgtgttctcataaacagctgtatacgtatggcgtttctaaacattgcataaaaattaacagcaaaaatgcagagtcttttcagtttcacactgaagattattttggtaaggaaagtttatggactggaaaaggaatacagttggctgatggtggatggctcataccctccaatgatggaaaggctggaaaagaagaattttatagggctctgtgtgacactccaggtgtggatccaaagcttatttctagaatttgggtttataatcactatagatggatcatatggaaactggcagctatggaatgtgcctttcctaaggaatttgctaatagatgcctaagcccagaaagggtgcttcttcaactaaaatacagatatgatacggaaattgatagaagcagaagatcggctataaaaaagataatggaaagggatgacacagctgcaaaaacacttgttctctgtgtttctgacataatttcattgagcgcaaatatatctgaaacttctagcaataaaactagtagtgcagatacccaaaaagtggccattattgaacttacagatgggtggtatgctgttaaggcccagttagatcctcccctcttagctgtcttaaagaatggcagactgacagttggtcagaagattattcttcatggagcagaactggtgggctctcctgatgcctgtacacctcttgaagccccagaatctcttatgttaaagatttctgctaacagtactcggcctgctcgctggtataccaaacttggattctttcctgaccctagaccttttcctctgcccttatcatcgcttttcagtgatggaggaaatgttggttgtgttgatgtaattattcaaagagcataccctatacagtggatggagaagacatcatctggattatacatatttcgcaatgaaagagaggaagaaaaggaagcagcaaaatatgtggaggcccaacaaaagagactagaagccttattcactaaaattcaggaggaatttgaagaacatgaagaaaacacaacaaaaccatatttaccatcacgtgcactaacaagacagcaagttcgtgctttgcaagatggtgcagagctttatgaagcagtgaagaatgcagcagacccagcttaccttgagggttatttcagtgaagagcagttaagagccttgaataatcacaggcaaatgttgaatgataagaaacaagctcagatccagttggaaattaggaaggccatggaatctgctgaacaaaaggaacaaggtttatcaagggatgtcacaaccgtgtggaagttgcgtattgtaagctattcaaaaaaagaaaaagattcagttatactgagtatttggcgtccatcatcagatttatattctctgttaacagaaggaaagagatacagaatttatcatcttgcaacttcaaaatctaaaagtaaatctgaaagagctaacatacagttagcagcgacaaaaaaaactcagtatcaacaactaccggtttcagatgaaattttatttcagatttaccagccacgggagccccttcacttcagcaaatttttagatccagactttcagccatcttgttctgaggtggacctaataggatttgtcgtttctgttgtgaaaaaaacaggacttgcccctttcgtctatttgtcagacgaatgttacaatttactggcaataaagttttggatagaccttaatgaggacattattaagcctcatatgttaattgctgcaagcaacctccagtggcgaccagaatccaaatcaggccttcttactttatttgctggagatttttctgtgttttctgctagtccaaaagagggccactttcaagagacattcaacaaaatgaaaaatactgttgagagacagagtcttgctttgtcacccccaggctggagtacaatagcacaatctcggatcactgcagtgtctgcctcctgggctcaagcgattctcgtgccttagcctcccaagtagctgggactacagaatattgacatactttgcaatgaagcagaaaacaagcttatgcatatactgcatgcaaatgatcccaagtggtccaccccaactaaagactgtacttcagggccgtacactgctcaaatcattcctggtacaggaaacaagcttctgatgtcttctcctaattgtgagatatattatcaaagtcctttatcactttgtatggccaaaaggaagtctgtttccacacctgtctcagcccagatgacttcaaagtcttgtaaaggggagaaagagattgatgaccaaaagaactgcaaaaagagaagagccttggatttcttgagtagactgcctttacctccacctgttagtcccatttgtacatttgtttctccggctgcacagaaggcatttcagccaccaaggagttgtggcaccaaatacgaaacacccataaagaaaaaagaactgaattctcctcagatgactccatttaaaaaattcaatgaaatttctcttttggaaagtaattcaatagctgacgaagaacttgcattgataaatacccaagctcttttgtctggttcaacaggagaaaaacaatttatatctgtcagtgaatccactaggactgctcccaccagttcagaagattatctcagactgaaacgacgttgtactacatctctgatcaaagaacaggagagttcccaggccagtacggaagaatgtgagaaaaataagcaggacacaattacaactaaaaaatatatctaagcatttgcaaaggcgacaataaattattgacgcttaacctttccagtttataagactggaatataatttcaaaccacacattagtacttatgttgcacaatgagaaaagaaattagtttcaaatttacctcagcgtttgtgtatcgggcaaaaatcgttttgcccgattccgtattggtatacttttgcttcagttgcatatcttaaaactaaatgtaatttattaactaatcaagaaaaacatctttggctgagctcggtggctcatgcctgtaatcccaacactttgagaagctgaggtgggaggagtgcttgaggccaggagttcaagaccagcctgggcaacatagggagacccccatctttacaaagaaaaaaaaaaaggggaaaagaaaatcttttaaatctttggatttgatcactacaagtattattttacaagtgaaataaacataccattttcttttagattgtgtcattaaatggaatgaggtctcttagtacagttattttgatgcagataattccttttagtttagctactattttaggggattttttttagaggtaactcactatgaaatagttctccttaatgcaaatatgttggttctgctatagttccatcctgttcaaaagtcaggatgaatatgaagagtggtgtttccttttgagcaattcttcatccttaagtcagcatgattataagaaaaatagaaccctcagtgtaactctaattcctttttactattccagtgtgatctctgaaattaaattacttcaactaaaaattcaaatactttaaatcagaagatttcatagttaatttattttttttttcaacaaaatggtcatccaaactcaaacttgagaaaatatcttgctttcaaattgacactgatt

SEQ ID NO: 95832 - DNA, 1657 bp, Homo sapiens
ggcacgagggtccgcgcgcccgtcccgtcgccgccgccgccgccgcagacccctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcctgtgctgtttcaaaaaaaaaaaaaaaaaaaaaaaaaaaaaaaaggggggggcgggcccaaaagtttccccccggggggcccaggttataccgcgcgttccccaaggttttctgggttccaagaggggcgccccatatataggggagcgctcggatattatatataagcgcataggcgcacggggcgcgcgctcggtttaacacaagcggtcgggagacggggagacaacaccggggatagcgcttggggagacctcttggggagagaagagagagcccttatacttctcgggggggctggcgaccatatatttggggacacaaatcttcaccttacgagagagattttaaagccgcctctaagggggggacactttataacaatttttaaagcgtgggtcataaggggggac

SEQ ID NO: 95833 - DNA, 1585 bp, Homo sapiens
ggcacgagggtccgcgcgcccgtcccgtcgccgccgccgccgccgcagacccctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcctgtgctgtttcaaaaaaaaaaaaaaaaaaaaaaaaaaaaaaaaggggggggcgggcccaaaagtttccccccggggggcccaggttataccgcgcgttccccaaggttttctgggttccaagaggggcgccccatatataggggagcgctcggatattatatataagcgcataggcgcacggggcgcgcgctcggtttaacacaagcggtcgggagacggggagacaacaccggggatagcgcttggggagacctcttggggagagaagagagagcccttatacttctcgggggggctggcgaccatatatttggggacacaaatcttcaccttacgagagagattttaaagccgcctctaagggggggacactttataacaatttttaaagcgtgggtcataaggggggac

SEQ ID NO: 95834 - DNA, 1599 bp, Homo sapiens
  misc_feature (1253)..(1253): n is a, c, g, or t
  misc_feature (1297)..(1297): n is a, c, g, or t
  misc_feature (1303)..(1303): n is a, c, g, or t
  misc_feature (1334)..(1334): n is a, c, g, or t
  misc_feature (1382)..(1382): n is a, c, g, or t
  misc_feature (1411)..(1411): n is a, c, g, or t
  misc_feature (1421)..(1421): n is a, c, g, or t
  misc_feature (1426)..(1426): n is a, c, g, or t
  misc_feature (1581)..(1581): n is a, c, g, or t
  misc_feature (1593)..(1593): n is a, c, g, or t
ggcacgagggtccgcgcgcccgtcccgtcgccgccgccgccgccgcagacccctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttaaaaaaaaaaanaaaataaaaaaaaaaaaaaaaaaaaaaaaaaaaaagcggccgcncgaatngtcgacgcggccgcgaattcgcggggcaacngggcctgcgagaagacgacagaagggggcttctgtgagtttttccggngcacgcgagtcttctgaaacgtcagctgngctcccctcngagtnctgagcccgcggaaccgcagccatgactgaggctgatgtgaatccaaaggcctatccccttgccgatgcccacctcaccaagaagctactggacctcgttcagcagtcatgtaactataagcagcttcggggagccaatgagggccaccccctcnaggggcatctcngagttc

SEQ ID NO: 95835 - DNA, 667 bp, Homo sapiens
aggctggtactgcgccccgggagttacggatgtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcctgtgctgtttcaaaaaaaaaaaaaaaaaaaaaaaaaaaaaaaaggggggggcgggcccaaaagtttccccccggggggcccaggttataccgcgcgttccccaaggttttctgggttccaagaggggcgccccatatataggggagcgctcggatattatatataagcgcataggcgcacggggcgcgcgctcggtttaacacaagcggtcgggagacggggagacaacaccggggatagcgcttggggagacctcttggggagagaagagagagcccttatacttctcgggggggctggcgaccatatatttggggacacaaatcttcaccttacgagagagattttaaagccgcctctaagggggggacactttataacaatttttaaagcgtgggtcataaggggggac

SEQ ID NO: 95836 - DNA, 1646 bp, Homo sapiens
  misc_feature (1300)..(1300): n is a, c, g, or t
  misc_feature (1344)..(1344): n is a, c, g, or t
  misc_feature (1350)..(1350): n is a, c, g, or t
  misc_feature (1381)..(1381): n is a, c, g, or t
  misc_feature (1429)..(1429): n is a, c, g, or t
  misc_feature (1458)..(1458): n is a, c, g, or t
  misc_feature (1468)..(1468): n is a, c, g, or t
  misc_feature (1473)..(1473): n is a, c, g, or t
  misc_feature (1628)..(1628): n is a, c, g, or t
  misc_feature (1640)..(1640): n is a, c, g, or t
ggcacgagggtccgcgcgcccgtcccgtcgccgccgccgccgccgcagacccctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcctgtgctgtttcaaaaaaaaaaaaaaaaaaaaaaaaaaaaaaaaaaaaaaaaaaanaaaataaaaaaaaaaaaaaaaaaaaaaaaaaaaaagcggccgcncgaatngtcgacgcggccgcgaattcgcggggcaacngggcctgcgagaagacgacagaagggggcttctgtgagtttttccggngcacgcgagtcttctgaaacgtcagctgngctcccctcngagtnctgagcccgcggaaccgcagccatgactgaggctgatgtgaatccaaaggcctatccccttgccgatgcccacctcaccaagaagctactggacctcgttcagcagtcatgtaactataagcagcttcggggagccaatgagggccaccccctcnaggggcatctcngagttc

SEQ ID NO: 95837 - DNA, 1074 bp, Homo sapiens
acacacaagcctaaaagatgaacgatacggtgtttatacttctccctaggaagagccataggccttgggccccatcaaggactcttcagtgtttgaattttaagatttgcctccagtatgaaacgagaggactttgccttcactactcagcttgaagaaagaggaagagatttatttggggtggagaatgtgaagccatcccagtgactgcctcttccacaaattgtctttctgttccaaggcaatgacctcagtgttgtcaactaggaggcacctgagctagtaaggagaagccaagcaagagagagatttgcctcatccccactggttaaatagtttgctcataaaaaatttcggaaatatatttattaaggataactatgtgcaacagtttctaaaatgtcatttgggatgttgcatgagtgatcaatgttagggtggcatgaaaatcctgaactgtagctagcaggctttagcagctgaaggcattttgtttaatactgtaaatacagtaccaaagtttaactgcattgacgattattttacagctgacccatggcccacagagtggttaaaagcaagggcatttgaggcaggtggcctgagggttcatgtccctgctgcatcatttacaatctccatgaccatgggcaagttacttaacttctgtaagccttagttttctccccataagttaaaataaagctgtaccttccttatgagtttggtaagacaaataccttagacagtgcatataaagtaattaacaccatgccttgaatgcagtagttgctccaaaaatattaattattgccactaccattctactatcattacaattgttattttttcatatatttgctcaaaaatacagtggaaatgtaagcatgtaaacgttattgtgttcagtataatatacaaacattagcataagtatttcctttctcatgagcttttgcagagatcacctgctaatgaatgtggaaaaatagaaataaatttagaacatttctgtagaatcaaagttattttcaggttctctaacacttgaaaacaataaaagctgatcaaaaa

SEQ ID NO: 95838 - DNA, 312 bp, Homo sapiens
tggcagcgattagtcacacttggttctaaccatgcttccaagcctggcttatctttaacacccagtctacctcaagacaaacaatataaaggagagaaaaacactttggggtcatttagaattacttgcatcacagatccaatgacaaaggcagccatcgagccgcagagcagggagaggaggctgggtgccaggtccgcagcttggctgccagctcctcgccttgtgcaaaaagtgcttttgttagacattccttgtcaggacttagaaactgatggtttgttccagaagttctttatcctgagatagctc

SEQ ID NO: 95839 - DNA, 504 bp, Homo sapiens
gcatgaaccaccacacctggcccctgttgctttctctaagcatatgttacggactctaaaatccttgatgatgacacaagatgagaaagggcatatatgtggatggatatagatatttcatgtatataccaatgctacccaaaatgcagtctccagaccaatgttggtttgcaaattgtttgttatagctcaccatgagataacattataaatcaaatacatcactaagcacactgcttagttaaactgacttgtttttcacagtaatactttcttgatgaaggaagtattgccttgatttacattttggtacaaattcctcatcttgtcataaacctgcactactgacgtatctatacctgcatactattcaactcattatacactcacatctttactcaaaacaaagctattcagacatatcaaatcttcatcacagttccccctcttaaaatgtactttctttccaaaaaggaaataaaaccagtatgccttcacaatgaa

SEQ ID NO: 95840 - DNA, 356 bp, Homo sapiens
tcatgcccctcagtcaaactccctctgacgaggcaagagctcaggttgctgcgtgcaggcctctatggatccaccgccgcggacgtccctaccgccaaacaccccatcttagcggatgttttctctcccaaatgttccctctttccagctgtttcctttgcacggcatgcaatcttcctaggtgttccgtctacccaccgtggaatctgctcagaggttccttctgcccaccatgagacctgcttaagggttttctgctgttgaccacgccatcttcgcacttaggccttctgctaaacgtgcagtctacctgagtgttccttctgccaaacagctagttgtgtccgctccctccc

SEQ ID NO: 95841 - DNA, 333 bp, Homo sapiens
gttgcagtggccgagatcgtgccattgcactccagagtgagcaacaacagcaggggggtaggcagggagggagaagaacaaaaagctactttatgcttatttaaagttatatgatactgaatcatagtaaaaacataagaactgggtatgtatttttaaacatatcctaaggaaacttatcttaaaaaattaataaactcgttttggctttaaccatactagacagaatacattcagtgtaacgctcaaattctgtgaagtgcgtccctatagtttgttgtgtgtgaataataggatgaaaaatgcttagaacattcggtgagccactcaagg

SEQ ID NO: 95842 - DNA, 708 bp, Homo sapiens
agcggagtaaatcttgagcatcataatatttcatccataaagatctcagtatgtgcccctaataaataaggactcctttaaaaaatacacaaccacaatttcattatcacgcctaaaagagcttagtaatcaaggattccttaattcataaaatattcaacaagtgcttacatttctccaactgtctcaaattgtattcttttacattttgctagtttgaaacagaatccaaataagccccatactctgtaattggttgatggagctcttcatactcttttaatctacagatttcctccctctatttcttttttccaccttgccatttagtaaaccagctcatttgtttaaatttccaatagtctggattttgattattgtgtcaccatgtgtcatttaacctattcctctgtttctgtatattctacaaattgttagatccagagggttgatcagattcaggttcaattttttggtacgaatacttcctcggtggtatttcacacttctatctggaagcatgtaactatgcctggttgcttctgtgacattagcagacactgatgaccactgccccttatttcattaggagcagacacccaattacgaaccacacattttgattaatcgctgatattatatgacttcgttggatcctactgttttacttaaaaatttggtctggaggctgaatcaggggagaattgc

SEQ ID NO: 95843 - DNA, 431 bp, Homo sapiens
caactaatttttaaagttttttgtagagacagggtcttgctttgttgcccaggctgttctcaaactgttggcctcaagcaatcctcttgccttggcctcccaaagtgttgggattacaggtatgagccaccacacctggcaaaaagtttttattcttaacatttagtcacttggaaaactcactgacttagaattttatataacaataaatgaggtatttttgtatttggctttgctactccgtttgcccacttccaagtctacgacttgagcactaaatgctaacataattcaagagtacagtatgatgaagtgaacatgctgggatagtttttctttaatgaggggagttggctaacacatccagctagttatttgacatacaaatactaatcaataaatatttctcaagtataagctgtcataactca

SEQ ID NO: 95844 - DNA, 189 bp, Homo sapiens
tagagaaagacggagaggaaaggggaaggacagggaggtggatgatggatgggctccatggaaccgtcacttcatcttctcctcctctccctgtggcttctcgttcagaggcccaaacttgactgtcagagctgggagagccaggatgcacaaacaccccaaaggagattttcggcagcagcagcagca

SEQ ID NO: 95845 - DNA, 415 bp, Homo sapiens
gttaaagaagtttccttatatacttactgtgctaagactatttaagaagataaaatatagggcatataagcttagaagttgccactgtgttctaacaacaagtattaataaaaatctgaacaaactgaaaaatcagcaactcttcttagatccatcagagaagtgaggtcacagggcaatctaccaccccccaaattagagaaataggcaactacaaagaatcaccacaacttacaggagcagaaacccaagagcagaaatctccagaccatccaatgccagggaaggaacacctgaattacaactgctggtggtgcagtgaggtcaagtctgacagtttacgaaccccagggaaagccagtcatagggagattcccatgcttttctgaattttacttccaggagctctgacaag

SEQ ID NO: 95846 - DNA, 445 bp, Homo sapiens
cagggatcagatctctgagtcaggcagctgggtggatggcagcttttccccgtgtggtggaggcagtggcatgggcagaaaccagtggggagaagtgaggcatgctacaaacccacgtcctatcccatggcagctggcagaattttccaaagagcattccttctcccagagcatcaggaggcttcaggtaagagaagcacagctgctccgaccacacctcactgtcgtccctccctgggagtgaattccttttctgtaaggctggaaggaccacaggattgggggtatacacagcagaaatttgctttctcaccgttctggaagctggaagcctgagaccaaagtgttggtagatcgattccttccgaggcctctctccttgccttgcagatggccgacttctccctgtatcctcacatggtcttcctctctgcagctgtgttct

SEQ ID NO: 95847 - DNA, 287 bp, Homo sapiens
ggccctgatccaacaggattagtgtcctttcaagaaaaacaccagaaggctccctcttgttctctatccaccatgtgaggacacagcaagccaagaagagagccggcaccagaacccactctgctggaccttgatcatggacctttctgcctcttgacctgtgaggttcactgatacggtctcagattccactccacaactactctctacaaaactatcacttgatgggttttgctgtagcatcaaagaagaatacccacaattatccgaaaagctgtgaaatactc

SEQ ID NO: 95848 - DNA, 305 bp, Homo sapiens
atgaataaggtatgtaagaaatcttcctttctgttatgaggtaagagaaaaatgaggttatttaaacaatccatgtttatatgatggccatcttttaacaaaaattcttttcaatacattaaaaatgatcattgaatcatcaaatgtagttttgtcctctgatagacaaaagagtagtgtctagactgtctgatgaatctatttgactgaaagataaaaacaaatgtggtcttgttgtcatctctgtggccttctgaaagcccagtgtacagaggtcacacagggagccccaagagggtggtcag

SEQ ID NO: 95849 - DNA, 349 bp, Homo sapiens
gggaaagctgaaggcactttgcacaggacctagggcagacggcctaattctacacaggacagttaataaaaaacagtgttactgatggtattatttaacccgagaaaagattacaaattaacaaactcagtagttatctatttgtgggccagtatgaaagccagatagttgagaagactttctagactttctgaatcatgttatcaagtttaaacatacctccttagctctctccaaagcatttgctgtaagtcaacaggtcctgctaaaaagagattcactgacaaccaaaattgtttatgctactaagtggttaaagagcaaaacatcagcaagtagttatagtgtg

SEQ ID NO: 95850 - DNA, 311 bp, Homo sapiens
ggtgatctgccagccttgcctcccaaagtgctgggattacaggcatgagcactgtgcctggcctgaaatttatggttattaatgactacattaaaaaaggaaatatcacaaattaataacataaccaccagccttagaaacaagaaaataaaaaatcaaactaaactcaaataagaagaaagaaatagtaaagactcgagtagaaataagcaaaatagagaatacgaacacagtagagaaaatcaatgaaacaaaaagttgattctttgaaaagatcaacaaaaatgacaaacatttagctagactggcca

SEQ ID NO: 95851 - DNA, 382 bp, Homo sapiens
aggtcataggaaacagtgctgtgcagccaactctcttcagaaacccagcaatggagcaactaagttacccacgaggtgtaattgtgaattttcttggctacttcctccaccttaggaaatagatgaagtgaaattgtttcttctccctttaccctctggtgtctggaggggatatctgggatcatgctttcttattatttctcttttctttccctcagatcccttctagaaactaccaagaaatattcagctgacttgcaggaatactttttcagtaggcagataaaccatatcccccaaagtaatatgtagctttctttctttctttctttcttttttgagatggggtctcactctgtcacccaggttggagtgcagtggc

SEQ ID NO: 95852 - DNA, 208 bp, Homo sapiens
atgcccagctaatttttgtatttttagtagtgacaacgcaatattggccaggctggtctcaaactcctgacctcaagtgatccgcctgcctcagcttcccaaagtgctgggattacaggtgtgagccaccacgcccagcctctagtgtgattttaacatgctccttcaacttctctgtttcctgtaacctggttactctatatagctt

SEQ ID NO: 95853 - DNA, 309 bp, Homo sapiens
cctggtgttatctcataggactgtagtgaggagtatgatgagaaggcatatacatactgagtgtagtgtttgacatatagaaagcacataataaggctgaacgcggtggctcatgcctgtaatcccagcactttgggaggccgaggtcgggggatcacctgaggtagggagtttgagaccagcctgaccaacatggagaaaccccatctctactaaaaatacaaagttagtcaggcgtggttgcgcatgcctgtaatactagctactcgggaggctgaggcaggagaatcgcttgaacccgggaggtag

SEQ ID NO: 95854 - DNA, 220 bp, Homo sapiens
ctcaggcgatccgcccgcctcggcctcccaaagtgctggggttacaggcgtgagccaccatgtccggcctcatgtagttattttcacaagaagtgtcactatattaatacattgaaaaagagcaaggtgaattgtcaatgtgaattttctaaacatggccccaggtcacattcttgatcaattaaagcacttcacctctttaaaattcaagacttaaggc

SEQ ID NO: 95855 - DNA, 193 bp, Homo sapiens
ccatctagtttttacatttttagtagaggcgggatttcaccatgttggtcaggctggtctcgaactccttacctcgtgatccgcccgcctcagcctcccaaagtgctggaattacaggcatgagccaccgtgcctggccgagccttgttttattactgaattatcttcacagttccctaaagtacctggcaaa

SEQ ID NO: 95856 - DNA, 310 bp, Homo sapiens
agtcgtccgagacgccgcgcggtgatgctcctgaaaacgtctgcccggcgtaggggaacccagcatgattttcaggatcttatattgcactttaaacacacctaaaattgacatggaaagactcttaggaggacaactaggactagaagatttcatatttgcccatgtgaaaggaatcgaaaaagaagtgaatgtgtataaatctgaggattcacttggtctcaccattacagataatggtgttggctatgcttttataaagattcttatctgctgcctctgatagtgaaatgtgctgtgacttttctct

SEQ ID NO: 95857 - DNA, 2746 bp, Homo sapiens
aggctgggcgggcgggcggctgctccggtccaggggtggaggtcggggccctgacccgacgcagccaggcggaagcgcggctgccattggaggctgcttttacctgcgcggggcccggggcgcaaagtccgaggcgccggggggaggaggcggcggacggcagcgcaggtgggcccgcgctctcggccctgcaagatgcccctgaagctgcgggggaagaagaaggccaagtccaaggagaccgccgggctggtggagggcgagccgacgggcgcgggcggcgggagcctctcagcgtcccgggctcccgcacgcaggctggtcttccacgcgcagctggcgcacggtagtgccacgggccgagtggagggcttctccagcatccaggagctctacgcccagatcgcgggcgcgtttgaaatctcgccgtcggagatcttatattgcactttaaacacacctaaaattgacatggaaagactcttaggaggacaactaggactagaagatttcatatttgcccatgtgaaaggaatcgaaaaagaagtgaatgtgtataaatctgaggattcacttggtctcaccattacagataatggtgttggctatgcttttataaagagaattaaagatggtggtgttattgactcagttaaaacaatctgtgttggggatcatattgaatccataaatggagaaaatattgttgggtggcgtcactatgatgttgctaagaagttaaaggaattaaaaaaggaggaactctttactatgaagttaatagaacctaagaaggcatttgaaatagagctgaggtcaaaggctggaaagtcatcaggagaaaaaattggttgtggaagggcaacacttcgcctgagatcaaaaggtcctgccaccgtggaagaaatgccttctgaaaccaaagcaaaggcaattgaaaagattgatgatgttcttgagttgtacatgggaattcgagatattgatttagccaccacaatgtttgaagctggaaaggacaaagtaaatccagatgaatttgctgtggcacttgacgaaactcttggagactttgcgttcccagacgaatttgtctttgatgtttggggagtcattggtgatgccaaacgaagaggattatgatgtgtacactccatctctgaagaaacaacccatcgttcttttttttctcttttttaaaaagtcctataagatctgtttttggacacctttactaactctggtttaatttcatgtgtatggaatatattctttgaaatataattttggtaattttgatttctgggcactttttaacattgctgatgtagtatgcttaagagaaatgacctaaataaggatcaattgtaatattcattcaaaaggtttttaaaagtaagttttaaggagtatttctcgacagatgattttcttctccattaatacccatgctttgtttttcacatataaatagatgatttcaatagctttgtagttttttttcaaaatcttaatgtaaactaggattggagtatgatttacctcatagtatcttcactgtgttatcctagtttgaacaggatatgttcaggaaatgaaaggtgaattatgccccttattggtctagaagcattggtttttttttgatcctctgagtaagggaaggaagattcctgtggcatgttgatttctatggccaactttctctctttgtaaaacaaagattgattgattttcttgtatgcttctttatacatgctcttaaaacttgtggttgaaatctgtgctgtgtgtgtgtgtctctgcatgtgtaaaagaagggtaaaaaagagatgggtagggtagaactacttgcatttgatttttttttcagtccttaaaacattatttctttttttcactcatagccacttttatgttaccttttataagcactccagggaagattttatatttttttgtagagtttttggaaagatatttactcaaaataactatgctttagaacttttttttttttttttttttttttggttaaacagcagcactttttagttccctaaactttagaagaaatgctatcagaaatagatttccttccagtggaaagaaaggaggaagggagaattgagaaaatatattagtctattattttagagttctaatacactctaaattatagagaaaattgagagtaaatgactgtcttatcactcttatttgacatttcgtaggtgtaagagaaatggaaatgaatggtttcaacaaagatcatttaatacagcagagcatggcatgaccaagcatctttgtaaagtgttagatggaaaatgctgtgtgctgccatggtaatcagaaataataacctgttagggatgtattctaggaaatcagaagtagttctcttttcttgctggattattgcttagataactcttgttttctggtaaaactttagttgtattgccatccactcctttttcaaatgagtttaatgccataaagctgatattctttgtccgattaatttgaaatctgcacagaagctgttttagtcattaatgtgtaacaaaagtagcttatagaatatggactgccttattgctgttgcttatcatttgaaaataaaatccagctcaggttgtaacttgttggtactcgtttagtgagttcgttttggaggttctgaaatacctattaattcttaatattacctctcttggaaagacacaaaaaaagagctgtt

SEQ ID NO: 95858 - DNA, 2645 bp, Homo sapiens
aggctgggcgggcgggcggctgctccggtccaggggtggaggtcggggccctgacccgacgcagccaggcggaagcgcggctgccattggaggctgcttttacctgcgcggggcccggggcgcaaagtccgaggcgccggggggaggaggcggcggacggcagcgcaggtgggcccgcgctctcggccctgcaagatgcccctgaagctgcgggggaagaagaaggccaagtccaaggagaccgccgggctggtggagggcgagccgacgggcgcgggcggcgggagcctctcagcgtcccgggctcccgcacgcaggctggtcttccacgcgcagctggcgcacggtagtgccacgggccgagtggagggcttctccagcatccaggagctctacgcccagatcgcgggcgcgtttgaaatctcgccgtcggagatcttatattgcactttaaacacacctaaaattgacatggaaagactcttaggaggacaactaggactagaagatttcatatttgcccatgtgaaaggaatcgaaaaagaagtgaatgtgtataaatctgaggattcacttggtctcaccattacagataatggtgttggctatgcttttataaagagaattaaagatggtggtgttattgactcagttaaaacaatctgtgttggggatcatattgaatccataaatggagaaaatattgttgggtggcgtcactatgatgttgctaagaagttaaaggaattaaaaaaggaggaactctttactatgaagttaatagaacctaagaaggcatttgaaatagagctgaggtcaaaggctggaaagtcatcaggagaaaaaattggttgtggaagggcaacacttcgcctgagatcaaaaggtcctgccaccgtggaagaaatgccttctgaaaccaaagcaaaggcaattgaaaagattgatgatgttcttgagttgtacatgggaattcgagatattgatttagccaccacaatgtttgaagctggaaaggacaaagtaaatccagatgaatttgctgtggcacttgacgaaactcttggagactttgcgttcccagacgaatttgtctttgatgtttggggagtcattggtgatgccaaacgaagaggattatgatgtgtacactccatctctgaagaaacaacccatcgttcttttttttctcttttttaaaaagtcctataagatctgtttttggacacctttactaactctggtttaatttcatgtgtatggaatatattctttgaaatataattttggtaattttgatttctgggcactttttaacattgctgatgtagtatgcttaagagaaatgacctaaataaggatcaattgtaatattcattcaaaaggtttttaaaagtaagttttaaggagtatttctcgacagatgattttcttctccattaatacccatgctttgtttttcacatataaatagatgatttcaatagctttgtagttttttttcaaaatcttaatgtaaactaggattggagtatgatttacctcatagtatcttcactgtgttatcctagtttgaacaggatatgttcaggaaatgaaaggtgaattatgccccttattggtctagaagcattggtttttttttgatcctctgagtaagggaaggaagattcctgtggcatgttgatttctatggccaactttctctctttgtaaaacaaagattgattgattttcttgtatgcttctttatacatgctcttaaaacttgtggttgaaatctgtgctgtgtgtgtgtgtctctgcatgtgtaaaagaagggtaaaaaagagatgggtagggtagaactacttgcatttgatttttttttcagtccttaaaacattatttctttttttcactcatagccacttttatgttaccttttataagcactccagggaagattttatatttttttgtagagtttttggaaagatatttactcaaaataactatgctttagaacttttttttttttttttttttttttggttaaacagcagcactttttagttccctaaactttagaagaaatgctatcagaaatagatttccttccagtggaaagaaaggaggaagggagaattgagaaaatatattagtctattattttagagttctaatacactctaaattatagagaaaattgagagtaaatgactgtcttatcactcttatttgacatttcgtaggtgtaagagaaatggaaatgaatggtttcaacaaagatcatttaatacagcagagcatggcatgaccaagcatctttgtaaagtgttagatggaaaatgctgtgtgctgccatggtaatcagaaataataacctgttagggatgtattctaggaaatcagaagtagttctcttttcttgctggattattgcttagataactcttgttttctggtaaaactttagttgtattgccatccactcctttttcaaatgagtttaatgccataaagctgatattctttgtccgattaatttgaaatctgcacagaagctgttttagtcattaatgtgtaacaaaagtagcttatagaatatggactgccttattgctgttgcttatcatttgaaaataaaatccagctcaggttgt

SEQ ID NO: 95859 - DNA, 1845 bp, Homo sapiens
  misc_feature (12)..(12): n is a, c, g, or t
acacctggtgtnctagaacccagttaagagcaattgaaaagattgatgatgttcttgagttgtacatgggaattcgagatattgatttagccaccacaatgtttgaagctggaaaggacaaagtaaatccagatgaatttgctgtggcacttgacgaaactcttggagactttgcgttcccagacgaatttgtctttgatgtttggggagtcattggtgatgccaaacgaagaggattatgatgtgtacactccatctctgaagaaacaacccatcgttcttttttttctcttttttaaaaagtcctataagatctgtttttggacacctttactaactctggtttaatttcatgtgtatggaatatattctttgaaatataattttggtaattttgatttctgggcactttttaacattgctgatgtagtatgcttaagagaaatgacctaaataaggatcaattgtaatattcattcaaaaggtttttaaaagtaagttttaaggagtatttctcgacagatgattttcttctccattaatacccatgctttgtttttcacatataaatagatgatttcaatagctttgtagttttttttcaaaatcttaatgtaaactaggattggagtatgatttacctcatagtatcttcactgtgttatcctagtttgaacaggatatgttcaggaaatgaaaggtgaattatgccccttattggtctagaagcattggtttttttttgatcctctgagtaagggaaggaagattcctgtggcatgttgatttctatggccaactttctctctttgtaaaacaaagattgattgattttcttgtatgcttctttatacatgctcttaaaacttgtggttgaaatctgtgctgtgtgtgtgtgtctctgcatgtgtaaaagaagggtaaaaaagagatgggtagggtagaactacttgcatttgatttttttttcagtccttaaaacattatttctttttttcactcatagccacttttatgttaccttttataagcactccagggaagattttatatttttttgtagagtttttggaaagatatttactcaaaataactatgctttagaacttttttttttttttttttttttttggttaaacagcagcactttttagttccctaaactttagaagaaatgctatcagaaatagatttccttccagtggaaagaaaggaggaagggagaattgagaaaatatattagtctattattttagagttctaatacactctaaattatagagaaaattgagagtaaatgactgtcttatcactcttatttgacatttcgtaggtgtaagagaaatggaaatgaatggtttcaacaaagatcatttaatacagcagagcatggcatgaccaagcatctttgtaaagtgttagatggaaaatgctgtgtgctgccatggtaatcagaaataataacctgttagggatgtattctaggaaatcagaagtagttctcttttcttgctggattattgcttagataactcttgttttctggtaaaactttagttgtattgccatccactcctttttcaaatgagtttaatgccataaagctgatattctttgtccgattaatttgaaatctgcacagaagctgttttagtcattaatgtgtaacaaaagtagcttatagaatatggactgccttattgctgttgcttatcatttgaaaataaaatccagctcaggttgtaacttgttggtactcgtttagtgagttcgttttggaggttctgaaatacctattaattcttaatattacctctcttggaaagacacaaaaaaagagctgtt

SEQ ID NO: 95860 - DNA, 778 bp, Homo sapiens
cttttggcatttctcatgagctcatcagcacaagagctaacattttccctgtttgttttcttttcagacacgaatgcatttgcttcagcaaaagagacatgtatcttagaaacctatcaaaaatatttgaatacagctacctcggcaatctctgctctacgggctcctccccccacctttcttttaacctttgcctgagaagaatttaaatggcatatttagtggctgtatattgtgcttcctgtacccactgctgcataaaagggattgatttaaatcgcttacagtaaccatgtgggggaggagggtctagttttctgcaccaaatgctccaggatgcataataagcaaccacaaatacagacaacaaatgagtgtgcttgcatttgtctcttctctggtaaagaattattctttagtacggatggactgcacacttttagcatcaacaagagagcagctcagatgtgcgagcaccaataaaggatacttaagcctccgtcccccaggtaatgagtctcagaaatgttggctaaaaaagtcagagaatgttcctatttataatttttttgaatcatgaaatttataacacctcccaaagcaggaacggaccaagtttaaagattacagctgagtgccagtaaagcgttaaaggcaaccattgttaataacaatcggctgaaaagcaagacacagctcatgctttggagccgtactaagagattcggcatctctaaaatcgctagagcctttgacaagccaggcataaatcaggagg

SEQ ID NO: 95861 - DNA, 272 bp, Homo sapiens
ctcaaaagccctgtgcattcaaaaaaggcttggttgggttatttccagttgtactgtcgggaaaagagctatttctgtcttttaactctcaaatacaaagatactgctcagtgggaatcaaacattcctaattttcatttatttatcttttcattttaattttggattgggggggtatctgcgcagctctgttagacggagtatattgcatggtgctgaggtctgggcttctgatggtcccgtcgttcaagtagcaaacgcgctgcgcgaaa

SEQ ID NO: 95862 - DNA, 2158 bp, Homo sapiens
  misc_feature (1060)..(1060): n is a, c, g, or t
  misc_feature (1467)..(1467): n is a, c, g, or t
  misc_feature (1505)..(1505): n is a, c, g, or t
  misc_feature (1777)..(1777): n is a, c, g, or t
  misc_feature (2048)..(2048): n is a, c, g, or t
  misc_feature (2080)..(2080): n is a, c, g, or t
ctccaacaggggagtgaagggacaggatggagcgggagcggcgccaaagcacggggagaaccagaggccgcaggaatggcagactctggacatgctcctagagatgggaggtcaaaatgatcaacgttcagggtcccttcatctcagagggtctcgagtcacctcatttaaaggtgggaactggggatcctggaacctcccctgcaccccagatgcttctggggcccttgagaacttgccctgagctgtcacctggcctagactcccagccactttcagggcacagagaaactgccctcactctgaaaatgtggagaccgggacccagagagtgtggcctgggacacctcctatccagccatacgccgcccaggactggctcaacagctccaccctccactgctgttcacccatgacacgtcacttcccacccgccactgctgcaccctggggaggggacccagtgcagtgatgcccaagttccagcgttcagactgcctgggagccctgagactccctgacccagcaggacgccccatcctgggtgagggggagagtggggtgggccagaaagcccacccagacaactgagacccctccccacctgctaccccatctgcttgggcccaggaatagaggggccaaggcagacccctcaacatacatgctgaaccctgatgtgtagccgcccacacaccatgagcccagattgtggcattcagtattttttctgacatcaaaacagtcttggcagggcacggtggctcacacttgtaatcctagtactttgggaggccgaggcaggtggatcacctgaggtcaggagttcgagatcagcctggccaacatggtgaaaccctgaaatacaaaaattagtcaggcatggtggtgggcgcctgtaatcccagctactcgggaggctgaggtgggagaattgcttgaacctgggaagtggaggctgcagtgagccgagatcgtgccacctacactccagcctgggtgacagagcaaactctctcttaaaaaaaaaaaaaaaaagaccagggcccggcgtggtggntcatgcctgtaatcccagtactttgggaggccgaggtgggcggatcacctgaggtcaggagtttgagaccagcctgaccaacatggagaaaccccatctctactaaaaatacaaaaaattagctggatgttattgcgggcacctgtaatcccagctacttgggtggccgaggcaggagaatcacttgaaccagggaggcagaggctgcggtgagccgagaccacaccattgcactccagcctgggcaacaagaacaaaactccatctgaaaaaaaaaaaatactgagccagtccatgtgcattatttcatttctggtggactcttcccgatgttaatttcacctgagatatttatgcatgtgctcatgtgaacacacacgtgcgtcagcacacactggcctgctcangcacacacctgcaagtgctgcttccagcctcctgccangaggccagcctggctccctccctgtggagtgggctctgcccacggggcagatggactaagacgaacgctcgttaagccccccagaagttgcctggcttggcactctctgcggtatctgaggcggggctcactcgcccatttgacagatggagaaactgatgcttagagatgtggagtgagtgcctgactcccccagcgcccccggaatcccccagccccaccgactctcccagatcccccgactcccccagcccccccaactcccccagccncaccagcacctgctcccaccctccccaaactcaaattgcacccgccccagcttcagggcttggttggggttcccttttcagtcaaggtacaacatccaggcggtaaaatgctcccatcagccacttactggcgcagtggctcatgccggtaatccagtactttgggaggccaaggcgggcagatcacaaggtcaggagttcaagaccagcctggccaatatggtgaaaaaaattagctggccgtggtggcacatgcccgtaatcccagctngtcaggaggctgaggcaggagaattgcttgancccaggaggcggaggttgcagtgagccgagattgtgccactgcactccagcctgggtgacagagcaagactccatctc

SEQ ID NO: 95863 - DNA, 446 bp, Homo sapiens
  misc_feature (18)..(18): n is a, c, g, or t
tgggtccagggcagcganctagtccatttgtccttttcgaagtgtggcctgggacacctcctatccagccatacgccgcccaggactggctcaacagctccaccctccactgctgttcacccatgacacgtcacttcccacccgccactgctggctcacctgtgacaccccaggcagctcagatgcccggcaggtcctgctggtgtgtgttagccggggtctccaaagaaccagagccagcaggggacacacccatctctgtatctggagaaaaagatcgatgagaaggaatctgctcctgtgatgatggaggctgacaagtcccgagagccacggttggcaccctggagacccctgagggtgataccaccactccaggctgaaagctggcaggcttgagaccctgggagagctggccctctgactcctgggacttcttattctat

SEQ ID NO: 95864 - DNA, 470 bp, Homo sapiens
agctatgcgcctcgtgcctgggagccttagggccacacggaagggtagaaatcagtttcaggtcaggaggtctggaacagctttgttaaacccagtttttttcctatgaaaatggctgcagacactgggggagggagagggtggccctgatcccgatgactctgaaacatgcttggccttccccagagattcctgctcccagcccaggcccagacggcaacagaagctcatggtgagttcaccccggtcctggtctggcacctcattgctggggaggtctcggcagtccagaggaggtagcccccaccctgggcatccatctgcccaggccccagcctccgcgggaagacccaattacagaagagagaagtatgtggagacccttggctgaggttgggggtcctggaagctggaggtagtgttcctgggtatagcatgatgggttgatgggtgggttttattctcttttt

SEQ ID NO: 95865 - DNA, 735 bp, Homo sapiens
agctatgcgcctcgtgcctgggagccttagggccacacggaagggtagaaatcagtttcaggtcaggaggtctggaacagctttgttaaacccagtttttttcctatgaaaatggctgcagacactgggggagggagagggtggccctgatcccgatgactctgaaacatgcttggccttccccagagattcctgctcccagcccaggcccagacggcaacagaagctcatggaatggcagactctggacatgctcctagagatgggaggtcaaaatgatcaacgttcagggtcccttcatctcagagggtctcgagtcacctcatttaaaggtggcctgggacacctcctatccagccatacgccgcccaggactggctcaacagctccaccctccactgctgttcacccatgacacgtcacttcccacccgccactgctggctcacctgtgacaccccaggcagctcagatgcccggcaggtcctgctggtgtgtgttagccggggtctccaaagaaccagagccagcaggggacacacccatctctgtatctggagaaaaagatcgatgagaaggaatctgctcctgtgatgatggaggctgacaagtcccgagagccacggttggcaccctggagacccctgagggtgataccaccactccaggctgaaagctggcaggcttgagaccctgggagagctggccctctgactcctgggacttcttattctat

SEQ ID NO: 95866 - DNA, 2661 bp, Homo sapiens
  misc_feature (18)..(18): n is a, c, g, or t
  misc_feature (869)..(870): n is a, c, g, or t
  misc_feature (901)..(901): n is a, c, g, or t
  misc_feature (926)..(926): n is a, c, g, or t
  misc_feature (1563)..(1563): n is a, c, g, or t
  misc_feature (1970)..(1970): n is a, c, g, or t
  misc_feature (2008)..(2008): n is a, c, g, or t
  misc_feature (2280)..(2280): n is a, c, g, or t
  misc_feature (2551)..(2551): n is a, c, g, or t
  misc_feature (2583)..(2583): n is a, c, g, or t
tgggtccagggcagcganctagtccatttgtccttttcgaagtgtggcctgggacacctcctatccagccatacgccgcccaggactggctcaacagctccaccctccactgctgttcacccatgacacgtcacttcccacccgccactgctggctcacctgtgacaccccaggcagctcagatgcccggcaggtcctgctggtaagagggaggcaggaacttgtcctgtctgggacccgggcattgctgggcgccggagggacctgggacctcaaccacgctgggagctggcctgtcgtacaggcggtgcctggcagatgtggacgggctctgcaggctcctggcggcccacccctgccttcgtgccatccttcctgggagtctcctggccaaggaggactcgaggcctgtcccacctgtgcccagggctcactgtggctcccttcagcggggctctgctctctccccgcctgcttcccctccagctcctgggctctgccccagcatccccccgagcctctcccattcctggccccagcctggccagggatcccagaggatgccttcgccagcccagccccttgcctggtggatcaccactcctgtctcctgctgctctgccccctgccccgggcctgggaaacctgggaggaccctgagggagggtcagggatgtgtgacaccagcaggaggctgacgagttccctggcaggaagcacactgcacagggagcctgccgccatgctgccactctcatgcccctgcggggccgcagagagggatgcctagggcggggtgggcagtggctgccgtaggggaggcgctctgggcagtgctgttccctgagaaactgcagccccaaggggcnngggcagggcctggcctgactgagtgggattnaaggggaggtagggtgggtgtgccntatgatgtaggccactgctgcaccctggggaggggacccagtgcagtgatgcccaagttccagcgttcagactgcctgggagccctgagactccctgacccagcaggacgccccatcctgggtgagggggagagtggggtgggccagaaagcccacccagacaactgagacccctccccacctgctaccccatctgcttgggcccaggaatagaggggccaaggcagacccctcaacatacatgctgaaccctgatgtgtagccgcccacacaccatgagcccagattgtggcattcagtattttttctgacatcaaaacagtcttggcagggcacggtggctcacacttgtaatcctagtactttgggaggccgaggcaggtggatcacctgaggtcaggagttcgagatcagcctggccaacatggtgaaaccctgaaatacaaaaattagtcaggcatggtggtgggcgcctgtaatcccagctactcgggaggctgaggtgggagaattgcttgaacctgggaagtggaggctgcagtgagccgagatcgtgccacctacactccagcctgggtgacagagcaaactctctcttaaaaaaaaaaaaaaaaagaccagggcccggcgtggtggntcatgcctgtaatcccagtactttgggaggccgaggtgggcggatcacctgaggtcaggagtttgagaccagcctgaccaacatggagaaaccccatctctactaaaaatacaaaaaattagctggatgttattgcgggcacctgtaatcccagctacttgggtggccgaggcaggagaatcacttgaaccagggaggcagaggctgcggtgagccgagaccacaccattgcactccagcctgggcaacaagaacaaaactccatctgaaaaaaaaaaaatactgagccagtccatgtgcattatttcatttctggtggactcttcccgatgttaatttcacctgagatatttatgcatgtgctcatgtgaacacacacgtgcgtcagcacacactggcctgctcangcacacacctgcaagtgctgcttccagcctcctgccangaggccagcctggctccctccctgtggagtgggctctgcccacggggcagatggactaagacgaacgctcgttaagccccccagaagttgcctggcttggcactctctgcggtatctgaggcggggctcactcgcccatttgacagatggagaaactgatgcttagagatgtggagtgagtgcctgactcccccagcgcccccggaatcccccagccccaccgactctcccagatcccccgactcccccagcccccccaactcccccagccncaccagcacctgctcccaccctccccaaactcaaattgcacccgccccagcttcagggcttggttggggttcccttttcagtcaaggtacaacatccaggcggtaaaatgctcccatcagccacttactggcgcagtggctcatgccggtaatccagtactttgggaggccaaggcgggcagatcacaaggtcaggagttcaagaccagcctggccaatatggtgaaaaaaattagctggccgtggtggcacatgcccgtaatcccagctngtcaggaggctgaggcaggagaattgcttgancccaggaggcggaggttgcagtgagccgagattgtgccactgcactccagcctgggtgacagagcaagactccatctc

SEQ ID NO: 95867 - DNA, 888 bp, Homo sapiens
gttcccttgaaaaatgaatgattaaatgaattaaacaacagttaaacaattagattcagtatgatattatgtgcatactgtacatacttttgtattttcaaggtcaatcattgcatagaaagaaattaatttttttaagaagttaaaaatatagtacttaatcttgaataaatttgttaataactagggcacattaaaatatgcctcaaacgtagtaaaattacattttaacatttatacaagaggttgtctagaatatcacaaaagaaaaataacctaaaaataaaaactttcccaaaacaaagactcaaaagcagcccaaaactgttacaacaataaaaataatgccacaatatttgtttctattttaattgaaaaaaggaaaagcagatttagttattactctaaatagatactttattgttgatttttctagatttaatagattcaatagtttgaacttaaaaccgtatttctcaattttactctaattttctaacctcaaacttaaaacacatcatttccctctttattttcccaccaaccacacacactagccatgtcattctatttgtatttacctcattctttttcacatactctttgtgtgtgattctgctttaccatcttttagaatatcttttctcaatttttcacctatatcaaatattgttttaatatatagcatattaatagaaaagctaaggtatagtaaggtaaacagatcggaagacaattgccattgaaaagatactcagaatttccaagagaagggagcatgtcacgccaggggagactacagggaagaactcaggtccatcaggaaacagagagagggaggaattcacgagcaagaccctagactgtggtgtttgcaggaagaaacca

SEQ ID NO: 95868 - DNA, 586 bp, Homo sapiens
caattatatgaagaataaataggagagtaagggtagaaagggctgaggacatgttaggaaaacatataatccaaggacatgtagggtgatggcaaaggagatggagaggtctatttggagataaactcagcaagatttgctggtcaattgcatgttgatgatgagggagaggagagggaagtggcaaggttgatttctacgcttcttatcacgaggatctttaagtggatggttgtcttattccatttagtgttgctataaaggaattacctaaggctgggtaatttataaagaaaaggagtttatttggccatggttctacaaactgtacaaggagcatgatgcccgcatctgcttctggtgagggtctcaggcttccacttgtgtcagaaggcagagtaccttttattcttaatacaaactacaattcttgtagatttactgacacttactgattacctactgtctgccagtcactctggtacattctttctttataatattattcagttgttaaacaacagattctcagatatatgtaatgttttctaggtcgaaaacaagtgccagttcttgttgggtcctt

SEQ ID NO: 95869 - DNA, 619 bp, Homo sapiens
tgtatgtgccaggctgaggctccggatttgggcaagcaatggtcaggctccacggaggctcaaagatggatggtttgagacttagggacggatgacagggaagacctcagtgatggggtgatgtctgttgaatgcattacttgctttacatttttaaaagctgaaagcttaagagcttatttcttaaggccgagaaacatgttctcagctgcagcaaagcattctgctctgtcagatagcccagagctggtccaaaacaaaggtgggaagtcgtctgtgtttgtggcccctccctgcctttctgtgcggcttccccactttctgatagagccacctggcaggtgcccagcagttctcaacagcctgtagcatggtcctggagtctccagcaagccatccaggtgtcatcagcactgggccttgcaacccggagccctgcaaccctgtggtagagctgcacagggatggggaggatcgcgggatttagagtcaagaggacctgtgttctgggcctgggtcttagacaaatccctgatcctgagcctgattcttcagctataaacagcatttttcatacttatcagatgggtttggagattgagcaaatatgaaggtataa

SEQ ID NO: 95870 - DNA, 839 bp, Homo sapiens
aaaagaaaaagaaagaaaaaaccctagatgtgtatatctatgtatgaaaaatatatatataattagatgtgctaaggattggacttaggtgaatctgacaaaaattttctcagctcttcatgtttttaattacttccatttagaaatctttttagtttaatgacttatactaatttttgttaacagagtaccaacccagggcaagtaagatccaaaaactaagtccattaaatttgtcacctactactgtccacatgtagcattatttaagtttctctttaaaaagagaagaacaactttggtgcatataacacacacatattataaaagaaaaataccactgtagaaccaagttttatgttattattaaaatacagtttttcttttcctcatttttttttaatttcccaaataatactgggaagcaaaataaagtacctgcatttcaccatttcaaatataatgggaagagttgggtttttaaatcgtccctattcctttccagtctctgcctttaaaagaagatatttttggccggggttggtagctcatgcctgtaatcccagcactttgggaggctgaggagggcagattgcctgagctcaggcgttcgaggccagactggcccaacgtggtgaaaccccatctctactaaaaatacaaaaattagccaggcatggtggcgggagcctgtaatcccagctactcgggaggctgaggcaggagaatcgcttaaacctgggaggcaaaggttgcagtgagccaagattacgccactgcactccagcctgggtgacagatggagactccatctcaaaaaaaaaaaaaaaaaaaaaaca

SEQ ID NO: 95871 - DNA, 429 bp, Homo sapiens
gtgtgcgtggaacatacgatgttttacatctccctcttgagccatcacaattcaaaggctatgagaaggcctggagtagagaaacccattgaggcttgatgttgcatgttctgtgctaatgtgaccctggaaccccctttcagcctcacctcttaatgtgccacagaacacacttgggggaagctgttaaacttcaaaacggtggctccaccacttattagcaatgggacaagtcatttacatctctgaacctcagtttccttgtctgcaaaatggaaataattgggacacctaccctatggagttttagggagggttaaatatgttaagagatgtcaaggtcaccctctgcctgtcagcagggtttgtcccagtggatcattccctcctcttgcttccttctataactttctgtctccctcttacttt

SEQ ID NO: 95872 - DNA, 334 bp, Homo sapiens
tagaaatggagagagaattgaaagttgaggcaatcaagcaagatttccagagaaggttgatactttaatttagacagaacaggtttcaaaattttagctctggagattataagctgtgtggccggtggggaagtcacttcaatgctgggcctcagtttctttattggagcaagagagataacaaggcctacctaccttttaggatttttggacatatttaggtattagagatagtctgtgtacagtgctcaagaaatagaaagcactcaattaaggcaatatgtattatttcagtcgtcactattgactggagagtgaaagttaggtttaaatg

SEQ ID NO: 95873 - DNA, 475 bp, Homo sapiens
ggtctgagtgaggtctgttgttgggggtctgagtgaggtctgttgttgggggtctgagtgaggactgggacccaccaggctttaacagtcactgtagccgctggacaggaaccagcaggaccaggaagcagcaatagtgaggtcagaggatggggccagcatgggtctgagagcagctctggccacggggcaggcagagaaaagccaggccacccggtctcccggcacagccacacctgggcttcagggccagcagggagttcctctcgactcccaggaaacctcatgccagccactcaggtaagattactgccaccttcgcctgagcccagggctccggttacctgctcccgcagggacgtgtgcctgcccgcccgccgagagggcctcaccgcccgccagctggggtccctacacctggatggcaggaagtcatccagagtgaacctgagctggctgacggggcggtacctgc

SEQ ID NO: 95874 - DNA, 503 bp, Homo sapiens
cttttcaagaatatttattaagaagtaaaaattttagccacatcaaacataatgcaaataattattcccagatttcaaccaatttgctaaatggcacactggcaggaattaaggaattcatcctgattcttctgttggttcttttcacttttggggtttcctttctggaataagagtacaatcttttttttttcctgccttgaggaactttaggagatttcagaagataaatgctctttaaattcaacgtggcacaaaaggttactgggaagaaaaaacacgtttgccaatttggacttccaccaaatgttataattggtatcagaagatgtgcaagaatggactcattttgtagtagaatttagatgtgactcattttagtcatggaaccaattttataatgtataagctagatataggtaaaaataaaagagcaaaaggaaatattcttctgtagcattgcagaacccatacatggacattcccttgactcttttcctgtg

SEQ ID NO: 95875 - DNA, 532 bp, Homo sapiens
tgtgggtctgctagtgttctctgaaaaagtgatggattttagcttggccatctttgtgtcagtgccacgacctgaagatttctacctccagagttggaacttattcccgtaactgttatctgaagattcttgagaatcttcttaggagcagcaattgctcagtgttctagtctggggctgtatcatctccagcttcagttccatctcccagaagcttacctgcatctcatgtttgtcctaaaataggatgagcaaattctatttgagaacttttctgacatcttctttatttagcaaatatttaaaaagtgaccattatgttccatgcacggtgaaagaggcagcaagtatagaaatatttctattaaatgttatcggtgagggagaaaagagttacatataaagagccagagttgagggaagtttttttgtttaattttaatccattaaagattaacttgcttacatattgatactcaaccaactgagagaatttagtgaaataaaatagaagaggataatcgatgtgtaa

SEQ ID NO: 95876 - DNA, 957 bp, Homo sapiens
ctcttaggggtctgatctgtggttgcggattattgcagacttttaggacggattgcggtaggggttggggaatttaggaaagtggtttctagtatggggatttaaccttgcccatgtgaataatagcacactaatatagacacagtttctccacttgtcaggagtgtcacacatgtcccttgcagagtgacatccagcagaatgggacgtttactactgcccagtgtgcaggactcaccacgtgcttttcacagaacctttctagttcattctcttaagacagcacatttatctttctctttaaaaaaaaaaaaaaaaaaaaaaaaaaaaaaaaaaaaaaaaaaaaaaaaaaaaaaaaaaaaaaaaaaaaaaaagaaaaagaagaaggggcgggcgccggccacaagaagtactcaccccacgagaggggcgccacaatgatgccgagcaacccccaacgaacttagtgcaacgcaaagcggggccgcccaatataggaggcggactgatattaatcacccgcacggcggcagagcgcggcagcagtagaaaaacaaaaaacagcagtgcagcgggggcgcaaaacacacgctgacacacgcagcgcaagcatcccacagaggcaaagagagaaacacaccacttccaccgcggcgcgggggcgcaacgaacaccaagaggaggcacgcaaaagcaacccaccccccacagaggcggataagtaacgagcaaacccacccacccgcacagggggaccggcaagcaaactaccagcaacaccaacccagccgagaacgagcgctctacacctagcgcggggcggaccaacacaacaaccaacgctgcagacaagacaagggagcggcgcagcctgctgcgacgcaaagaaaaagcagtgggaggacccccgccaggccccagtaaccgtctgcacctcggaggcagaacatatcacac

SEQ ID NO: 95877 - DNA, 434 bp, Homo sapiens
tttccaagtaggttttgtttaccctactccccaaatccctgagccagaagtgtggtgcttatactcccaaacattgcatacccagcctcccgccgttgagttttagtctcttgtgctgtgtctgctggcacttgggctgaaaaggccactgcctcatctaggtttttggtttgtttttgaaacagggtcgcagtggcgtgatctctgctcactgcatcccaggctcaagccatcttcccaactcagcttccctagtagctgggaccacaggcagagaccggggcgagggggtctctacaaaaagtgttggccaggctggtctcgaactcctgggttcaagcaatctgctcacctcaatctcccaaagtgctgggattacagttgggagccacccgccggcctccatctaggttttcataaatatcttactcatg

SEQ ID NO: 95878 - DNA, 406 bp, Homo sapiens
ttcacccctaatcaagaacttaagtgttcataccctggaagagatagtaatcctgcctgctttgtagttcttccctgtcttgtagcactcaaacctttgtctttcccacaagactgaaaactccatgacacaggaatatttcttatcctgtgaacctttgtgtcataccacctatagtagtgtttagtataaaataaattaattgtttggaaatctatcctaaaaaaaaaaacctagattcagtaaaagctctgtggccaaggatgtttgtgttacagtgaacaccttcgagcacttcaggcccaaaaaggggacagcaaatattccaacactaagatctaggaactgtactcattaatacccattctctccatccaagctgccataaacccaagttcaggtctcc

SEQ ID NO: 95879 - DNA, 335 bp, Homo sapiens
tctagttgattcctgaggtatccccacgctctgcataaaggggtgttcaggatgctgtcctttggctgtggtggctggtcctactgctctgtttgccagggtcctgggctcacagtgggtttcttgaggctttggcaagatgggcgattggctctccctgtctccttctttctctttcttcttctctgcctttcttccttccctcctcctttctttccccctccctccttcttttctctcttccgtccctgcttttctctttcttcctttgccctcagttctccctctctctctcttttcattctttcttgaactctccctctttcttcctccct

SEQ ID NO: 95880 - DNA, 301 bp, Homo sapiens
aaaaagggggggggcggggtgaagaaataccaaactgaaaatttctgaaacaaatgtgtaattactactacgctaaacttttttcacacctttgtttgtgagtcagtttccctttaacctttgactcgtaacataaagaaggttaaggccagagtccatcaatggttaaaagattgtgagtgagatgtagaaaaacagtactgatgaattctgaaaggggaaacctcatttccattgcctggttcttgtgcattgcagtattaccacaatatggcattctatacagcagataaatgtaatt

SEQ ID NO: 95881 - DNA, 755 bp, Homo sapiens
gtgaacttggctggttatctgcttcaatttgtccaatgggcaagggtcatcaaatttccattttactatctcattttaaaaacacagatcttccctttggaaattacgtgttagatgtttatcctcaggaaaagggattggaagtggtggggcttgggcacccatctctggctggcccttgtcagttggccacatgagtgaccacagctggcatctgtggaaaacgccctgaatgtttagccagtccggtcacagctcagcccccagtgttgtcatgtaatgatgtccccatgccagactggtgtgactgcaaagcggagaaaagcattgcactaaattcaatgcaaatgtcgagccttgaaaataaaattgaagtaaggaaggacacattaaaaaaaaaagatcaacaatggaaggaggctgggtgcggtggctcactcctgtaatcccagcactttgggaggctgaggtgggtggatcacctgaggtcaggagatcgagaccagcctggccaacatggtgaaaccccgtctctactaaaaatacaagaattagcgagcatggtggcacacgcctgtgaacccagctactcgggaggctgaggcaggagaattgcttgaacccgggaggcggaggttgcagtaagctgagatcgtgccattgcactccagcctggacgagagagcgatactctgtctcaaaaaaaaaaagaaaaagaaaaaaaaaaaaggaaaggctcacaagcaaagaatatc

SEQ ID NO: 95882 - DNA, 672 bp, Homo sapiens
agcggagtccgctacggagctccagcccttctctgagacggggaccagggatggcagccatgcacctgacagcctggccccaggcctgagctatggaattggccctagggcagcaggaacctattgtttcagaagtcggtgacctttgaggacgtggctgtgtacttcacccaggcggaatgggatggcctgtcccctgcacagaggaccctgtacagggatgtgatgctggagaattatgggaatgtggcctccctgggatttccacttctcaaacctgctgtgatctcacaactggagggaggaagtgagctggggggctcatctccactggctgcaggaacaggcctccagggcctccagactgtagatattcagactgacaatgatttgacaaaggaaatgtatgaacggaaaagagaatgtatcatttgaacttcaaagagacttttcccaggaaacagacttttcagaagcctctcttctagagaaacaacaggaagtccactcagcaggaaatatacaagaaggagaagagcaacaccattgatggaacagtgaaagatgagacaagccccgtggaggagtgtttttttagtcaaagttcaaactcatatcagtgtcataccatcactggagagcagccctctgggtgtacaggattggggcaac

SEQ ID NO: 95883 - DNA, 397 bp, Homo sapiens
atgtcagctataggaagaggatttttctctcttttgctgaatataaacaaccaaactttttgcctgcttgcaggcatattgtggccttgaagaaagcctagctgaggacaaataccatatatgcctggtgtagcacagagaagtggctcacccctgtaatcccagcactttgtgggtgccgaggcaggcaaatcacttgaggtcagcagttcgagaccaggctggccaacattgtgaaaccccgtatttaccaaaaacataaaaattagctgggcatcgtgttgggcgcctgtaatcccagctacttgggaggatgaggcaggagaatcgcttgaacctgggaggtggaggttgtggtgagccaatatcatgccactgcactccagcctgggtgaca

SEQ ID NO: 95884 - DNA, 343 bp, Homo sapiens
gaggaacctccaaactgttctccacagtggttatactaatttacattcccactaacagtatatgagggttcccttttcttcacatcctcagtagaatttgttattgcctgacttttgcatataagccattttaactgtggtgaaatgatatctcattgtagttttgatttgcatttctctgaggatcagtgatgttgagcacctattcatatacctgcttgccatttgtatttttccttttgagaaataagcctgatattctttcagggcataaattaagaatgcaaccctcctctgcccatggccacatatatcatgtaagagcaatctggcatagatactc

SEQ ID NO: 95885 - DNA, 199 bp, Homo sapiens
caaagcaaccctgctgagccagagcccaagttaagagatgcaaaaagaatggtaaggtggggaaacaggtaagatcagacaacagacagggcagaggggcatgctctgaggcaaacagggaggtaaggtacattctaaccactctgccttggacaactctgccggacaaaccgctcacctgagacctgacaggtgacag

SEQ ID NO: 95886 - DNA, 325 bp, Homo sapiens
ttacatttggctaatgaatattgactgacatggtggaagatcaggcagggaagagttctaaaccacaatgccaacacacaatggtgtgtcattatgagactagggttgacttgcctcttagtgacacagcctataatttgagcacatcacagggaattgcagtgtacagagctgctgtcttttgtagatgggaaaaaggtgagtatgtgctgatgcaggcattctccagtgtcaggtgaggtaaggcagaacatagcttcagttattagtacattaaaaaaacatgagtaacaaataagagagagcagagatccctaaagaggac

SEQ ID NO: 95887 - DNA, 818 bp, Homo sapiens
caaaatttttgacagtagggggattattcagccaatttaataccagttggaaagctgcagggggtggcttgttttgagtaagatggagaagttttatgagaaccatagtgttgggggaatataaaaattttgaacatttgcaatcatctgtcagtcttgtaatccagtttcccaaggttgtgactgaggaggtctggggtgggttgacagacctgcagaaggctggagtcttctagttgatgaagaatgacactgcactgctgttaataaagcctttgagtttctctgcctgctccccagccaggtgagtgcagtttgttttatgactttcccaggggtgatcatcctctgaggactgatgcaatcttgcctaactcccaacagggtgattaatgccccagaaagctgaagtcttactttatggtgggtctatatttatcatgactgcccaggagatctttgccttggcttctcttctcctgatgaaacctggatgtcaactgtccccctctgctctgattctatggctccatatctgaatgtagaacttagaacctcctcaggttcttgttttgttttttctctttttttgagacagagtcttgctctgtcgcccaggctggagtgcagtggcgtgatctcggctcactgcagcctctgcctcctgggttcaagagattctcagcctccagagtagctgggattacaggctcatgccaccacatccagctgatttttgtacttttagtagagatgcggtttcaccacgttggccaggctggtcttgaactcctgacgtcaggtgatccactcacctc

SEQ ID NO: 95888 - DNA, 1179 bp, Homo sapiens
ggcaggagaatgccacacagacatctcagagcgtcctcattcttcctctttctactgtcctcatagctgctcctgactttctcttgtctgccattatagagacatgccataggaaatgttaaatcaatacatgttactaaaatacaaaatactatcaagattatctgaacagatccaaagtcaagtcttgaagtgaaatatgacttaaataaatgaggtcttaaatgggagctataaaatgcaacaagaaaaaagacagttaagacaaatgtttaaaaatcccaaatgaaggattctgaatgtttaagaagtaaaacaggttttttttggttttgttttgttttgtttttgtttttttgatgcctagaggttggttcaattaggccaggcaagccaagtacctgggtgcgttgtcagaattatctccattttggtcctgttcaggctgggattgacccagaagaccttcaagcatttgcccagggttcttagaagtgatgagcagctgtgatggttttcaggatggatcaagaggccagcaatggctcaagcttcctgggagctctgcccaacactcaggagttaacatggtgtaggttacctccctctggacctccctccctgccccactgaagcctgagaaacacagaactccttgtccatgagcaagggagctcaagcactgggccaggagcggggcagaaaggtgccagtggatagctagacctgaccatcctgggcaactatcacacaccagagcaaaaggggtttaggtgctttgccaagaaatttcttctgtgcatgcctgtatgagagagagagagagaaagagagagagagagagagagagtgtgtgtgtgcgcgtgtgtgtgtctgcctatgtttgtctctgtgttcaatctcagtctgctagccaaatcctagggaccccacaccctgcaatcacaaggactgacctggcaggtggaatcttcatgaagcagaagctgagatctagagatccagatttagagtgttctgtaaagcctagagaagtgtccctttctttctcctccctcacctcaccctatatctccaccatcccctaaaagggcatcctaccaactagctatgaaaaaaaaaagaatttgctgagaaatctgttacccaagaaatattttcaggctgcaagcaaatgtc

SEQ ID NO: 95889 - DNA, 1165 bp, Homo sapiens
ggcaggagaatgccacacagacatctcagagcgtcctcattcttcctctttctactgtcctcatagctgctcctgactttctcttgtctgccattatagagacatgccataggaaatgttaaatcaatacatgttactaaaatacaaaatactatcaagattatctgaacagatccaaagtcaagtcttgaagtgaaatatgacttaaataaatgaggtcttaaatgggagctataaaatgcaacaagaaaaaagacagttaagacaaatgtttaaaaatcccaaatgaaggattctgaatgtttaagaagtaaaacaggttttttttggttttgttttgttttgtttttgtttttttgatgcctagaggttggttcaattaggccaggcaagccaagtacctgggtgcgttgtcagaattatctccattttggtcctgttcaggctgggattgacccagaagaccttcaagcatttgcccagggttcttagaagtgatgagcagctgtgatggttttcaggatggatcaagaggccagcaatggctcaagcttcctgggagctctgcccaacactcaggagttaacatggtgtaggttacctccctctggacctccctccctgccccactgaagcctgagaaacacagaactccttgtccatgagcaagggagctcaagcactgggccaggagcggggcagaaaggtgccagtggatagctagacctgaccatcctgggcaactatcacacaccagagcaaaaggggtttaggtgctttgccaagaaatttcttctgtgcatgcctgtatgagagagagagagagagagagagagtgtgtgtgtgcgcgtgtgtgtgtctgcctatgtttgtctctgtgttcaatctcagtctgctagccaaatcctagggaccccacaccctgcaatcacaaggactgacctggcaggtggaatcttcatgaagcagaagctgagatctagagatccagatttagagtgttctgtaaagcctagagaagtgtccctttctttctcctccctcacctcaccctatatctccaccatcccctaaaagggcatcctaccaactagctatgaaaaaaaaaagaatttgctgagaaatctgttacccaagaaatattttcaggctgcaagcaaatgtc

SEQ ID NO: 95890 - DNA, 196 bp, Homo sapiens
tttcgagttcaaagtgagtgaagagcatgacccctctttcctgctggggggccatgcagttgggagctgtcatcaggtggagctggtctacagggacaggcccaaaggatggagccacataccagagactacaaacacatggtggggagtggagtgtcctggcagccctgctgactccggctcccctgtctttcca

SEQ ID NO: 95891 - DNA, 291 bp, Homo sapiens
gcgaaccgtgacatttttgtataaccaattaaatatgaaaattcttgaatctcatcttttccaaaatatattgaaataggtttgcatgctactatatgcagaagtaaaatgagcaaaacaattttggattacgattttttagaatttttagatagaagctcaatatgattgaatattaatatcaatgactgaatattaaagtttactttaacaaggagaaagtaacatagtagatcaggaaagactttctaattgtagaaaattttggaaaaagtagaaacctgagatgga

SEQ ID NO: 95892 - DNA, 476 bp, Homo sapiens
atggagagaactccaggctggaatggggaaggcatgacaaggcgttctatgtcttccaccaggtggttgaaccttctagacacattctgggaaggtctttacagaccaatatctctggaatacatttcaatgcactaaacagaccaatgcttcttctacagaccatgctgtcctgggtagatcaccactctgtgccttagttactttttctgtaaattggagccactcataatgggctactatctctccaggaatacagatgagatggtacatgtgaaatctcttttgaaaagaaggtatagcatgggctcaattcctaattccctcattcctactgatttttaaaaattgtcatggcaaataaaccattggaggtttcatttcgttcatctcacagataaaaatgtagacaggtaagcgtaggtcatccctgcttagtaaataggcgtgatcgtcaccgggccagtcagtgacag

SEQ ID NO: 95893 - DNA, 421 bp, Homo sapiens
accctagtgcaaaatccacaaatccggaatgaaaatgtaagcatccatgccttccagcatgctccatgcttttcccactgcgctcatggtaaatgctccccatggcatcaccaccgggaaccaaacacatgcatacatacgtatatgaagacagtttagccaagtggttaagagtgaggaccctgtggctacactgcccaggttcaaatcctggctctaccactccttaccaacctcagggaagtcacttgacctttctgagttttccatttccctatttgtaagatggaaacgctagtcataatcaactttcttggcacaacgatcaagagtcaaaataaaccaatatgtaaaaatggttttggaagttttttttttgagatggagtctcgctctgtcacccaggctggagtgcagtagc

SEQ ID NO: 95894 - DNA, 323 bp, Homo sapiens
tttctatttaatgtagaacccccaacatacctgttgtgtattagttttattatatttaacggttattatggtttccttgatgctttgcttaaagagctatcatacaaagccaggcgcggtggctcacgccggtaattccaggactttgggaggccgaggcgggcggatcacaaggtcaggagatcaagaccatcctggctaacacagtgaaaccccgtctctactaaaaaattagctgagcgtggtggcaggcgcctgtagtcccagctactccagaggctgaggcaggagaatggcgtgaaccagggagatggaccgtctca

SEQ ID NO: 95895 - DNA, 476 bp, Homo sapiens
aggtggctgctgtgtctagctgggctgagatccacacagcagcccgactgctgcgggtaccaccagagtgcctggagggggctgtcaccaggagggtcacggtgagcccgagggtcctggggagaggggcctggcctggctgacccacaggctgagtaagcaccatgagggctgcaggcctgacacaccagctgtgcctcctctgccctccaggagacgccctatggccaggtctcgcgatccctgcccgtggaaagtgccgttgatgccaggtggccctagagacgggtgagagtcagagcagggcccgaggcacggctctatgtggctcacccacccgccatgcctacagggacgccctggccaaggcactgtattcccgcctcttccaccggcttctgaggagaaccaatgcacggctggcaccaccaggggagggaggcagcattggcaccgtcactgtcgtgaaaaaaaaa

SEQ ID NO: 95896 - DNA, 220 bp, Homo sapiens
agctcaacatggattaagacttaaatgtaaggtctgaaactgtaacactcctacaagaaaacagaggaaaaagctttgtgacattgggtcttggcaatgctttcatcaatatgactccaaaggaactggcaacaaaagcaaaaatagatgacatcaaactaaaaccttctgcacagcaaaggaaactatcaacagagagaaaagctcacctatagaatgg

SEQ ID NO: 95897 - DNA, 291 bp, Homo sapiens
ctggattctgttattttttaaattgctctccagtggttctttttccagatttctctaaaggaaagctattcccttgctattcagagctgtgtccaaggaccagcacaaacatcacctgagtgctcatgagaaatgcagactccaatacctgctgagtcagaatgtgcactttccagaagctcctcaacgaattcatgacaatttgaatgccctgttccacactggtgtgcttccatattggtttaccctaactggcctttttggcctagcctcaacttctttcctattatg

SEQ ID NO: 95898 - DNA, 284 bp, Homo sapiens
ggtttgagttcatggccaaaaagaccggaggctgagctgagttagagagggccgctcctgccccctcccctgccaggattcaaactaccagtggacaccatcaaaggtaaaataccctggtcaattaaaaagtcaattctccactaaggagataagcctcaccgttagtcagatggaagtccttacctggggcacccaccacctgcaaatgctaatcagagaaaagcccatctcagaagtgactgaaacccccactcagcccctcaggctcaggaccccccacc

SEQ ID NO: 95899 - DNA, 1310 bp, Homo sapiens
tgtccaactgtttttcaccttttctaatgaaagtattctccaaagaacaaattggaatgcttccaattatagttgttcccccttatcctagggggacacattgcaagactccccaatgaatccctgaaactgaagtctgtatacactgccgaagcctaagtataccatgttttttagatctaataaccaagatgggctgatagcgtatacagcatggatacactggacaaagggatgattcacgtcctaggcaggagggggcaaactttcattttgctactcagaacatgctcttgccccatttaaaacttaggaattggccaaagtgctgggattacaggcgtgaccaccggcacccggccatgttttttgatattctggaataaaaaggatatagcagttgggataggcttgggttcttgtcctttatgttcttgtcctttcctcatgataatcaaatcataattagaaataagatgctaagaatacaaaggtggctctatgttaatactgtattgataggtcaaaggagaaaaagcatgagatcaattcattagatactgaaaagtcttttgagggaatttaatgtcttcttgctttctttattaacagaataggaataaataatagcataggcataaattaaaaataatgtaattttttaaaatctcaaactaaaaatgggaatcatacttaaacattagcattccccaggagagttggagcaagacctctgtgcccactatcactcaacatttcattatttaagtcctagcaagtgcaaaacagaaaagatgcataaatattagagaaggaaagttattttttgcaaatggcgtattttttatctggaaataccagagaatcaagtgagaaactttgaagaataaaataattcagtaatgatgcttcctaccctaggttaattaatataaagaagagttaaattcctatggcatatttctggtaacaaaaacatcactaaacttttaaataaaacccaaaacacttctagtattaaacatttaaatgagctgggcgcagtggctcacgcctgtaatcccagcactttgggaggccaaggtgggcggatcacaaggtcaagagatggagaccatcctggacaacatggtgaaaccccgtctctactaaaaatacaaaaattagtgggtgtagtggcccgcacctgtagtcccagctactcaggagactgaggcacgagaatcgcttaaactgaggaggcggaggttacagtgaaccaagatcgcgccactgcactccagtctggcgacagagcgagactccatctc

SEQ ID NO: 95900 - DNA, 341 bp, Homo sapiens
ttgcagtggcctcccaagttgactcaggttttggcatgtgattgacaacaggacatcagcaagtatgatgcaagcagaggtttgatggtgcagcacactgggatgctccttcctggacccagccacccactgggaaaagcctaagccacgtggagcagctacatagaagagggccggggccacagctacagccagcagctcctgccagccacgtgagagagctaccttgatgttccagcctccagagatctaagagcttccagacatctaccaccccagccacaccacctgagccaatgtcccacagagtcatgggagataataaaaggctgttgttctct

SEQ ID NO: 95901 - DNA, 272 bp, Homo sapiens
acacagaagctggggagccagtcaatagatcctcctagtgtttcccatgaaatcttaaaaaaaattttgttctgggaggaagcagtagaccattggttttggaatcagaagacttaggttctgatccagctttatagtctttttttttttcagctgcacgactttaggcaaatcctgtaacttttctgagtcaatttcatcctttatgacacgtgtgaggataatacctatcctacaggtttttgaggatgcttacaggagacaacatagtg

SEQ ID NO: 95902 - DNA, 101 bp, Homo sapiens
cttctaacctctggtggccaggtcagcctcaggaaggggctgggactgagtggaggggcctggaaacaactgcgcacactcgtatccattctcgggctcac

SEQ ID NO: 95903 - DNA, 427 bp, Homo sapiens
actgttattatgttctatgcggtagaagcaaaaattttaaaaaacttactttaaatagtagcattttagaagacagtacagaaatatccaagtagtgttaatatctctgccataaagacattcacaaattcaaaaacaaatttctactgaccatcttagtgtacagagtactgttctaggctctggggttatagcaataaacaatatatccagtccaaattcttaagaaatctacacttagctagggtggggtagaaggaaaaaatgataaacacaataaagtcagatcatgataaattctcatgaaaaaaaaaccataaaactcggtaagagattaaaagatggaagtgtttggcggtgggtgcattttagagagagtggacaggcaagacctttctgagaaaatggcatgcgggtataacataaa

SEQ ID NO: 95904 - DNA, 771 bp, Homo sapiens
agcggctgaaatatctcagaatggttaaaacatttaaaagcagactacccacaaaggaaatagaattaagcatctgaagagcaacacatgagtttccacaaaacttaagagaaaatgatttcaaatctagaatcttatactcagattaactattagttaaaggtgagggaaaatcatggcattttcaggtttatagtaatggctaatatttaatgaactcttactatgagccagttgtatctccatgctcgttgcaattattaacttatttattttatactcagaacagcccagctagttcggtactattattatcactggttttacaaatgaaaaaccagaagtatagagaagttgagaaacctgccaaagatcatgccactcgtagaaggcagagttgggttttgaatccaggaagtttggctgcagactctacactcttaactactacacaacagtgccactctgttggtcaggcactcagaaaatttatgtcccatgtagcctctttgaaaaaaaaaatgcttgaggatatactacaataaaatgaaaaaggaagtcaagaaagagggaagcgtcagatcctagaaagagtggcactaacctgggggtcaggccatttcaggacaacagcatgtctatgaaattaaaacagaaaatcagaacattccatgaaaaaatgtcatccaaagagaaagattctattgttcgaattgtatgattaaaaccctgaagttcttaatagtaaaatgatggcgtgtatttcccctg

SEQ ID NO: 95905 - DNA, 617 bp, Homo sapiens
aactgcatttaaagtgttataaataccatgactacataagctaagggaatgaatgtattaactctgatgcagtctgtcaggttttaacagtagtgaatcttgggatcggtacatctcattccagtatagctatggtaaatgacatagagatcgctgaattgttgtatttccaggacttttcaaaagtgactattaaggttggctgtgggatctagcaggttattgtcctagaacacttgtggccttctcctaaaacagactgggaaaattctggttctttattcactgacatctcaaagggcaaagagggaggcaccatgacattctgcagttgcaggcctctcaggatgagactgtatttttccatacagcaatgttgatttgatctggcctaattctccgattgatgtggtgagaggcaggactacttgggaatgtattcactgtgcctgatttctctctgggcaatttatttggtcatcaatctttttatcctcctgacatttgatttctagatattggcccaaattccataagataggaatttttgttctgaattttaataacatatgtattttaattaatagtatattttaaaataaaagtaatacgacaaa

SEQ ID NO: 95906 - DNA, 486 bp, Homo sapiens
cccacatccccacccaaactccaagttccctgaggacatttcctcccagaggaactgtgtgcattagttatcagcatgagttgtgccaaggccagcagagctcacagcaatgatcaggtcactctccactccatgtcaatcatcggcaggacattagtgcactacacatatgcagacatccattttctgactctaattatggatttatttggctgatggtggttggctccaccagaggcccctgggggcagtgttgaacctgaccaaggatgctaaagagagctaggtcgtgttctttcattctctcgcaaacaaccctaaggcctcaagaactccttgggtgtgctcagaccaggcgagcacccgaggaggcgagcaccagcatcactgacaaagctggcagagtcgggcatggcacagtctagggactagggcagtccctgggttccgttacccagcagatgacccttagacataacacaaact

SEQ ID NO: 95907 - DNA, 299 bp, Homo sapiens
cggccaaccagagaccaacaagggagcaaacccttgcactgtccttgcggaagggccctacccagcatcctgggatgtaactgggaaggatgtgtctcattagcacctctgccccacctctggaataccagctccaagccaaacacgtcccctctgagcagctgctgtgccctgcccccgagtgctctatgttgaggatcctccgggcaggaatggtgggctggatgctgagccctctacagttgtccccatgtccctctcccaccagactccactccccagcagcagtgggcaacctc

SEQ ID NO: 95908 - DNA, 374 bp, Homo sapiens
tttcatccagaattaattttggtcaaagagttcaatagggctacaatttatttttccctgaagaggcgggacagctgtcccaatataattcactaaagagcccatctttcctctgccaatctgcaatgccaactttactacaatgtctgcaacttaatctcaaatggtagagcaacaaacatatttagagtgtgtgtgtgttgaaattaaatcaaatgtggagaaatgttagcatagcaattattgaatcaagatagtacatttggccttcattacccacgggttctgtatctatctgcccattcaaccaactgcagattgaaaatactctggaaaaaaattttttaaatacaataataaaaaataatgcaaat

SEQ ID NO: 95909 - DNA, 385 bp, Homo sapiens
gagcctatgtctaggggagagcaccagtggaaagagaggtgacaatgaggatccgagagaggggacgtcctagctggatggaggagttagggagtgaggagggaaaggccttctcagaaatcccaggggatgcacgcatcggcctttacagtttataaagtacaccctgtacttccgctcttaaaatgcgcttgttaggaattatgattgctattttatgggaaaggaaacaggctcagagaagttaagcagcttgctcaagataacaagggggagagttgggatttgaacacagcgctctgtgcctgactcaggttctatctctgccacacccagccaaaaaagggggctagtttcagtgtgtattggaaatctgtctgttgga

SEQ ID NO: 95910 - DNA, 332 bp, Homo sapiens
ttcaccattttggccagactggtctcgaattcctggccacaggtgatccgcccacctggacctcccaaagtgctgggattgcaggtgtgagccaccatgcctggcctaattcttacgttatttctaagagttttcccattgattaattttggctttttggatgttcagttatattatctatacgtaaagataatttggccacctctttcaaatattgatgtcttactttacggaccaatataatttactagcagttcctcctcagtgttaaatcagcagggatatccagccctttgctctatcattgacttcttttctttccttctgccccc

SEQ ID NO: 95911 - DNA, 650 bp, Homo sapiens
ggcccaggactgagactaaggagatcttggcccacaggggctcccctgggggcactgcccaggagacaggggaggagactagactagggcctccaaacctgccactcgccagaaaggactttccaaatggaaaaagccacggggactgttgctgtcagtatcggaagttctccctgctgtctgccctcaaggcttcccactgtactgccctggccctgggctcacctgagattgctggggaaaagaaagggtcaaccgggaggtttagacacgtggagaaggagtgtgcctggctctaccagttggaactgggatcagaagtggagctgaggaggctggtccagggagaatgcagtgctaagagacgatgctgctgacaagcccggcctcaggctggagtcagactgccctgatattacattactgaggcacactaggctaaggctgacaacaccaaatgctggcaggaatgtggagcaacaggaacaggaattcgtggctgatgggaatgcaaaatggtacagctactttggaagaaagtgtggcagtttcctaaaaaactaaacatactcttaccatacgatccaggaatcatgctccttggtatctacccaaaggagatgaaaacttacgtccacatgaaaatctgc

SEQ ID NO: 95912 - DNA, 816 bp, Homo sapiens
aagatggagtcttgctctgtcacccaggctggagtgcaatggcgcgatctccactcactgcaacctctgcataccaggttcaagcgattctcctgtctcagcctcctgagtagctgggattacaggtgcccaccaccacagctggctaatttttgtatttttagtagagactgggttttaccatattggccagactggtctcgaactcctgacctcaggtggtccgcctgccttggcttcccaaagtgctgggattataggagtgagccactgcgcctggccatttgattcttataacacctttgaaagtaggcatgacaaatattataatcacaatgttacataatattatgctggttttagaaagaagggaactgaggctctgcagggtgcttagaagttttgctgctgaagtttaggtgcatttgcttctattcaatgtctttgttaccatctgaacaaccatacagttggctgtgatgctgaaaatgtcccgtcatgcacctacactgccacagacaatatagtgcaccttgacctgagctcagaattgcaggtatattaaatgttagtcttcaccatttaaaggcaactgtatttcctatggaagagactactcgttttctccctatgcatttcccccataagaatagaatttgtgttttttttgacttcataggtagctgtccagaataaagcgtacattacccagtacacattgggtcaagggaatgtcaggtgactaactaaattctagatgaaactagaagtgtcacatgacagcttccaaggcatagcaaggacatgctcctccta

SEQ ID NO: 95913 - DNA, 249 bp, Homo sapiens
taaaaattttttttgctattataacattgaaacttgcaaacatttttgtacacttcgctttattttttagaatcattgctggtatgaaaaaaaaatctcccaagttgagataattgattcaaggagtacaaagttttttccttgtttaaaactgtgatgacccagctacattgggaggctgaggtgggaggatcatttgagcacgggaaatctactgtattggcatcgttatcacttggatgtgtactt

SEQ ID NO: 95914 - DNA, 872 bp, Homo sapiens
cataccatgcttttgtcgaatggaatggaagagaatcttcgaacggacccgaatggaatcatctaatggaatggaatggaataatccatggactcgaatgtaatcatcatcgaatggaatcgaatggaatcatcgaatggactcaaatggaataatcattgaacggaatcgaatggaatcatcatcggatggaaacgaatggaatcatcatcgaatggaaatgaaaggagtcatcatctaatggaattgcatggaatcatcatcaaatggaatcgaatggaatcaacatcaaatggagtcaaatggaatcatgatgtagaaatgagagtctaataagaaagacagaaatatatagaatcatattttaaaatgttttatatttgtattggtcttctacgcttgtttaacatcccccgccacccaccccaagcctaaatatgtcactattgttattatcatttgcttcttgtctggtttctttgccagagagatgaaaacaaatcatttttttgctcaaggtaatgagaaagaaaggaagaaaaataggaaaacagaaagaatactggatactttgaaaggacatgatgaatttaagtgattgggacagcttgaaccgggtgtattcagcaatataaccccttgctgttatgccactaaaatatttaccattgtcacttgctttcataattgctatgggtctttgtgagttttaaattgattttgccacttgtgcctgtttgtgttctctggctcatttagatttaaacatttatcagtgaggtaaataataaattttgcttgatttgaaaaattgggctgttgtgctttccatcagtcattttgtgaattaaatcagatttcaaatgctactt

SEQ ID NO: 95915 - DNA, 834 bp, Homo sapiens
aggccttggtttgctcactgctgaaaaaggagggctctgcatctttttagatgaacagtgctgcttttatcccaataaatcaggcctagttcaagatgcagtaaaaaaactcaaagattgagcccaaaaaataaaagaaaacacatctgctacctggtccctctggtcctcatggtccctcagctcctgggttccctggcgactacccctccttggcccagctataaccatctttcttctgttagcttttggaccctgcttcatgtgtctccttatccagtttttacaggaccacatcaaaaccttcacccatggaacagtgcgaggtatactgctgcttcaagcataccagcggcttcaagaacaaccatcgcaagccccccaagcctttccccttgcacaccgcccctctacagctagaagcagtcagatgataaagtcactcctcttcctttatcacctattaaaggctggaatgttagagagccaagctacccctcctcctcctccatgacctttgcaatacggtcctttgtgaccacctacaaacacctccccactttttctacagccacttctgcaagactttcagtagaactggtaaacagttccaggatgtggttaagacatctgcccaccttgcctagccaagcttgcctagccaagcaggcaaaaacatttccaggaaatggttgaaacacctgcaactctactcagtttcccccaccccaacctagcaccttgccctataaaaccccacagcagcctgtaagcggggctacctcctccacagtggagcagcccagcaggttaataaaaacttgcttgcctgac

SEQ ID NO: 95916 - DNA, 4412 bp, Homo sapiens
ccgcgctctctgatcagaggcgaagctcggaggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatgactatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagatatttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcattttgtgttgttgttgttgttgagacagagtctcgctctgtcgccaggctagagtgcagtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgataatgtgcttctgttatcaaacaccaacataaaaatgatctaaacc

SEQ ID NO: 95917 - DNA, 3527 bp, Homo sapiens
  misc_feature (3527)..(3527): n is a, c, g, or t
ccgcgctctctgatcagaggcgaagctcggaggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatgactatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagatatttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcattttgtgttgttgttgttgttgagacagagtctcgctctgtcgccactgcactccagcctgggcaaaggagn

SEQ ID NO: 95918 - DNA, 1633 bp, Homo sapiens
cgagctcggtaccctcgattggcgggcacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcattttgtgttgttgttgttgttgagacagagtctcgctctgtcgccaggctagagtgcagtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgataatgtgcttctgttatcaaacaccaacataaaaatgatctaaacc

SEQ ID NO: 95919 - DNA, 3847 bp, Homo sapiens
aaagtatcactgagcctttggctgagtctgatacagtccttatatacagacaatttttttttttccttgagacggagtcttactctgttgcccaggctggagtgcaatggcgcaatcttggctcactgcaaccgccgccccccaggttcaagcaattctcctgcctcagcctccagagtagctgggattacaggcatgcgccaccaagcccagctaattttgtatttttagatacagtttcaccatgttggtcagactggtctcgaactcctgacctcaggtgatctgcccacctcagcctcccaaagcgctgggattacaggcgtgagctaccgcgcctggccccatttaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatgactatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagatatttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcattttgtgttgttgttgttgttgagacagagtctcgctctgtcgccaggctagagtgcagtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgataatgtgcttctgttatcaaacaccaacataaaaatgatctaaacc

SEQ ID NO: 95920 - DNA, 476 bp, Homo sapiens
acaggtcccaagacttacagatgcaaatgaaaataactacttcgccacttatttaaggaagaaagaagaaaggaatcatagcacagagaatatattatttctccaagccagccaacaccacaaatagaggaaacttttccagctgatggaatgacaacttcagtcaattctcccatggggaaaaatgctttttatgaacactgttccttccaattcagctccatttcacagtgcatgattatcttccattttattgtcaccaaggcaccagagaaaacaaatagaataaagacaaccattattaacaggtaatagatgtttttcttgcagttttagtggtaaattaaactttaatggcatctgttcacaatgaaaaatgtaaccaccttagtgataaatatgctttaatttcaaatgtcaaattataacttgttttcatttaaatgtaaaataaattcactttccatcataagaaa

SEQ ID NO: 95921 - DNA, 1138 bp, Homo sapiens
taaggaatgcattaggggtgtgctgggaaccttttcttgagcgatgtcttaaagccagcttctcttctctgtctctgataaataattggaaggaaaggcaatgaatttttttctgacagttggttctaactgggggccagggcctcgtttgcaaatgaaaggactgctgttggagtagttgaaatcacaatgggccctgactcttttcacatcaaagtgtaaaagaatctccaggggtgataaatgggggctgctggactcattacttgtaaacaaagctgagggatgacctctacatttttttttaattaaaggaaaacagggtttcctagtggtgagcatggggctgctcttcgtttgaattttgactgttcacactggaaaagatctttctttaaggttacaagggagctgccgctgttacccaggatttaccctgaatctcaaacactactggaaaaatgctgtgcctaggacggcccagcaggtatcctgcatgtgttgagaattgaagtgcagtgggttccgctgcgttgttacagtaaagtggaacagggcagaatttctgagtgctgctcctctcaggagactgagggctcctttactccttttcccacccgacatcaggaggaaaactcctttattcctgtgcagtgtagaaaaaggtccgtttttaagtaaattcttagctctttgtaaaagaagtccaaaggcagtggttttagagtttaaagatagtatttctttatatttgtgtagttacaaggctttgagtatgatcaaaacgtttaaccaaaactaaagtatgtgcatactttatggtgttgaaagcaatgctactaaaaatagtacaacattttatgggattaagattgcaaattgctgcctaaattcagcttgcagttaaggcctaccttcagtaaactctcgttgtgtagtcagctccccaccaagcttatctcttgctgtttttccacttggctcctctgttgcagtcagtccaagccctaccagattttaaacaactggaggtcagagactgccctttgtaacctgagtggaactggtaaggcactgggcacccaagaattctaatgtgtttactgactttccacatgtttagtaatcaccttctgag

SEQ ID NO: 95922 - DNA, 421 bp, Homo sapiens
taaggaatgcattaggggtgtgctgggaaccttttcttgagcgatgtcttaaagccagcttctcttctctgtctctgataaataattggaaggaaaggcaatgaatttttttctgacagttggttctaactgggggccagggcctcgtttgcaaatgaaaggactgctgttggagtagttgaaatcacaatgggccctgactcttttcacatcaaagtgtaaaagaatctccaggggtgataaatgggggctgctggactcattacttgtaaacaaagctgagggatgacctctacatttttttttaattaaaggaaaacagggtttcctagtggtgagcatggggctgctcttcgtttgaattttgactactaaacaagagagtctcatctagtagtgacggcaaagcggttcacacgag

SEQ ID NO: 95923 - DNA, 407 bp, Homo sapiens
ctgcggcccccgcccgcgggtgtcctgcttaccgcgcgtggcggttccgggccagacctggggccggctccgagtctcttctgcgcgtggccgtggcgcggaggggcgcgcacaaactttctcaagtccggtggcgccgctgggccgctcttggctgcaagctgggctcccccgcctcctcccggggcttcggtggggcacccctggtgccgtggccgcacggcgcggaggggcggccgacctgagcccaggtcgctgacgttggcggggccggccctcccctcccccgctccggcgggggcgccgtgtgcggccagggtgggggtccctgggaggccagcggggtccttccccccaggtggcggcggggcgggggtctgggcgcagaccgggcggcggggcccccg

SEQ ID NO: 95924 - DNA, 1418 bp, Homo sapiens
tccaaccagtcccactgatatgaactgggtacctcagttggaaatgcagaaatcacccgccttctgcgttgatctcactgggagctgcagaccagagctgttcctatttggccatcttgccagcaatcagaccagagttttaaatggactacaaaataggtcaaactctatttcagaactagaggctaggaataatgtccaaacttggttatgaaagtttttttttttttggtctggtaggataagagggtttttactcatcttaagtttgaattaaactttgtaacaaagttattgtttttttaaacaatgcatgtatcaaattatctgtctcattagataactaggtagacttttccaagatggtttcaaaatcaaatatatattcaaagatcttccagtgtaaagcaataggaatgaaacaagccatgagaaagcagaatattttgagtatattctcatgcctttctttaaaggagaagcgcctatctaaacagttacagaaacccaaattcaaagtagattaaacaagaagtaaatttgtaaactcttttaactgggagacaggaagtagggagggctccaggcacaatatcattagcagttcaatgtgaacgaagacccatgtcctttccaagcctccctctgccatcagcattgccctccttcccagggtcacagatggctatcaatggcaaaactggggttccgcgttctcttctcctcatctggcaagagaaaatgggaaatctctatcccaagcttggattaaaaattattttcatttttgtgttccagcaaacttgggtcctatgcccagccatggaccaaaaataggcttaatgtgaatgttatgtgctgattggattaaaataagttctgactctgaatctgggaatgtggtcaccttcctcagagacaagttgagaggttggcttatctgaataaaagcagagaatatgagatgctggagaggtgttcattaaggagaacattccctgaggtgaattaacggttagaattatctatctctgtatttatctatccacccatctatcatcatcatcacctcatctccctcctttctctctctctaaatatatacatgcgggtatgttgagtgtgtatatatttattaggtgtgtaatatggtgtgtgtgtgtgtgtattccaggcagatgtgtgcatatatacccaaactttcctgatgaccttgaaattaaatgggtcatgtgaagctaaagattatagaaccccttgattcctttataaacagtatttctaagataagatcaacactaatctttcaaattagttgactgtgtatagaacaacttgtttatttaaagtcatctagtctaatgcaatcaaggagtaaattataaataaccagttagcataaatggaaagaaaatagt

SEQ ID NO: 95925 - DNA, 407 bp, Homo sapiens
agacagggtcttgctctgtcacccaggctggagtccagtggcatgattatggctcacttcagcctctatctcctggatgtaagtgatcctcccacctcagactccaagtagctgggaccacctccgagtagctggaaccaccacagctggctaatttttgtactttttatagataaggggtctggttatgttgcccaacctggtcttgaactcctgggctccagcgatcctcctgcctcagcctcccaaagtgctgggatcacaggcatgagctgttgcgcccacctacaccttctttacacagtcggctggtgcttgcaggtgctgtgctgttttctgggaaggttggctccatcacgagccatccacttcctcgccctgtgtcatcatggacatggcagtaaagc

SEQ ID NO: 95926 - DNA, 447 bp, Homo sapiens
gacaggtttcaccgtcgggagacagcaggcctgtcctccgccctcccagccacaacgtgtccttctgtgcacgtttcagctgaaaccttgcatttagttttctaactcagagggtttgtcaatcttttacctgcgaactcctgttcctgcctcgaatttctccactacgtccctatcgctgattccctgttttccaacccggccatggcttactccagggagaaggttgaactttctacacacgagtaactcccacccctgaatggtgtgtgcgatgactgcggtctgaaagcatgaacgtgcccaaactccaatttcacccactgtcatgatctattcttaaaagatggtgattctgggaaatgtttctgaaaattgaaagtgagataaacagcaatgccaactctaaggagtgcctgcaaggagcccgcgggcctgaccatgccc

SEQ ID NO: 95927 - DNA, 348 bp, Homo sapiens
tctccaaaatgctcatatatagtataattattgtaaagacctaactaaaaaatagggttggtgaaatattttttttcccctgcatctcagattttttaaaataaccagaagtcacctgtaatcccagcactttgggaggccaaggcgggcagaccacttgaggccaggagtttgaaactggcctggccaacatggtgaaatgccatctctcctaaaaatacaaaaattagccaggcagtgtggtgcacacctgcaatccagctactcagctgaggcaggagaatcacgtgaaccagggaggcagaggttgcagtgagccgagattgcacaaccgcaccccagcctggg

SEQ ID NO: 95928 - DNA, 690 bp, Homo sapiens
gttttgaagagacgggtctcactttgttgcccaggctggtgtcagactcctgggctcaagctaaatcacccaccttggcttcccaaagtgtcgggattacaggtgtgagccactgcgcccagctctgattttgtatttcttacttaaggcgacatacttagtagctgtgcgtcttggggcagatacctcccaaaatgctgggattacaggtgtaagccaccgcgcctggccgtagtttttaaattttctgtagaaacagagccttttgctgttgcccaggctagtctcaaactcctgcgctcaagcagggtcctcccactttggcctcccaaagtgctaggattacaggcacgagccactgcgcccagttgaaggttttctgtttagaattagttttttaaagtttcagttttatatcattagattaatatatttgccatcatatgatattgtgtctttttaatccagaaattgtagttaatttgcagaagattgcagttactctgcagataaaattgtatacgttttctttgaatctacaaaaagagtccctttgaaagaaaaacatttttaaatgttctaactgaacatccattccctattgaattaagaatcaatcgtggaacataataggcggtggagtgtttctagggtatattgctttctatatttttgttttttttggaatat

SEQ ID NO: 95929 - DNA, 745 bp, Homo sapiens
tgcggcttctttaaagggaaggcaggaggcggacagcttggctgtgaccctttagcgctgggtcgcgtgtggcccaccctcggcctgaggcattgttgggtggttggaggtggttgtagtatttggaaaagaacttgtccctgaagggctcaggggacttggtttctcagctcctaatatggaaaattaaggcatttcttacgagatgcagattttaaagcaggcatatctactcgacggctttggattactgcactgcacaaattccagtctctgtcggttttggctgagaagagctgtgcttctcaccagctactggtgagacattcgccctacaggaaagggtcggtatgattgtggacattgacatgcgtagcaaaagaaagtggctaatttgcgccaataataataaattagcttgtatttgaattagccaagtctttgcggttttgctaacttggcttcactttgcatggagtgggaagcgcctgcttctgaaaaggtgacttttttcctaattagaatggactcctcttaaggccatgcagttttcaaagaagaaagacaagctggacgttttgttagtaacaaaatgtagctgaagcagagagagaaggcagcatacgtcagcattttcttctctgcacttacaagaaagatcaaagactttaagactttcactgtttcttctaccgctatctactacgagcttcaaagaggaaccaggagtatgggaggagcatga

SEQ ID NO: 95930 - DNA, 520 bp, Homo sapiens
ttgggtgatctaaggatcccgtcgaggtaccaacacaaaactggtcattatcactataaattccaaaccttttctcactcttatcttttctgtaaagaggtattcaatcccctgagtttctgttatcaaaggcaagatatacaaggacaggtagtgtcctgtctgttctcttcaacatggcacatacagcaccttgaacttggtgtcttatttcattcatgtttttatatccattaaaataagctttgtttgtttgtttttttgagatggagtctcgctctgtcgcccaggctggagtgcagtggtgcgatcttggctcactgaaagctccgcctcctgggttcacgccattcccctgcctcagcctcccgagtagctgggactacaggcgcccaccaccacacgcggctgatttttgtatttttagtagagacagggtttcaccatgttagccacagtggtttcgatctcctgaccttgtaagtccacccgcctcggcctcccgaagtgctgggattac

SEQ ID NO: 95931 - DNA, 373 bp, Homo sapiens
ttcaatcacatttgctctgcctcttccaaattaaccccctaccaccttgaacttggtgtcttatttcattcatgtttttatatccattaaaataagctttgtttgtttgtttttttgagatggagtctcgctctgtcgcccaggctggagtgcagtggtgcgatcttggctcactgaaagctccgcctcctgggttcacgccattcccctgcctcagcctcccgagtagctgggactacaggcgcccaccaccacacgcggctgatttttgtatttttagtagagacagggtttcaccatgttagccacagtggtttcgatctcctgaccttgtaagtccacccgcctcggcctcccgaagtgctgggattac

SEQ ID NO: 95932 - DNA, 740 bp, Homo sapiens
agcggagtgggaggccaaggtgggcagatcacttgaggtcaggggttcgagaccaccctcaccaacatggtgaaactccgtctctactaaaaatacaaaaattagccaggcatggtggcgggcacctgtaatcccagctgctcaggaagctgaggcaggagaattgcttgaacctgagaggcggaggttgcagtgagcagagatcacgctactgcacttcagcctgggtggcagagctaggctctgactcataaaaagtaaaaataaaataaaaataagaaggaattacaaaatggaaccttttctttaataccagcctctaccacacaatcccattcctcctgtctcctgcagaggtagcctaaagattaaaatactcaacaaatttctcacaccaccattaaagctgcttaccaagaacttccccagcattttgacttccttgtttgatagctgaattgtgagcaggtgatagaagagcctttctagttgaacatacagataatttgctgaatacattccatttaatgaaggggttacatctgttacgaagctactaagaaggagcaaaagcatagggaaaaaaatctgatcagaacgcatcaaactcacatatgccccatctactacaaacagattgtagtgctgtgctggtttattccgttgtgcagaactgcaagctgagtcactaaaccaaagagaggaaataataggttagtaaacattgtaatcccaggaac

SEQ ID NO: 95933 - DNA, 380 bp, Homo sapiens
tgagaagctacaattccaacggacagctctgtgtgcatggctggggctgccacttgggaagtcctactgtgtgacgattgtcatctggaggtctttaggactatgtaatgtctctgttctcttttctgggggatagacccttggttgctgacattctgggagcaaggcaggggaacaggctgagagggccgtcccattcggtatgcatattttcacttgatctcctcttttcagccatatgttttgcctccactttctactaaggcttgtatccccaaatctggaatttctgcacagaataaacatctaatcttctgcttccacaggcctagctacctaaagtagggggatccacctgctccttatacgtattttctgcc

SEQ ID NO: 95934 - DNA, 179 bp, Homo sapiens
cacatgtggcttgcgtatattcctgttgaatagagctgttctaaagctattagttggattaaaatctgagtgcataatgccttaaagtcacccacagaatagatatgagtgaaatcgtctgtatttttgtcaaatgcggggtaaagatagagctggttaatccatagacacccttcaat

SEQ ID NO: 95935 - DNA, 351 bp, Homo sapiens
gaaagagagaaatagactgagtggggacatcatttgaaggtgaaagattaaactggaggtgtggcagacagaataatggcccccagacatgtccacatcctcatctctgaaacctgtggacatgttgttttacatggcaaaaggaactttgcagatgtaattaaggatcttgagataggagaattatcctggattatttgggtgggcccactgggtccttagaagagggaagttagaaggtcagagtccggccaggcgaggtggctcacacctgtaatcccagcactttgggaggccgaggcaggcggatcatgaggtcaggagatcgagaccatcctggctaacacagtg

SEQ ID NO: 95936 - DNA, 523 bp, Homo sapiens
tcagatgtgcatcaggactaagaggagtacgggggctagaatgtgctggacaggtgagggtgaaacctaatagagtggtataagttagggtgccaaagtgctgagagggcaggtttgagtaccgagggttaggccaaggtgtatgaggggttaagactgagatcaggtccagatactctacaacaagtttagatttaagccagagtagaggccaggttgagtggggccaggacttaaaggtaaagatttggagaataaggcccagatgtaaggtgattcaagaagggaggggctagacctctaggagtctctagaggtttttgatgacctctttggctctgtcccccacatcaggacttttgaagactaagtgaaacggtacatgcagagtgacctgagcatagttggcatagaactctaatcggtctcccttaagacttcctgtcttcactgacaaactcctactcaacttttaaggccttgctcaaatatcctctccgtgaagccttctccaagttccact

SEQ ID NO: 95937 - DNA, 713 bp, Homo sapiens
cttagaataaaaaacttttaaagtcagcaatatgtgaaatatgtattgaatatattatgctatatttatctgagtattttggtttaacaaattaaatgcatatttttttctttttaaaaaatgtattgaccatatttatataactacttatctttttatttggtagatttaagtaaaatttattatttatttaacacttttgaatttatattatacttgaagtggtttatttatccttggccagctacccccttgagactctggctttctattttatagaactattttaatgatagtttaaacatgtatacctgttactggttattttctgttccccttatcttgggagttcagcataatgctgtgcggatcaggataacaaggtcccactgaggtgaaggagggaggctgggaatggctacagcctggagtggaggtgtgatttcagtaggtggaaggttgtcttcctgaaaggaattggcagaagtagattcttactgattcagatacattttccaccaactgaaggaaggaattattaaagccaatggtgaacaaagcatttcaagcattttataggaagtgactagatgaggagatttttttcattccttttttaatcagcaaaaaagaaattagtattattgaattagcagattcttcctattctatattaagaaagatttaatttttgtaccaaggaaggttaggtg

SEQ ID NO: 95938 - DNA, 439 bp, Homo sapiens
acacactctcaccccaggcgcaaatccgttgtcttcataggaaggagaaagaggggtggtggtgaagggaaacactatcctcccaagcagggaagagatgacaaaaattaaattgcgctctctgctttcgccccagctctgccaccggactcggtccgcaaattccctaatcgctccgagctgttcagaatctcgcaaacaaagggagaaaactctttcaagtgctaccaaacgaaagttcgggttgctgtgcggcgcagaataaaacaagcacacacacgtctacttccaaacctcgcttcaccacgctaaaaatccgagccatttcaagttccactgcctccccagacccagcaggcttggaaggagagaaaaacctgctctacccagccaggtcccttcctttggagaagttataagccttccatggcacccgcta

SEQ ID NO: 95939 - DNA, 838 bp, Homo sapiens
agcggaaagaaattctaatggacaatgccttattgagcagctgtggtcaaatatttattaaaaaggacgtattgatttgcagattaaaactgaccacatatgaactcttcttttccagtgacattcttatttaaggtattgattaaagactttttatgcagaaagcatttttcttgtcagctcagttatgctggcttttgtaataagctaatttgatttccttttttaacctttgtttgattaggggaacagacatttgcattaagattcaagagagatgaagtctatcatcgatcttgacttcctcatggacctcttgtactcagcgaaagatgatttagagaatgtcaagaatcttggaacaaccgtaatgagagagaaaaaaaaatcacttcagacttatataccaggaagggcttatttgacagaaagggcaattgcatttggtggatatgttttagagaaatcaaatccaggaagattaattttgttcttaggccaaatcattaaaatatctatgggataagctgccattaataaagtacttgctagttaaaccaaaacatttcaaaacatccaaagagtttaagcaaaacatatacattattacttgtcacaaagggatactaaaagtaaattctagtatttctttataaacatgttcctagtaaaacactaacttcagacaggtttggaatttaatcctctattgctttctctgagaattgtgggggtaaaacactaatagattagcccaagtctttcatgagtgtacccaggattaatcctctttcacaataggactcaaagctatttgcaaatttttttttaattaaaa

SEQ ID NO: 95940 - DNA, 264 bp, Homo sapiens
agatagaaatttctgatacagcctctagaaaggctgtaccactttacattttgcaggatgcatagtcacagtgctgtctccaatactgtttatgatacttgttatagtctggtgttactaagtttttaattaaatttttagtttatatttttatgagactaatggacaattttttcttgtgtttgttggcaatgtttatctctcttttgtgacttgtcaattcatatcttctatcctttttttgagacagagtgttgttctgtc

SEQ ID NO: 95941 - DNA, 1520 bp, Homo sapiens
tcagttgtcatactgggctgctgtcagagaatgtttttttacatgaatgaacagattaaaaatggaataatatggtcgggtgcggtggctcacgcctgtaataccagcaatttgggaggccaaggcgggtggatcatttgaggttaggagtttgagaccatcctggccaacatggtaaaaccccatctgtactaaaaaaatacaaaaattagccgggcctggtggcatgcacctgtaatcccagctacccaggaggctgaggcaggagaactgctcgaatcccgggaggcagaggttgcaatgagctgaaatcgcaacactgcactgcagcctgggcaatggagtgagactccgtctcaaaaaaaaaaaaaaaaggaataatatttgaactacagagcatttttggggtcagcatgagctgctctagtaaggactcttgagtctgggaaaagtggtatcactataccttctccccactcctcacccacccgagcccatacactccctgcttttcatggatatgtattgaaaacaggtgcttctcagaagcactttgcctcaaccagagttatgtatgccctgcctatcttcccttcttaaccctgtaggaatatggatttacttttccaggaaaggggatagatttacatttctaggcatactctcaggtcctctatgtgatgtttgtgaaaggaattagggtgtgtcatgtgtgccatgaaacaacaaaaccaactaccctagaatcatttatgcagggggtactagagttagaaataataatgagggcagataacatttgtacctcagtctaccaaaaaattatagtactaaatttaacttctaggcgtttcctggaagcagatgctctataatttgtgatagcattctcataaatggagtcctacacataattggacagagatgtggaaatggtggtttccttctgataagggatacagtggaccatgtcgcttatatatcaccctactaggggatataattttcccttctaagcaagggaaatggcagtgctaaatagttttgtaaagtttttgaatgagaagcttttaggtaaagataaactgtcataatatttttcagatgcatttgcattgactatgggagaaaaattagggggaaatgacagtcatggtgtttttttttaattttaaggactgaaattctgttacatgatgtatgacaatataaaaacatacttagttttatactaaatctttttttaaggtcttggcatttaatataaagcaaattcacacgttttctaactttccataagttccaaaaagggaaagaagaaacctcagtcttgaaattttgatttttaaaaatcatgacactgttttaccatgaaattgagtagctaacttttggtaacaccttttgtttctttgtatgtttgtaataatggacattttaaaacacaggaatgttttggtttgtacagactttgacaaatgtgtgttaataaaaattcatattgactcaagtgtaaaagt

SEQ ID NO: 95942 - DNA, 1466 bp, Homo sapiens
tcagttgtcatactgggctgctgtcagagaatgtttttttacatgaatgaacagattaaaaatggaataatatggtcgggtgcggtggctcacgcctgtaataccagcaatttgggaggccaaggcgggtggatcatttgaggttaggagtttgagaccatcctggccaacatggtaaaaccccatctgtactaaaaaaatacaaaaattagccgggcctggtggcatgcacctgtaatcccagctacccaggaggctgaggcaggagaactgctcgaatcccgggaggcagaggttgcaatgagctgaaatcgcaacactgcactgcagcctgggcaatggagtgagactccgtctcaaaaaaaaaaaaaaaaggaataatatttgaactacagagcatttttggggtcagcatgagctgctctagtaaggactcttgagtctgggaaaagtggtatcactataccttctccccactcctcacccacccgagcccatacactccctgcttttcatggatatgtattgcctatcttcccttcttaaccctgtaggaatatggatttacttttccaggaaaggggatagatttacatttctaggcatactctcaggtcctctatgtgatgtttgtgaaaggaattagggtgtgtcatgtgtgccatgaaacaacaaaaccaactaccctagaatcatttatgcagggggtactagagttagaaataataatgagggcagataacatttgtacctcagtctaccaaaaaattatagtactaaatttaacttctaggcgtttcctggaagcagatgctctataatttgtgatagcattctcataaatggagtcctacacataattggacagagatgtggaaatggtggtttccttctgataagggatacagtggaccatgtcgcttatatatcaccctactaggggatataattttcccttctaagcaagggaaatggcagtgctaaatagttttgtaaagtttttgaatgagaagcttttaggtaaagataaactgtcataatatttttcagatgcatttgcattgactatgggagaaaaattagggggaaatgacagtcatggtgtttttttttaattttaaggactgaaattctgttacatgatgtatgacaatataaaaacatacttagttttatactaaatctttttttaaggtcttggcatttaatataaagcaaattcacacgttttctaactttccataagttccaaaaagggaaagaagaaacctcagtcttgaaattttgatttttaaaaatcatgacactgttttaccatgaaattgagtagctaacttttggtaacaccttttgtttctttgtatgtttgtaataatggacattttaaaacacaggaatgttttggtttgtacagactttgacaaatgtgtgttaataaaaattcatattgactcaagtgtaaaagt

SEQ ID NO: 95943 - DNA, 143 bp, Homo sapiens
aactggacactaaaagggagaattttaccatatttaaattttacctcaaaaaaacaggttttattttattttttgagatgggacagtggcaggtctcactatgttgcccaggctggtctcaaacttttgggctcaagccatcc

SEQ ID NO: 95944 - DNA, 413 bp, Homo sapiens
tgttattttaagacagaataagtagtatacccagagtacctgttacctttaaacatggctcagtaattgaaaggcatattactagaagtatttggagataattataatacttggaatatcaacagataaaaatactagttgatttttcccctgaacttcagagacactcatttgacctccaaaatagaatgccttgttcttgatactcattttttcgtttaatacattcagtgttcctgctgcaggtgccaaatgccagccttgagtttcgtgcttttaagtagaggtatagaaaacacagagcttatggagcccactctttctcagtttatgttactttcactgtgagcacctgcttactgtttggcaaactagacataactgttcagcatctgacggataaccctgctgag

SEQ ID NO: 95945 - DNA, 409 bp, Homo sapiens
caaaatattgttatttcaacatataatcaatataaaaattacttaagatactttatattattattatttatttatttttgggacggagtttcggtcttgtcgtccaggctggagtgcaatagctcaatctcggctcactgcaacccccgcctcctgggttcgagcgattctcctgcctcagcctcctgagtagctgggattacaggcacccgccatgatgcccgactaatttttgtcttcttagtagagacagggtttcaccatgttggccaggctagtctcgaactcctgacctcaggtgatccacccacctcggcctttgtacccaagtcttcaaaatctcttgtgtgttttctagtatgtctcggtttgcaccagccacattttaagtgctcactagtggctagcg

SEQ ID NO: 95946 - DNA, 422 bp, Homo sapiens
tagatggagtccagagggaagatggcagatcctcccctgcctgggatcctgtctggaaggacagaggaagcatcagctggaatggcagtggtctggagttttgagtcttgcagccgcccttgcttaatcagttgactcagctacactgcctttgagggagtcccttgagaggccagggcacacagtttccagggctggggccattgttcacagacagagccttaaagcaatgattcccaaagtttgtggcttgctagaatcacccggaaatctttttaaataaaatcctgatgcccagattcacctatattgttaaatgagaatgcccgagggccggagccagagtcggtaatctgggaatctctgctttgagtgtgcaaggcagagcttcaggcctcagagtggaaccaccgcacgcttcc

SEQ ID NO: 95947 - DNA, 446 bp, Homo sapiens
tttcctgtgcctgttccattccttcaaaaaaatttttttttctgtaatttacccatcactatatatttgatgtgctctactaaagtccaaatacttaatgccatttaaaaatactgtttcattttaacttgatttttagcaatgggcagtcaagagtgcttgctgatagaaagttagacaagggagtccaggaccttatggagacaaataagacatattttgaaacatagtgatggtgcccagtagctgacctgttccaacacttggatgctagactcctagccctgcctgctgcttactaactgtgggaccctgggcaagatttttaagctctgtgggcttcagtcttctcatttataaaattgggataagaatatcaccttgccagagggctgattgctggatacagcagaggcatttgccaggttatacaggtaagaatggcc

SEQ ID NO: 95948 - DNA, 332 bp, Homo sapiens
gcgccggtggtcctgagccgagatcaccatgacgtgagcggcaccgacagcccctttagggagacctccaacatttacgacggctctgccttctgtgcagacatggctgtgcagaacttcgtgggagatgcctgtcgcggagccacctgggtcgcccttcacaacggagggggcgtgggctggggtgaggtgatcaacgggggattcggcctcgtgctggacggtaccccggaggccgaggggagagccaggctgatgctcagctgggatgtctccaatggtgtggcccggcgctgctggtcagggaaccagaaggcctatgagatcatctg

SEQ ID NO: 95949 - DNA, 396 bp, Homo sapiens
aggtaggtatctagttttactctttttgcatgtgaatatctgcttgtccccccatcattgttgaaaaaaactattctttccccattaaatgatcttgggacccttgtaaaaaaatcaattgactatagatgtatggggtccagaggattttaatggccagaataaattaggatatgtttgagatgattaaatgcagggtttctcaacagtggtactgttgataattctttgttttagggtccatcttgtgcattataagatgtttggcagcatgtctggcctttatttattagatgccagtagcacctcacctccatcttagtcataacaaacaacaatgtctccagacattgccaaatgtcccctggagggaggggagcacaattactcccagct

SEQ ID NO: 95950 - DNA, 446 bp, Homo sapiens
taaaattaagaaaaatgtctatggaagtcaaagttcccctcaaactgttcattcttgcataaaccttgatatcccagagaccaatatctcaaagcatagttataatcactgacttcccaaccaaaggcttctgcagcttctgcttgcctgcagttgtagctcctaatctcattatcatcagaagcgtgatgcttcagactaatcataatcatgattatgattcaggattgcaggagtggggctccaacacatgcatgtttatgaagctcccacgtaattccgatggtcagtgagactaaagccttttgatgagaacttgagctcctcctgcttcatagcctttccctccatccctgctgcgtaattatcatcgatgactccaccatccaggtgggtgacctcccaacacccaggcctctcaattctttggccttctagccaccaat

SEQ ID NO: 95951 - DNA, 483 bp, Homo sapiens
cagagagcttgtgtatttaccttacggtggatggcttctgtatttttatctctaggctaaccttacctgctgagctctctgtatctgtttatttatttactcttcatttattcaaaattatttttaaaaattgagaacatactgtgtattattgctttgctgggctctggagaatttatattctactgtagtgtttctccagttgtagtttactgccagcctgcatcatttggtatgcttgtgaaaaatgcagattcctagtctcttcatctggtttattcacttgtgatctctacctgtgggcattatttatactacaagttgcaaacctctggtctcctagatgagatgtcaccacttgatgtcttgagagtaaattaaagttcgtatgttcaaaagttcattactctttcccatctctcattgtgcccagattttatgaatggcaccactagttaccatagcctgacccaggtatacccc

SEQ ID NO: 95952 - DNA, 587 bp, Homo sapiens
taaatttaatttaattttatctttatagagatggggtctcactatattgaccaggctggtctcaaactcctggcctcaagtgatcctcacatctcggcttcccaaagtgcaaggattatgggcatgagccactgagcccagcctaaacaaagcttttaaaagctcctgcaacctcaaggttgttaacctggtcatctcatggtaattagaaactctgattggctgctttagatttcttgattaaaaacctaagtaaactgattaagttttaggcattctttcaaaggtttctcagtgaaaagattgggaactattctatttggtgctttgtgaaaatattttgaattagtatatgtgccagttattgccatttcttaagtccaaaatgtttttctggtcaaataaatagcagtttttcaaaaacaaaaattagctgtgtgtggtggcatgcatgtgtagtcccagctactcaggaggctgtgggaggactgcttaagcctgggagatcaaggctgcagtaagctaagatggtgtcactgcactccagcctgggtgacagagtaagaccctgtctcagaaaaaaaaaa

SEQ ID NO: 95953 - DNA, 427 bp, Homo sapiens
acctcgtgatctgctggcctcggcctcccaccaggtgacctgttttttagcaaaaatctcagaagcattgcatagtgttaaaataccaaacatgcataaatctgtcacaaaatattcatactttgggtttggttctctgcacacattttcatacttagtaacacatcttctcaaggtgagtgtattgaccctgcccactgggaaggcagtgggcttcccaaagcttcccggacgctgctgggacgctgaggttcccatctgggaggttgggggcaagcacgagagccaaagggcacagagttgtctttttctttgagatggagtcttgctctgttacctaggctggagggcagtggcaccatcacagctcactccagttttgacctcctgggctcacatgatcctcccaccttagcctccacaggca

SEQ ID NO: 95954 - DNA, 156 bp, Homo sapiens
  misc_feature (8)..(8): n is a, c, g, or t
  misc_feature (10)..(10): n is a, c, g, or t
agcactgntnaaggcatgtactcagaccccatcatggccagcaagcctaaggttcaaagaagatactaacctctataattcccttgtgcacatggctgttcacctatcataggagcagaacactacctgagctaacttatgcccacctgaatcatg

SEQ ID NO: 95955 - DNA, 831 bp, Homo sapiens
caattcgactgtgggactcagagagaaaacggaggagcctcactcatggaggaggaacaaggtaggctggaggcagggacttgtaggcctcagacagaaggaagctggtgaagctcccataggcaaaatgcccaggagctccggctagaaggcagcaggagtgtgcagtccaggcaagaggaagagatcccccacagcacctccctctgcccagctcagacaaatgggacagtcaatccccaggctgatggaggcgggagcgagaaccacaaagttgtcagactggtttgcccaggacagggagagcagggaacacaaattgcagcaggagctcagcttcagggggcagaaaaaagcagcaaaattggtgggctgtagggaaacaaggacccaggtccatgcgatttcctgggtgcagaggggaaatccagcaggccaagagcaagggagccaagggacaaggggccagcagatgctgaaaaggaccaaggtttctggaaaaaaagagagtgacacttacaagaagggacacctacaaggagagaaacctgtcccctactcttacactggcccaagctcaggaccactcacacctgtctcctgagggacaggccagtgcaagaagaatggacaggacactgccaaccacgggatactgacagagattctgtccctcaccaaactttattcctctgagccctctactcatctggtcctgacctagggttcctaactccattctctctaagagcctagttttagcaaaactcctgttaaccagaatcccccaacctcaatatctaatcaccctggatatctgaacgtatttct

SEQ ID NO: 95956 - DNA, 509 bp, Homo sapiens
gtcgtgtcttccctgttaccaacagaattcagcaaaagggactgtgtgatttccaaacatgggtcagcaagagcaatgcagcctcaactttgtttgcctgaacacttgcacttagagccctgggttacccagtaagaaatccaactactctatagccaccattctacaaggatgccacatggagaggcgctcctataaggcgtcctaatccgaattcttccagccccagaaccagacaaaggagtgaacacgacttaagccctcagcaactgagtctctctcctggcctttgagttttttcacaaatgatcagacgtcatggagcagagacatgctgtccccattgtgacttgtccaaattcctggcctacagaatttgttaacaaaatataaaattgatttaagattagatttcacgatgatttgttttgtaaaaatagcagccacaacaccggggaaagctacttccccacatttaagaatatggaaaaaaagagataagtttctca

SEQ ID NO: 95957 - DNA, 212 bp, Homo sapiens
attaggcctcgttgccacctctgcacaggcgcttggagcccttgtagaagctggtgctgctgggacaacagagggatagaatcctctttggccagatgccaaatgctgtttgttggtctccttgtaaaaacacccagaaatcatgggggctttccatgtgtgagctgcacctcttactctctgcagcacccaggtgtctcccgggcaccatg

SEQ ID NO: 95958 - DNA, 271 bp, Homo sapiens
tgggccgttgttgatgcaaggacaggggaaggaataggagggaagctgatggggtctaatgctccctcattatgtaggagatcatctcccttcatgacatctacacattcaggtcaaaatatcagagtgacatgagctgagatgaaagtgctgtgagaaccatttctcccgtcaaagtccacaagcagccttgaagatggctggtccactcacagagcaagacctcgggggtcaggatgtctcaaggcgaccttccacctcctccaacgtg

SEQ ID NO: 95959 - DNA, 161 bp, Homo sapiens
gttttgcctcctaagctcaaggataacacagctattacttcttctcattataaaaccatcatctgcgttacggggcagttagagaacacagaagaggaaaaccagccaccccaatcctaccctcagaacatgtcgggttttggtccattttccactgtctc

SEQ ID NO: 95960 - DNA, 565 bp, Homo sapiens
agcggcaactcatttgggtcccctcccacgctgtgggagatttgtgcttttgctcttcacaataaatcttgctgcagctcgctctttgggtccgcactacctttatgagctgtaacactgcgaaggtctgcggtttcactcctgaagtcagcgagaccaagaacccaggggaaggaaccaattctggacacattggtacacacattggcaggtagaggggctaccttgtaggagctaaggctggaatactctgctatcattattattattattattattattttgagatggagtctcactatgtcacctaggatggagcgcagtggtgcagtctaggctcactgcaacctccgtgtgccaggttaaaacgattctcctacctcagtctcctgagtagctgggcttacaggtgcctgccaccacacctgggtaatttttctatttttagtagagggaaatgactttgtatctcccttcacaaagagagatgtgaagaggtgtctctcatcgaaagtcacacagtctgaaatgctactgtgtctcttaactccttttctttataggt

SEQ ID NO: 95961 - DNA, 764 bp, Homo sapiens
ctcttctccctcccgtctctgctgcacgctgagccggaaccccggagtgaggttctggccaacagtcctcctcctcctcctcttcctcctcctatcagcagaatctcccttgcgtgttaaccacccactcggtgaacggcagcaatacaagcataggtatgtgagccctaagcacgtgcaactccctggcttcagtgccttgggccacaccaggttccctggggctggcctcaagcctccaagctcccttctctgatggcaccgccccagtttttaagacagcatatgccctccttgaaggttcccagggtgccgcctccacgcccggcttcaaattggagccaaggacctgggtacagatctgtccccgccacaggggtgtgcatggctcagctggaggcgacactctggccaagagttgggaagagatggcctctttctcactcgctatagctaggacgggcccaggggctgcaggcgaggagagttctcagcagcagagccaggaaacagtccagtgggaagcagtggaaggagctgaacctgtggctagaagtcgacccctggcctgctctgtcatgagctgacaaatgctcctttgcgtgggcttgctgccgctacatttgaaaccagcatctgtgcagcacccagacttcatggccacgccctcaatccaggaatgggagccaacgtgcgcctgcagggttgttttctctgcctagaaaactcctatgcactcttcaaaatccaacttaagtagcacc

SEQ ID NO: 95962 - DNA, 373 bp, Homo sapiens
atttcttagattaagtcttcaaaatgtggtatatattttaaatttacagcattatctcaaattagcctctttttaagggctcagtagccacatatggctagtggtaccctattggacagctcaggtctatttgatggaacatatattggcaggttctaccttttactcaagggaattttagtttcatggttaattggcgttaattatcagtagtaatcataatgtaactcaccatagttattactttagctaatatatgggcagaagtccacatgcctagtttaaataattccttatttttggttgagaaaaagtataaatatttatatcaaaattacctttctacatgacacttaaagtagtataatatttt

SEQ ID NO: 95963 - DNA, 320 bp, Homo sapiens
ttggtcatcaccacaggtctctctcgtactaaatccagcagatacaccttggccctcatcttacttatttgcagcctctacgattgtttcccactctcattctgaagtcctccttccttggcctcttaccattctgccttctagtttccttcactggttattttaagaacataaatgtgctatatttaagctggttcattcattatattaccaagcttggtatcacaaatagacttcatatagaaatgctataatccttccttcccctccttccctgcctccctctgttccttccatccttccattcctttctttcataa

SEQ ID NO: 95964 - DNA, 1691 bp, Homo sapiens
  misc_feature (16)..(16): n is a, c, g, or t
  misc_feature (604)..(604): n is a, c, g, or t
aaagaggctttgcctnagtagctcttctcaaccccagctgccgtgagtctgattcaactgatggggcatcggtggttgttcagcctccccaggtgaactcgaagtggagcaaaaggtgacagtcacagcttagtagcccgccctgaagatgttggcaccagcctctactttgtaaatgactccttgcagcaggtgaccttttccagctccgtgggggtggtggtgccctgcccggccgcgggctcccccagcgcggcccttcgatggtacctggccacaggggacgacatctacgacgtgccgcacatccggcacgtccacgccaacgggacgctgcagctctaccccttctccccctccgccttcaatagctttatccacgacaatgactacttctgcaccgcggagaacgctgccggcaagatccggagccccaacatccgcgtcaaagcagttttcagggaaccctacaccgtccgggtggaggatcaaaggtcaatgcgtggcaacgtggccgtcttcaagtgcctcatcccctcttcagtgcaggaatatgttagcgttgtatcttgggagaaagacacagtctccatcatcccagaanacaggttttttattacctaccacggcgggctgtacatctctgacgtacagaaggaggacgccctctccacctatcgctgcatcaccaagcacaagtatagcggggagacccggcagagcaatggggcacgcctctctgtgacagaccctgctgagtcgatccccaccatcctggatggcttccactcccaggaagtgtgggccggccacaccgtggagctgccctgcaccgcctcgggctaccctatccccgccatccgctggctcaaggatggccggcccctcccggctgacagccgctggaccaagcgcatcacagggctgaccatcagcgacttgcggaccgaggacagcggcacctacatttgtgaggtcaccaacaccttcggttcggcagaggccacaggcatcctcatggtcattgatccccttcatgtgaccctgacaccaaagaagctgaagaccggcattggcagcacggtcatcctctcctgtgccctgacgggctccccagagttcaccatccgctggtatcgcaacacggagctggtgctgcctgacgaggccatctccatccgcgggctcagcaacgagacgctgctcatcacctcggcccagaagagccattccggggcctaccagtgcttcgctacccgcaaggcccagaccgcccaggactttgccatcattgcacttgaggatggcacgccccgcatcgtctcgtccttcagcgagaaggtggtcaaccccggggagcagttctcactgatgtgtgcggccaagggcgccccgccccccacggtcacctgggccctcgacgatgagcccatcgtgcgggatggcagccaccgcaccaaccagtacaccatgtcggacggcaccaccatcagccacatgaacgtcacaggcccccagatccgcgacgggggcgtgtaccggtgcacagcgcggaacttggtgggcagtgctgaatatcaggcgcgaataaacgtaagaggtgcctgtctacatttaaatatcagaataggtttttgagttcctttgccatctctgtggttaccattattcttgtgctgattagtacttat

SEQ ID NO: 95965 - DNA, 5590 bp, Homo sapiens
  misc_feature (5036)..(5036): n is a, c, g, or t
cagcatttatcaagaaattacaaagcgctgtgtgaagcctctgaaatgtattaattcattttatcctcagactatccatgagatggcacgccccgcatcgtctcgtccttcagcgagaaggtggtcaaccccggggagcagttctcactgatgtgtgcggccaagggcgccccgccccccacggtcacctgggccctcgacgatgagcccatcgtgcgggatggcagccaccgcaccaaccagtacaccatgtcggacggcaccaccatcagccacatgaacgtcacaggcccccagatccgcgacgggggcgtgtaccggtgcacagcgcggaacttggtgggcagtgctgaatatcaggcgcgaataaacgtaagaggcccacccagcatccgggctatgcggaacatcacagcagtcgccgggcgggacacccttatcaactgcagggtcatcggctatccctactactccatcaagtggtacaaggatgccctgctgctgccagacaaccaccgccaggtggtgtttgagaatgggaccctcaagctgactgacgtgcagaagggcatggatgagggggagtacctgtgcagtgtcctcatccagccccagctctccatcagccagagcgttcacgtagccgtcaaagtgccccctctgatccagcccttcgaattcccacccgcctccatcggccagctgctctacattccctgtgtggtgtcctcgggggacatgcccatccgtatcacctggaggaaggacggacaggtgatcatctcaggctcgggcgtgaccatcgagagcaaggaattcatgagctccctgcagatctctagcgtctccctcaagcacaacggcaactatacatgcatcgccagcaacgcagccgccaccgtgagccgggagcgccagctcatcgtgcgtgtgccccctcgatttgtggtgcaacccaacaaccaggatggcatctacggcaaagctggtgtgctcaactgctcggtggacggctaccccccacccaaggtcatgtggaagcatgccaaggggagcgggaacccccagcagtaccaccctgtgcccctcactggccgcatccagatcctgcccaacagctcgctgctgatccgccacgtcctagaagaggacatcggctactacctctgccaggccagcaacggcgtaggcaccgacatcagcaagtccatgttcctcacagtcaagatcccggccatgatcacttcccaccccaacaccaccatcgccatcaagggccatgcgaaggagctaaactgcacggcacggggtgagcggcccatcatcatccgctgggagaagggggacacagtcatcgaccctgaccgcgtcatgcggtatgccatcgccaccaaggacaacggcgacgaggtcgtctccacactgaagctcaagcccgctgaccgtggggactctgtgttcttcagctgccatgccatcaactcgtatggggaggaccggggcttgatccaactcactgtgcaagagccccccgaccccccagagctggagatccgggaggtgaaggcccggagcatgaacctgcgctggacccagcgattcgacgggaacagcatcatcacgggcttcgacattgaatacaagaacaaatcagattcctgggacttcaagcagtccacacgcaacatctcccccaccatcaaccaggccaacattgtggacttgcacccggcatctgtgtacagcatccgcatgtactctttcaacaagattggccgcagtgaaccaagcaaggagctcaccatcagcactgaggaggccgctcccgatgggccccccatggatgttaccttgcagccagtgacctcacagagcatccaggtgacctggaaggcacccaagaaggagctgcagaacggtgtcatccggggctaccagattggctacagagagaacagccccggcagcaacgggcagtacagcatcgtggagatgaaggccacgggggacagcgaggtctacaccctggacaacctcaagaagttcgcccagtatggggtggtggtccaagccttcaatcgggctggcacggggccctcttccagcgagatcaatgccaccactctggaggatgtgcccagccagccccctgagaacgtccgggccctgtccatcacttctgacgtggccgtcatctcctggtcagagcccccgcgcagcaccctcaatggcgtcctcaaaggctatcgggtcatcttctggtccctctatgttgatggggagtggggcgagatgcagaacatcaccaccacgcgggagcgggtggagctgcggggcatggagaagttcaccaactacagcgtccaggtgctggcctacacccaggctggggacggcgtacgcagcagtgtgctctacatccagaccaaggaggacgttccaggtccccctgctggcatcaaagctgtcccttcatcagctagcagtgtggttgtgtcttggctcccccctaccaagcccaacggggtgatccgcaagtacaccatcttctgttccagccccgggtctggccagccggctcccagcgagtacgagacgagtccagagcagctcttctaccggatcgcccacctaaaccgcggtcagcagtatctgctgtgggtggccgccgtcacctctgccggccggggcaacagcagcgagaaggtgaccatcgagcctgctggcaaggccccagcaaagatcatctcctttgggggcaccgtgacaacaccttggatgaaagatgttcggctgccttgcaattcagtgggagatccagcccctgctgtgaagtggaccaaggacagtgaagactcggccattccagtgtccatggatgggcaccggctcatccacaccaatggcacactgctgctgcgtgcagtgaaggctgaggactctggctactacacgtgcacggccaccaacactggtggctttgacaccatcatcgtcaaccttctggtgcaagttcccccggaccagccccgcctcactgtctccaaaacctcagcttcgtccatcaccctgacctggattccaggtgacaatgggggcagctccatccgaggcttcgtgctacagtactcggtggacaacagcgaggagtggaaggatgtgttcatcagctccagcgagcgctccttcaagctggacagcctcaagtgtggcacgtggtacaaggtgaagctggcagccaagaacagcgtgggctctgggcgcatcagcgagatcatcgaggccaagacccacgggcgggagccctccttcagcaaagaccaacacctcttcacccacatcaactccacgcatgctcggcttaacctgcagggctggaacaatgggggctgccctatcacagccatcgttctggagtaccggcccaaggggacctgggcctggcagggcctccgggccaacagctccggggaggtgtttctgacggaactgcgagaggccacgtggtacgagctgcgcatgagggcttgcaacagtgcgggctgcggcaatgaaacagcccagttcgccaccctggactacgatggcagcaccattccacccatcaagtctgctcaaggtgaaggggatgatgtgaagaagctgttcaccatcggctgccctgtcatcctggccacactgggggtggcactgctcttcatcgtacgcaagaagaggaaggagaaacggctgaagcgactccgagatgcaaagagtttggcagaaatgttgataagcaagaacaatagaagctttgacacccctgtgaaagggccaccccagggcccacggctacacattgacatccccagggtccagctgctcatcgaggacaaagaaggcatcaagcaactgggagatgacaaggccaccatccctgtgacagatgctgagttcagccaagctgtcaacccacagagcttctgtactggcgtctccttgcaccacccaaccctcatccagagcacaggacccctcatcgacatgtctgacatccggccaggaaccaatccagtgtccaggaagaatgtgaagtcagcccacagcacccggaaccggtactcaagccagtggaccctgaccaagtgccaggcctccacacctgcccgcaccctcacctccgactggcgcaccgtgggctcccagcatggtgtcacggtcactgagagtgacagctacagtgccagcctgtcccaggacacagacaaaggaaggaacagcatggtgtccactgagagtgcctcttccacctacgaggagctggcccgggcctatgagcatgccaagctggaggagcagctgcagcacgccaagtttgagatcaccgagtgcttcatctctgacagttcctctgaccagatgaccacaggcaccaacgagaacgccgacagcatgacatccatgagcacaccctcagagcctggcatctgccgctttaccgcctcaccacccaagccccaggatgcggaccggggcaaaaacgtggctgtgcccatccctcaccgggccaacaagagtgactactgcaacctgcccctgtatgccaagtcagaggccttctttcgaaaggcagatggacgtgagccctgccccgtggtcccaccccgtgaggcctccatccggaacctggctcgaacctaccacacccaggctcgccacctgaccctggaccctgccagcaagtccttgggccttccccacccaggggcccccgctgccgcctccacagccaccttacctcagaggactctggccatgccagcccccccagccggcacagcccccccagcccccggccccacccctgctgagccacccaccgcccccagcgctgcccctccggcccccagcaccgagcctccacgagccgggggcccacacaccaaaatggggggctccagggactcgcttctcgagatgagcacatcgggggtagggaggtctcagaagcagggggccggggcctactccaaatcctacaccctggtgtagggccngcaggaagagcagccacgcctgggccgcgccgcgccgcagccccacacgccagctcggctgtttttctgcattatttatattcaactgacagacaaaaaccaaccaacgacaaaacaaaaacccccaatcatgaacgcctgtacatagaactcttttgtacaaatgaaactattttcttcttctccatgaagccagggcacaaagaatttgacagtacaagtcaaatcccccaccccacaaaatatgtgtggagatatatatacatatatagacagacaggaacgcgtccacgagctatatatctatatatttctctcaccctattttgagacagaggcacaaagactcagcaatttttttccctcctcctcaccttccccccagtctaggtggttttgacaaagaccaaaatcccaactcagagacactgcatgcgattttactgttccaagaaaaccaggagttgcttcaatttgcagatgcttatgtgttaatacctttttctatgaaaaaagacccagcgccgtgtgcaataaaggttatgtttctatgt

SEQ ID NO: 95966 - DNA, 181 bp, Homo sapiens
tggttgtgtcttggctcccccctaccaagcccaacggggtgatccgcaagtacaccatcttctgttccagccccgggtctggccagccggtaagtgagttcagggccagatgatgaaggggatggaagaaaagaaaagggaccttgtacatcagccggcttccaggccaaaccctgaggct

SEQ ID NO: 95967 - DNA, 610 bp, Homo sapiens
ccttatcaactgcagggtcatcggctatccctactactccatcaagtggtacaaggatgccctgctgctgccagacaaccaccgccaggtggtgtttgagaatgggaccctcaagctgactgacgtgcagaagggcatggatgagggggagtacctgtgcagtgtcctcatccagccccagctctccatcagccagagcgttcacgtagccgtcaaaggtaggcctccctcaccagccagggcccctgcccgcctgaccacccaggatgcgtgggcctttccccagctgggactcagacaacaataggcaatcctgggtgaacggaaggctgagcaagagaggccccagcttggcattcagaaaaaagggagcagggcagaagactgtgggtggacgcaggccatgagctcctctacatccggggtcctcctcgggctgcagaataagacagcacacaccccaggtgcatgagagggtgagttacagataaaggaggcaggctgccttctgggagagaggccaggtcagagatgggctgcatggggcctctgctgttgggatggagcccccaggagctcagcgggcccacacaaggaggccacaagcaac

SEQ ID NO: 95968 - DNA, 7231 bp, Homo sapiens
  misc_feature (1024)..(1024): n is a, c, g, or t
  misc_feature (6677)..(6677): n is a, c, g, or t
cgggtaagctgagtccgaaagaggcaggaagctcgtgtcccaggtgacttaggccagtagaaaccgggcgtccttggctgaagcatggcaggctgttggcacatggatgacacatgcctgtctgcgaccacaggctccaagccggtgggtgacagggacccctcgcctctcagacagcggagccgggtcggggcggtctggcccgggccgccgctcctgttcctgggcttgtggggctggggtccgtctgggctccgggctcgcgcggcgctcaccacccggggtgccgcgggggggcggggagagcggccgcctagcccagccccgcggatgacaggagccggggagccgaggagggaggagccgccgccgcagccgagcgctgggctgaggagcagagagagcggggcgccgagtgcgggcggctgggagcgcgctgagcgggggagaggcgctgccgcacggccggccacaggaccacctccccggagaatagggcctctttatggcatgtggctggtaactttcctcctgctcctggactctttacacaaagcccgccctgaagatgttggcaccagcctctactttgtaaatgactccttgcagcaggtgaccttttccagctccgtgggggtggtggtgccctgcccggccgcgggctcccccagcgcggcccttcgatggtacctggccacaggggacgacatctacgacgtgccgcacatccggcacgtccacgccaacgggacgctgcagctctaccccttctccccctccgccttcaatagctttatccacgacaatgactacttctgcaccgcggagaacgctgccggcaagatccggagccccaacatccgcgtcaaagcagttttcagggaaccctacaccgtccgggtggaggatcaaaggtcaatgcgtggcaacgtggccgtcttcaagtgcctcatcccctcttcagtgcaggaatatgttagcgttgtatcttgggagaaagacacagtctccatcatcccagaanacaggttttttattacctaccacggcgggctgtacatctctgacgtacagaaggaggacgccctctccacctatcgctgcatcaccaagcacaagtatagcggggagacccggcagagcaatggggcacgcctctctgtgacagaccctgctgagtcgatccccaccatcctggatggcttccactcccaggaagtgtgggccggccacaccgtggagctgccctgcaccgcctcgggctaccctatccccgccatccgctggctcaaggatggccggcccctcccggctgacagccgctggaccaagcgcatcacagggctgaccatcagcgacttgcggaccgaggacagcggcacctacatttgtgaggtcaccaacaccttcggttcggcagaggccacaggcatcctcatggtcattgatccccttcatgtgaccctgacaccaaagaagctgaagaccggcattggcagcacggtcatcctctcctgtgccctgacgggctccccagagttcaccatccgctggtatcgcaacacggagctggtgctgcctgacgaggccatctccatccgcgggctcagcaacgagacgctgctcatcacctcggcccagaagagccattccggggcctaccagtgcttcgctacccgcaaggcccagaccgcccaggactttgccatcattgcacttgaggatggcacgccccgcatcgtctcgtccttcagcgagaaggtggtcaaccccggggagcagttctcactgatgtgtgcggccaagggcgccccgccccccacggtcacctgggccctcgacgatgagcccatcgtgcgggatggcagccaccgcaccaaccagtacaccatgtcggacggcaccaccatcagccacatgaacgtcacaggcccccagatccgcgacgggggcgtgtaccggtgcacagcgcggaacttggtgggcagtgctgaatatcaggcgcgaataaacgtaagaggcccacccagcatccgggctatgcggaacatcacagcagtcgccgggcgggacacccttatcaactgcagggtcatcggctatccctactactccatcaagtggtacaaggatgccctgctgctgccagacaaccaccgccaggtggtgtttgagaatgggaccctcaagctgactgacgtgcagaagggcatggatgagggggagtacctgtgcagtgtcctcatccagccccagctctccatcagccagagcgttcacgtagccgtcaaagtgccccctctgatccagcccttcgaattcccacccgcctccatcggccagctgctctacattccctgtgtggtgtcctcgggggacatgcccatccgtatcacctggaggaaggacggacaggtgatcatctcaggctcgggcgtgaccatcgagagcaaggaattcatgagctccctgcagatctctagcgtctccctcaagcacaacggcaactatacatgcatcgccagcaacgcagccgccaccgtgagccgggagcgccagctcatcgtgcgtgtgccccctcgatttgtggtgcaacccaacaaccaggatggcatctacggcaaagctggtgtgctcaactgctcggtggacggctaccccccacccaaggtcatgtggaagcatgccaaggggagcgggaacccccagcagtaccaccctgtgcccctcactggccgcatccagatcctgcccaacagctcgctgctgatccgccacgtcctagaagaggacatcggctactacctctgccaggccagcaacggcgtaggcaccgacatcagcaagtccatgttcctcacagtcaagatcccggccatgatcacttcccaccccaacaccaccatcgccatcaagggccatgcgaaggagctaaactgcacggcacggggtgagcggcccatcatcatccgctgggagaagggggacacagtcatcgaccctgaccgcgtcatgcggtatgccatcgccaccaaggacaacggcgacgaggtcgtctccacactgaagctcaagcccgctgaccgtggggactctgtgttcttcagctgccatgccatcaactcgtatggggaggaccggggcttgatccaactcactgtgcaagagccccccgaccccccagagctggagatccgggaggtgaaggcccggagcatgaacctgcgctggacccagcgattcgacgggaacagcatcatcacgggcttcgacattgaatacaagaacaaatcagattcctgggacttcaagcagtccacacgcaacatctcccccaccatcaaccaggccaacattgtggacttgcacccggcatctgtgtacagcatccgcatgtactctttcaacaagattggccgcagtgaaccaagcaaggagctcaccatcagcactgaggaggccgctcccgatgggccccccatggatgttaccttgcagccagtgacctcacagagcatccaggtgacctggaaggcacccaagaaggagctgcagaacggtgtcatccggggctaccagattggctacagagagaacagccccggcagcaacgggcagtacagcatcgtggagatgaaggccacgggggacagcgaggtctacaccctggacaacctcaagaagttcgcccagtatggggtggtggtccaagccttcaatcgggctggcacggggccctcttccagcgagatcaatgccaccactctggaggatgtgcccagccagccccctgagaacgtccgggccctgtccatcacttctgacgtggccgtcatctcctggtcagagcccccgcgcagcaccctcaatggcgtcctcaaaggctatcgggtcatcttctggtccctctatgttgatggggagtggggcgagatgcagaacatcaccaccacgcgggagcgggtggagctgcggggcatggagaagttcaccaactacagcgtccaggtgctggcctacacccaggctggggacggcgtacgcagcagtgtgctctacatccagaccaaggaggacgttccaggtccccctgctggcatcaaagctgtcccttcatcagctagcagtgtggttgtgtcttggctcccccctaccaagcccaacggggtgatccgcaagtacaccatcttctgttccagccccgggtctggccagccggctcccagcgagtacgagacgagtccagagcagctcttctaccggatcgcccacctaaaccgcggtcagcagtatctgctgtgggtggccgccgtcacctctgccggccggggcaacagcagcgagaaggtgaccatcgagcctgctggcaaggccccagcaaagatcatctcctttgggggcaccgtgacaacaccttggatgaaagatgttcggctgccttgcaattcagtgggagatccagcccctgctgtgaagtggaccaaggacagtgaagactcggccattccagtgtccatggatgggcaccggctcatccacaccaatggcacactgctgctgcgtgcagtgaaggctgaggactctggctactacacgtgcacggccaccaacactggtggctttgacaccatcatcgtcaaccttctggtgcaagttcccccggaccagccccgcctcactgtctccaaaacctcagcttcgtccatcaccctgacctggattccaggtgacaatgggggcagctccatccgaggcttcgtgctacagtactcggtggacaacagcgaggagtggaaggatgtgttcatcagctccagcgagcgctccttcaagctggacagcctcaagtgtggcacgtggtacaaggtgaagctggcagccaagaacagcgtgggctctgggcgcatcagcgagatcatcgaggccaagacccacgggcgggagccctccttcagcaaagaccaacacctcttcacccacatcaactccacgcatgctcggcttaacctgcagggctggaacaatgggggctgccctatcacagccatcgttctggagtaccggcccaaggggacctgggcctggcagggcctccgggccaacagctccggggaggtgtttctgacggaactgcgagaggccacgtggtacgagctgcgcatgagggcttgcaacagtgcgggctgcggcaatgaaacagcccagttcgccaccctggactacgatggcagcaccattccacccatcaagtctgctcaaggtgaaggggatgatgtgaagaagctgttcaccatcggctgccctgtcatcctggccacactgggggtggcactgctcttcatcgtacgcaagaagaggaaggagaaacggctgaagcgactccgagatgcaaagagtttggcagaaatgttgataagcaagaacaatagaagctttgacacccctgtgaaagggccaccccagggcccacggctacacattgacatccccagggtccagctgctcatcgaggacaaagaaggcatcaagcaactgggagatgacaaggccaccatccctgtgacagatgctgagttcagccaagctgtcaacccacagagcttctgtactggcgtctccttgcaccacccaaccctcatccagagcacaggacccctcatcgacatgtctgacatccggccaggaaccaatccagtgtccaggaagaatgtgaagtcagcccacagcacccggaaccggtactcaagccagtggaccctgaccaagtgccaggcctccacacctgcccgcaccctcacctccgactggcgcaccgtgggctcccagcatggtgtcacggtcactgagagtgacagctacagtgccagcctgtcccaggacacagacaaaggaaggaacagcatggtgtccactgagagtgcctcttccacctacgaggagctggcccgggcctatgagcatgccaagctggaggagcagctgcagcacgccaagtttgagatcaccgagtgcttcatctctgacagttcctctgaccagatgaccacaggcaccaacgagaacgccgacagcatgacatccatgagcacaccctcagagcctggcatctgccgctttaccgcctcaccacccaagccccaggatgcggaccggggcaaaaacgtggctgtgcccatccctcaccgggccaacaagagtgactactgcaacctgcccctgtatgccaagtcagaggccttctttcgaaaggcagatggacgtgagccctgccccgtggtcccaccccgtgaggcctccatccggaacctggctcgaacctaccacacccaggctcgccacctgaccctggaccctgccagcaagtccttgggccttccccacccaggggcccccgctgccgcctccacagccaccttacctcagaggactctggccatgccagcccccccagccggcacagcccccccagcccccggccccacccctgctgagccacccaccgcccccagcgctgcccctccggcccccagcaccgagcctccacgagccgggggcccacacaccaaaatggggggctccagggactcgcttctcgagatgagcacatcgggggtagggaggtctcagaagcagggggccggggcctactccaaatcctacaccctggtgtagggccngcaggaagagcagccacgcctgggccgcgccgcgccgcagccccacacgccagctcggctgtttttctgcattatttatattcaactgacagacaaaaaccaaccaacgacaaaacaaaaacccccaatcatgaacgcctgtacatagaactcttttgtacaaatgaaactattttcttcttctccatgaagccagggcacaaagaatttgacagtacaagtcaaatcccccaccccacaaaatatgtgtggagatatatatacatatatagacagacaggaacgcgtccacgagctatatatctatatatttctctcaccctattttgagacagaggcacaaagactcagcaatttttttccctcctcctcaccttccccccagtctaggtggttttgacaaagaccaaaatcccaactcagagacactgcatgcgattttactgttccaagaaaaccaggagttgcttcaatttgcagatgcttatgtgttaatacctttttctatgaaaaaagacccagcgccgtgtgcaataaaggttatgtttctatgt

SEQ ID NO: 95969 - DNA, 175 bp, Homo sapiens
ccccttctaaaccacagctcaaggatgccacctccaagaagctctcccagattgatctgcctccctctcccaactctgtcattttccccaaaggctgtgctcctgctttctctcaactgaccaggccttctccctgctcagttccaggtccccctgctggcatcaaagctgtccc

SEQ ID NO: 95970 - DNA, 682 bp, Homo sapiens
ctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggc

SEQ ID NO: 95971 - DNA, 750 bp, Homo sapiens
cattgtgatacactgtgatgagtatactatcagaaataacaataagcactatgagaatatggatataacagtttgagttagtcacaagaagatgaaggtttgctgtatttctgacatgtttttttaaatgtgttggatgttttctgcttccttttttggatcatttatatattatttctcaacttttttacttaatattttacgttctgaaatattttatatattgagatatgatattgaagcttttgaatctcttcatgttttcattatattgtatgtacttcagtaattcatagaaatattggaatatatttacttaaaacctaattttttagaaagatattatttaattgactattcttacttgccaggtactttctagaatacttaattttattgtacttttcattatttaccgtttataatttggaggtaagaccattagacccaaagaacttttgtcttggtgtgttcttgtttaaatatggaatttattttacaaaatagttttgttttgtatacatgtctagtctcaagggcgaagtgaaatcttaatgagtctacagaaagttctaagtggactgggtggtgcagcagcttcctcccatcgtgatatttacaagaatgccaggtctctcttgactgataggtcaatggctgttcgatgtgcagtggccaagtgtctactagaactacagaatgaagctgtatttatgtggactgctgaactagaaaatatagccactctct

SEQ ID NO: 95972 - DNA, 436 bp, Homo sapiens
tatggtgtctgagcacccaacgtacacatggaggagggagtgaacaactgtgtcaaatgctgtggagaaggaatggcaatgtgctgcacacactagtgaccttgatgagaatgtttcagtggggtcgaggaggcagataccagactgcaccggattagagcatgcataggtggtgataacacaaagagcaagtgcagatccagtcttgctgagtccacttgctcctactgccagggaaacctgctttatcctcctcacccttgcagccactccaaaaggttgcagcagacatgctcacctctttccatttctccattaattactgtggcatttacttgctaagcaatgtattcattactgttaattactgtgtgttaattactatataattataatttttttcacctcatgtagattgagatccttgaaacagggt

SEQ ID NO: 95973 - DNA, 1001 bp, Homo sapiens
tctgcctccgtagctgggactacaggcacgcgccaccatgctcagcaaattaaaaaaaatttttttttggtagagacagggttttgccacgttgcccaggctggtcttgaactactgggttcaagcaatcctcccaccttgaaccatgtgtcaaatctttgccccagccaaatatttgaagtaaataaagaaattgggtaatttctccaatctaaccctcctaaatgctgatggagctggctagtagaaacagttttattttctgataaaactcgagccctttccttctcagccttctcagagtttattttttttcttttgggagttcttagtttcctttgagaatctagcaagagttaaaagacctcctgagaaaagcacacatgcataatttggtatgtaatttcggagggttctttgatctgtggagtgaagctcatttatgcagatctaatgctgtctcttaaatcagcaagtttgatgcccattttgtgtactattgggatgctgttttggtgtttcaggaacttgtagtctgtagaaaaataaaagttccataatacagctgctttagggttgttattacagaaaaagtcaagagaagctggcttctaccagtctggttcatggagggctttgaggaggagttcatggcacttgtgcttgacctttaaaagatctgtcaaatttgacacacagaaaaaggaaaatatttaaggctgagggaaaagaacaagcaagacaaagtttatgctgaaagaagttgtgtagttggagtatatgataaactgaactagtgggaaaactatctggaaaggttgacgtttgtggaagaccttaaaaatgctggggtaggccaggtgcagtgactcacacctgtaatcccagcactttgggaggccaaggcaggagaatctcttgaacccagaaggcagaggttgcagtgagctgagatcacgccactgcattccagcctgggtgactgagtgagactctgtctc

SEQ ID NO: 95974 - DNA, 691 bp, Homo sapiens
aggtggcttctaacacaaggatcagggcgaggaccagggtagctgccggtggtcccttggccatttggggctgagggagaggtggcctggtagcctctcaggcccagctgcacctgctgcctgaacacgtgcctctcagctgcccaggaagggggcagggctccccagcagctgcagctccaccacgcagccgccctgggcaaagcatcaagtctagctcctcccagcagtctcaccccagcccacgccatgggcgactatgcatcctggtggtgtctgcttcccaccctcagttccgtagtgctgaggggcccgcgttctctgtgcacagtcctgggaggcccatggcttctgcccggcaagtcggtcagatgctggtttgattactatgtctaagggcacgggtgagcattcagggtgctttggtggcttcacccacttagcaccttgttaagacagggagccccttatggacactgttgaggtagaggattcctgtcttggggataagccctttgtttcatcaaaatctactccctgggtctgacttagtttgggggcatttaatgctttggtaaagttaatatcctcttactccctggcaaaactgttcattactcttacctcaaatgtacacttgatttgctgaggctttttaaaaacaggccggccacggtggcttacgcctgta

SEQ ID NO: 95975 - DNA, 544 bp, Homo sapiens
ggctatcttggcttcagaggggagaaatgaaacccatctgggtacctccctaatctcccacgtgcccccagtctcctgctccccaacctgccaccttgattacaaaggagcaagtgccctgggcagtgttcactgtggcagccaccctgctaatacattactctggggtcttgggtcagcaagttaggttactgagggagcttctgttggggtggagtggctggttagggtggactttggaggcgtggacatgggtttgaatgtgtctaactggacagaggaagccatgagccctgtgtggaatcctggctctgagcagttagaataatggttatcattgactgggtgcctatggcctgccaagccctatgctgggaacttttatcatccctcttaatcctcccactgagctggaaggtgctgtgatgtccattttgcagatgaggatcatcaagggcctaagttgtaacatactagcctggagtcctgctatttgtaagtggcaggagcttgtagtgaagcccctctctgactcaagatcatg

SEQ ID NO: 95976 - DNA, 553 bp, Homo sapiens
tcttcatcttgactatcatcaccctagtatagaccatcgtctcttctctggatagatcactcccttgttgcaggctcctaccatccccaaacaaactcatctttacccacgaacatgtttatcttcctgtacccccatttttagtggcatccaatctgccaaacgataatgtaaatgcagggctatgaaatagggctgccaggaaaatgagaaaagtagttacagaactgaaaaccaaattaagattcttggcacgattgtgatcataactgccctacatagtttagttagagctgcatctctataaactgaagcgtagtcatatttactctgaaatgattgaaatagaacaaagggaattcagcttccttaaaggaaggatagagaccgcaagctctgagataaggcttttttctgacacttattatccaaaataatctcaaattctaaactgacacatattcaccactaaggaaaagtggagtcttttaggtgtggtcccttctaatacaaggaccacagcctccctggaggtttgggtgagaaggcagaa

SEQ ID NO: 95977 - DNA, 116 bp, Homo sapiens
tccttctcttaaatgtctctaccccttcaatccttcccacattccctcgattctcttgtggctgacaggaagggtagggacagatttcctggaactgaggctcccaagccctgctg

SEQ ID NO: 95978 - DNA, 794 bp, Homo sapiens
cctgggccctcttcctggtaggccacagcaccacacacactgcaaaccaggcctcttcttcatccaccaccaccgtccaggcctcaacatcaccgcgtggggtcttgtgccctctgggggaacttccgggctaatgaggggggacagtccccattaccggtctatctttataaggcagtatatgcaacagtggaagttctgtgagacatgttccaaccccggggctgctggcagaactgtccccaaacccaccctcgatcccacggccaggaagtgggtccaaaattgcctggccaggtcacacccctgcgtgaaccgccccacaacacccagggcgctgcctgacttgccgtccacctctcagcccctcccctcacccctgccgcagctgcagggcctaccctcgccgggggctgctccctgcttacctccctcgcccgtgcaatgccatctacttcccgcaaggcctaccgggagatgttacaggtcacggtcatatttgagcatgagaagctcacgcagagaacattctggctgagggagaggtcttggggttcaaggctgttatcttggctctgctcagccatgccaggcaggaaaatgggcacctctagtgacccaggctggctgagagcctgcagggaagagcctttggaacgtgagccactgtgggctggcaggactgcaactggcgtctccatctactggtaccgaggcgaggaggaaaaagcaggggggcccggagacggcccctctaagtctgtaactccagagctgctgctcagtccccagaa

SEQ ID NO: 95979 - DNA, 300 bp, Homo sapiens
  misc_feature (261)..(261): n is a, c, g, or t
  misc_feature (293)..(293): n is a, c, g, or t
catgtgtactaatggctttcttagatcacagaggtctgcggcattccagtgcaaaagttcggagcaggacggcttacctgttttctagatttgtcaaatctctcaataagcaaatgaatcctttcattgaggatattttgaatagaatacaagatttattagagctttctccacctgagaatggccaccagtccttactgagcagcgatgatcaactttttatttatgagacagctggagtgctgattcctcattaaggcntgtttcctttctgccgatattcactataaggnccggcgc

SEQ ID NO: 95980 - DNA, 2313 bp, Homo sapiens
  misc_feature (1991)..(1991): n is a, c, g, or t
catgtgtactaatggctttcttagatcacagaggtctgcggcattccagtgcaaaagttcggagcaggacggcttacctgttttctagatttgtcaaatctctcaataagcaaatgaatcctttcattgaggatattttgaatagaatacaagatttattagagctttctccacctgagaatggccaccagtccttactgagcagcgatgatcaactttttatttatgagacagctggagtgctgattgttaatagtgaatatccggcagaaaggaaacaagccttaatgaggaatctgttgactccactaatggagaagtttaaaattctgttagaatagttgatgctggcacaagatgaagataggcaagcctctctagcagactgtctcaaccatgctgttggatttgcaagtccaaccagtaaagctttcagcaacaagcagactataaaacaatgtggctgttctgaagtttgtctggactgtttacagacattcctgccagccctcagttgtcccttacaaaaggatattctcagaagtggagtccgtactttccttcatcgaatggttatttgcctgggggaagaagtttttccgttcatcccagctgcttcagaacgtatgctcaaagattgtgaagcagaagacctccaggagttcattcttcttatcaaccagattacggccaaattcaagatacaggtatccccgtttttacaacagatgttcatgcccctgcttcatgcaatttttgaagtgctgctccggccagcagaagaaaatgaccagtctgctgctttagagaagcagatgttgcggaggagttactttgctttcctgcaaacagtcacaggcagtgggatgagcgaagttatagcaaatcaaggtgcagagaatgtagaaagagtgttggttactgttatccaaggagcagttgaatatccagatccaattgcacagaaaacatgttttatcatcctctcaaagttggtagaactctggggaggtaaagatggaccagtgggatttgctgattttgtttataagcacattgtccccgcatgtttcctagcacctttaaaacaaacctttgacctggcagatgcacaaacagtattggctttatctgagtgtgcagtgacactgaaaacaattcatctcaaacggggcccagaatgtgttcagtatcttcaacaagaatacctgccctccttgcaagtagctccagaaataattcaggagttttgtcaagcgcttcagcagcctgatgctaaagtttttaaaaattacttaaaggtgttcttccagagagcaaagccctgaggactggatttccctgtgcctacttcatgatcatgaattccagttaatttataaagaggcgatttttgtgtgccattcacactggtctttttcacattgttttgagcttattgcagtatatgttttgggatttttctgtaaaatgggtgtaattttcctaatacaggtatgtaacaacaaaagaagttgcctgcatgccggtccaaattgttctgtataaagatgctcttaaaagacacaagagttatcctagaaccttaattcttttttatttgaaattttaagtcaagtcctttataaagaccatagcagtggaaaacagtgtactttttaaaaaattgctgaatataaaatctttgaaaattttctttatgtgtgaagacacaaagtatgggggaagacagcaatcaaaactaactttttgtagatagccatttcatttctttaaactgtttcaacgccaatatgtattctacaaaagagaatggttttaggctccagtgttatacttttttttatatatatatataaaaataaactttacgtagtgaaatcttccaagtcttttctggaattattataaatactttagttttattttctcatcttaatctctccataatttcccatttaaggtttacaaatatgagtgtgtggatgctntaattcatttaacctcactcctcaaaggtacatgcaacttagttctgttatatggagagtctttttctttaatgtacttgggaaaaagcctatgtgaatctcgttgatagcaattttcacattccaaggcggggcgtgagagggtcaccgaaatgttatcccgaaactttgggaggcccagcaggtggatccctttgagtcacggagtttcagaatatcctgggcacattgttgaaaccccctcttttataataaaacaccggggttgttatttcacccccctaggccggtacacagggtattcaaaacatcactcgcaccg

SEQ ID NO: 95981 - DNA, 1884 bp, Homo sapiens
catgtgtactaatggctttcttagatcacagaggtctgcggcattccagtgcaaaagttcggagcaggacggcttacctgttttctagatttgtcaaatctctcaataagcaaatgaatcctttcattgaggatattttgaatagaatacaagatttattagagctttctccacctgagaatggccaccagtccttactgagcagcgatgatcaactttttatttatgagacagctggagtgctgattgttaatagtgaatatccggcagaaaggaaacaagccttaatgaggaatctgttgactccactaatggagaagtttaaaattctgttagaatagttgatgctggcacaagatgaagataggcaagcctctctagcagactgtctcaaccatgctgttggatttgcaagtccaaccagtaaagctttcagcaacaagcagactataaaacaatgtggctgttctgaagtttgtctggactgtttacagacattcctgccagccctcagttgtcccttacaaaaggatattctcagaagtggagtccgtactttccttcatcgaatggttatttgcctgggggaagaagtttttccgttcatcccagctgcttcagaacgtatgctcaaagattgtgaagcagaagacctccaggagttcattcttcttatcaaccagattacggccaaattcaagatacaggtatccccgtttttacaacagatgttcatgcccctgcttcatgcaatttttgaagtgctgctccggccagcagaagaaaatgaccagtctgctgctttagagaagcagatgttgcggaggagttactttgctttcctgcaaacagtcacaggcagtgggatgagcgaagttatagcaaatcaaggtgcagagaatgtagaaagagtgttggttactgttatccaaggagcagttgaatatccagatccaattgcacagaaaacatgttttatcatcctctcaaagttggtagaactctggggaggtaaagatggaccagtgggatttgctgattttgtttataagcacattgtccccgcatgtttcctagcacctttaaaacaaacctttgacctggcagatgcacaaacagtattggctttatctgagtgtgcagtgacactgaaaacaattcatctcaaacggggcccagaatgtgttcagtatcttcaacaagaatacctgccctccttgcaagtagctccagaaataattcaggagttttgtcaagcgcttcagcagcctgatgctaaagtttttaaaaattacttaaaggtgttcttccagagagcaaagccctgaggactggatttccctgtgcctacttcatgatcatgaattccagttaatttataaagaggcgatttttgtgtgccattcacactggtctttttcacattgttttgagcttattgcagtatatgttttgggatttttctgtaaaatgggtgtaattttcctaatacaggtatgtaacaacaaaagaagttgcctgcatgccggtccaaattgttctgtataaagatgctcttaaaagacacaagagttatcctagaaccttaattcttttttatttgaaattttaagtcaagtcctttataaagaccatagcagtggaaaacagtgtactttttaaaaaattgctgaatataaaatctttgaaaattttctttatgtgtgaagacacaaagtatgggggaagacagcaatcaaaactaactttttgtagatagccatttcatttctttaaactgtttcaacgccaatatgtattctacaaaagagaatggttttaggctccagtgttatacttttttttatatatatatataaaaataaactttacgtagtgaaatct

SEQ ID NO: 95982 - DNA, 1812 bp, Homo sapiens
catgtgtactaatggctttcttagatcacagaggtctgcggcattccagtgcaaaagttcggagcaggacggcttacctgttttctagatttgtcaaatctctcaataagcaaatgaatcctttcattgaggatattttgaatagaatacaagatttattagagctttctccacctgagaatggccaccagtccttactgagcagcgatgatcaactttttatttatgagacagctggagtgctgattgttaatagtgaatatccggcagaaaggaaacaagccttaatgaggaatctgttgactccactaatggagaagtttaaaattctgttagaatagttgatgctggcacaagatgaagataggcaagcctctctagcagactgtctcaaccatgctgttggatttgcaagtccaaccagtaaagctttcagcaacaagcagactataaaacaatgtggctgttctgaagtttgtctggactgtttacagacattcctgccagccctcagttgtcccttacaaaaggatattctcagaagtggagtccgtactttccttcatcgaatggttatttgcctgggggaagaagtttttccgttcatcccagctgcttcagaacgtatgctcaaagattgtgaagcagaagacctccaggagttcattcttcttatcaaccagattacggccaaattcaagatacaggtatccccgtttttacaacagatgttcatgcccctgcttcatgcaatttttgaagtgctgctccggccagcagaagaaaatgaccagtctgctgctttagagaagcagatgttgcggaggagttactttgctttcctgcaaacagtcacaggcagtgggatgagcgaagttatagcaaatcaaggtgcagagaatgtagaaagagtgttggttactgttatccaaggagcagttgaatatccagatccaattgcacagaaaacatgttttatcatcctctcaaagttggtagaactctggggaggtaaagatggaccagtgggatttgctgattttgtttataagcacattgtccccgcatgtttcctagcacctttaaaacaaacctttgacctggcagatgcacaaacagtattggctttatctgagtgtgcagtgacactgaaaacaattcatctcaaacggggcccagaatgtgttcagtatcttcaacaagaatacctgccctccttgcaagtagctccagaaataattcaggagttttgtcaagcgcttcagcagcctgatgctaaagtttttaaaaattacttaaaggtgttcttccagagagcaaagccctgaggactggatttccctgtgcctacttcatgatcatgaattccagttaatttataaagaggcgatttttgtgtgccattcacactggtctttttcacattgttttgagcttattgcagtatatgttttgggatttttctgtaaaatgggtgtaattttcctaatacaggtatgtaacaacaaaagaagttgcctgcatgccggtccaaattgttctgtataaagatgctcttaaaagacacaagagttatcctagaaccttaattcttttttatttgaaattttaagtcaagtcctttataaagaccatagcagtggaaaacagtgtactttttaaaaaattgctgaatataaaatctttgaaaattttctttatgtgtgaagacacaaagtatgggggaagacagcaatcaaaactaactttttgtagatagccatttcatttctttaaactgtttcaacgctttgacaggcctctcggatctcg

SEQ ID NO: 95983 - DNA, 556 bp, Homo sapiens
gggttgactaacgctttcccattagcttaaggtattgtaaagtctggccttacctagtttaaaatctctattctctctccctcccttttccccctctctttcccctatctcctttccccacttctctctccttcctctctcgaggttgagtcttgttcaggcccagaaacctgtagtggagaaacggagtaagttgatttcctgtttctgtcctttgattctcttctcccttcccgcccccaggcccttgtagactctggctcttcaagattgaggggagaaaggaagcagagataatggtcagtgtttagagaccagcattgttagcgggcactctgggtgtagctgctgtccatgtgctgggtctttgttttgtgggtaatatgggctgttgggaacctgactgacagaaatctcccatctgcagcctctttgcttttgctttaggtcaggagttggcaaactacatacagctcatgggccaaatccagcccagcacctgtttttgtgtggcctgaaggctaagagtgatttatacatttgtaaatggttgaga

SEQ ID NO: 95984 - DNA, 661 bp, Homo sapiens
cagacacgagtggaggcattgtgacctccagcctcagcagacacctccacactgcgcagggcagagcaaccacgccaccgagtgagccccatttgcagactttgagcaaataatgattgtgcacgttggatcatttattgagtttctctcgtacaccaagcactggttggatcccatgcttgttggtgacagaactgctgtgatgccagtcctgcgtccccttcagcctgtgaaggaggagcaccatgaaccagccaactaacacgtgtctaatcacataaagggaactgaacaccagagagccacagtcactttccgaaggtcacacagcaagtgcaaatgaggcctcatcctcagggctgggttccaggcctgctgggcaggtcggttactgctgcacaaaatttctgttatcctaaaattgtttcagacaagcaccaaaggacgtcccatagttctgcttgactaaggtttaatgaagttaatgttcatactttccactctatttttccactctttaaggatccaaattttcttggtgtaactgcgtataaaagtttaactattacagagataaccacaaaatttgatgaggcttcattgagtggaaaacactgtagtccaaataaatgcagaaatcattggtttgggaaccaaggga

SEQ ID NO: 95985 - DNA, 455 bp, Homo sapiens
gccactgctttcacagagaagggcactgtaagtcacatgccaacaggcaaggatgtataattttctccaggaaagaggggtgaaaaatcggatacaaaattacagtcaaccacatcttcctttctggatgaaactttacatgtgataaatatacactcttacagaattagatacaatttaccattttatattggcttttaagatatgcattttctcccaagttaaggtctgaaatcgtgatgcatcttacggtagatggggtcttataatcactgcaagccaggcagctgttgtgatgtcattgcctaggcatgagagaacttggctgctagtcctggtggtaggattggacacctgcaaccattgacatttcaggatcatttgagaaaggaatatgagtcctgactttcatttgaaaattttctgttgacaccccctagtaagatcagcatcca

SEQ ID NO: 95986 - DNA, 317 bp, Homo sapiens
tttccgattccaagacctgtttggtgtgaaagtgcagctaagttactgttaatcaagatcagaataaaagaatctaccaagaaaaattaacaaaatcccccttttaatgtataatcttccatctgtcaggctgtaagttaaataacacaaaacaaagctgtatgttttatggatatgtacatatataattgcagggaacatgatttggaaggatatacacttacattgctaagaatagtcacccctaaggagaagactggggtcataagtggaagtcaagggagtcttcagctttctttttgtatttaaattttgat

SEQ ID NO: 95987 - DNA, 258 bp, Homo sapiens
tcaaaacactccagcaaatgagatctgccttcagttttcgtttgtttgttttgagacggagtccggctctgtcacccaggctcgagtgcagtggtgcagtcttagctcattgcagcctcaatctcctgggctcaggcatctgagtagctaggactacaggcatgtaccactgtgcccagaagtttttttttttcctaaagtttaataattctgcttttaggccacatcaaagtcaccccctgaccatgcaggcgccca

SEQ ID NO: 95988 - DNA, 413 bp, Homo sapiens
accaccctaacgtagcaatcccaactgctttttaacagttgccatttttagatagctgaaacctgcctcttctgtagtgtcagtttgttcaaaaggctgaccatctacacctaatggtgacacaaaacacaccttaaatatttagaaagatctataatggtcttacctacaaagccttgtgctaatttttttttaattttcaggctaaataattatcagaacttaattattaaggaataacagtaacagctcagctaatatgtaacattcactgtgtgccaggcattgctcctctaagtgcttatatttaactacattaactattttgcagcaataaaaaacacatctgtcataatatgacaaagctgctgttttcagaacaaaaaaactttcaataaaaagttcatgatttt

SEQ ID NO: 95989 - DNA, 523 bp, Homo sapiens
  misc_feature (340)..(340): n is a, c, g, or t
  misc_feature (342)..(342): n is a, c, g, or t
  misc_feature (354)..(354): n is a, c, g, or t
taaggccacaccacattttacactaagtctcaagaccagacattctaatttaagtcacaccagtaccccatcaaccacacaataagtagtaatgaaaaataaagttaaaaagacaaaccagggtaaaagtcaggctgagaaatgaaagctttactagggacaaaaagtaacagaagtgacatcaattaaaatgatgattctgaactccatattgtactttcaaacagttcctttatgcaaaataactaccatgtagtttatcaatcattttgaattgtgtccctcaacagagtaagagagagagagagagtgtgtgtgtgtattttttttcttggaaaantntgagactttttnattgacaattatacttgtcccggctatgggtattaatatcactttaatcttatcctggatcctgggaatctataaaggaagaacccaggtttcttgctgggaaaagataagcactgctcagttatttgtgactttctttttattaatatattttcccaaatagaacaga

SEQ ID NO: 95990 - DNA, 782 bp, Homo sapiens
gtaaaatagggctttacataaactatcttatttaattgtcacaacatccctatgatatcacttcttttgttgtccttaatttacagatagtgagacagaatgtgaataaactaaccttgcatggtcacacaggtaatagccacagaggggaaggatatagtttactctatctatccatctatctgcttgcatatctatctattcatccctcatctaaatatgtatctctacttatctatctctccaaatacatatattttatttatgcagtgagatctggtggactttaattgcaaaataacttgagagaaaagagaattaattataagaagtacagaaaaagaaacagagcagaagcaattcctggactgtgctgtaccaggcagatgggcaatatagtcagtatgcagtgttggctctttctttgggagaatgaggtcatatctactggcaaggcccccttccctttattcccactatactgcttgggaatttctgatttaaaaaaaatactgttgataacagaaatgaccaattcatcatattgtcttgaccaaagagcagctcatactgtgacacacttgcctctctagtatctctggggaggatgttcgtaagtgagattggaggagtaatcgccccccaggaccgtgggataggttgtgcacgttgtatactgcacagtcccatgggggtgttagtctctctgaatggagtccccagagttatgcagtgcacaacctgtgtataaggcagccctgcctgcccccaccaataagatc

SEQ ID NO: 95991 - DNA, 253 bp, Homo sapiens
ctttggcgatttaattttctgcaatttaacagtaaaaggaaaattattttttatgttggaaccaaattcaatgccctgttttggtcaatgtgctttagatttgaggtctttgaacaaggaacacaatgtaacgggtagaatgtttcattgcttaagaaatggcttgagattaactttgttgctgttatttatgaaattctttttaccatcagtattgtcctttgaaaatattgccttaaaaagacctcatatg

SEQ ID NO: 95992 - DNA, 827 bp, Homo sapiens
  misc_feature (1)..(1): n is a, c, g, or t
  misc_feature (56)..(56): n is a, c, g, or t
  misc_feature (72)..(72): n is a, c, g, or t
  misc_feature (84)..(84): n is a, c, g, or t
naggataggatgccgtccccgtaaaaggaatgccggcgtgtttaagagaagcgagntttaagagcgcagggnccgaagaggacntccattcagtcagaacgtgaagaagtaagttcttggagacgtgctgatgacaggaaagatgaccgggtggaagagcgggaccctcctcgtcgagttcctcccccagctctttcaagagaccgagaaagagaccgagaccgagaaagagaaggtgaaaaagagaaggcctcatggagagctgagaaagatagggaatctctccgtcgtactaaaaatgagactgatgaagatggatggaccacagtacgacgttaagtctcaagataatggatttaaactggtgtcttaaataggtttgatcacattcaaggattattatacttgtgcttcaaccaatctaaattggattctttaatgttgtttcaccataacacaaaaagcatgaacttgtattaatcctatataatagattgatcatgcaccatatccacaggaggttggaaaaaccatgccattttctggaatttaagggtgttgcattatttcatcaatcatttgttgacaaaaaagaaaaactaaaaaataaatttaaaatgtgaaccttcaggtattgagtaacacctttatcttggtatagaactgatacttttttttgattttgaaatatctgataataatttggaatgaagtaaggttctgttaaaatatatttgaagaccctttaaagcagtgaatctgaaacaattttcacacccttaagtggttgatacgtacctatttttaggtattttgaggtatttacc

SEQ ID NO: 95993 - DNA, 386 bp, Homo sapiens
caagattagccagtaggttgcatgaagaatatgagttatgaactggacgtaaagttgactacaagtgtattaacctaagtatcccaaaggagggaatggccatttcctagggtggggaaaatcatgaaagattaggggagacaatcaggcattctgttgcatgcacattaggcttgagatggccaacacaagtgaaataacaaggcaatggatagatgaatctgaatccaaaggccaggagagagatctacactagacacatgaatttgggaagtaccagtgcctacatggtatctaattccatgagacttaatgagaacatcttgggactgagtgtagagagcaagagaagaggtccaaggattgggccctgggatcccaacatg

SEQ ID NO: 95994 - DNA, 313 bp, Homo sapiens
ttggaggccagaaatagaccaagaaggatgaagatctttgctgcttagagccacgactcaactagatttcagagaacggactccctgtctatttcttgtacaaaagaaaccctgtagcatggaaaccccatgttagagacccaatggtcaaaaaggaaagcaaagtatactttgtggacaccctgacttgtgttgcctcgctcctctcctattcactcattcttttttttaaattgtaagttaacttgctagaaaattattttagttgcacacattgctgagagccgtctcctgtgcctcctgagtagctggg

SEQ ID NO: 95995 - DNA, 504 bp, Homo sapiens
cttgcacaccctgcgggagagagctgcgtgtggaagagtcgtatttgggttatgtgactttttgctttgaaatcaagaaacacacattgtcaaaggtcatttagccttcagctggtgacctgtgtagcctggcacgatggccgtgctgtcctgcaggccacagtggggttgctagagccggcagctcctcagaaggggcctctgtccagaagtgccgctgttttcccttggaattcctgcctgcctcggattagtgtcttagctcagtgcgtggcctccaccctcaacaacccctgcgcctcccacaacccctgcgcctcccgcccacggtcccatctgaggcaggggcagccaatcttccaggcgctcggcccccaacacccactgcgtcctcgcctccttgctcctctcatgcccacccccagatgctcttcaacctcaccttcaagaaagatccagaaccaggtggcaccccccacctcctccacttcgactacttcccga

SEQ ID NO: 95996 - DNA, 158 bp, Homo sapiens
caataactccacataaagaatgtaaaaggctggatctttgttcctttcactgacatcttagctgaatctttatgatcttttttaatgcaggaggaggaaggaacacggaagaaaattacaggaacaagaatatccaaaacttaatttttttctaaatt

SEQ ID NO: 95997 - DNA, 531 bp, Homo sapiens
ggcgttcggcgacgttactggggctgcacggtgcttgtagctgggcagtcttatcatcagagtggagcctggtaaccacgacctccccgccaggtcctgtgtgttgctagctggagaagggtagttgaaaactcagaccaagcacagtgtttatatcggtcaaaactggaaaactatgtccgggcgcagccgaggctggaggatcccttcaggccaagagcaacctagcaatatggcgcgaccggatctctgtagtcctacctcaacccccagctacttgaaccccaaggttgaaggctccagtgagctatgatcccaccacagcattgcagcctgccagactgagggcttgaggatcagccaggtttcatgagttcaatgcagacctgaatcataccaagctgagactggggtacacactctcctctactgaaaagtagtgagggattccaacttggtgagagggagagtgggggagagccagaccagacaagagtgctcacctggaaaaagcctgccatcaaaggccat

SEQ ID NO: 95998 - DNA, 191 bp, Homo sapiens
aactgactaacttggaggagctaggccagattataagctcctgagttcctccaactcaatgcccggttaggatgtactgtagccaggccaacgaggtctctagacatccctgagatcataaaaatagaaagtaaggccccactgccaggttgagttgtgcaaagggagctttgagcagtctgcaaagagcc

SEQ ID NO: 95999 - DNA, 454 bp, Homo sapiens
aattcagccttccccataacttaacatgattaaactaatattcaatttaccacaaaagtggaattaatgagaggtaagtctagaaagagtttggcttactctggaggatttttgatgctaagatgagtaatttgtacttttgttagtcagataataaggaatcatcgaagttttgtgcctgtgtgtggcaagatatccggaacgtaaaatttactctctgtttttaaatatacagtttggtggcatccagtacattcacatcactgtgcaaccatcaccaccatctgtcttcagaactttttcatcatccccagctgaaactatagtcattaaacaataactcctctgtcccctcagtccccaacccctggtaactactattttactttttgcctctgtgattttgactattctgggtacctcatataaatagaagcatattttaaagaattat

SEQ ID NO: 96000 - DNA, 1018 bp, Homo sapiens
accacagatgcagggtggctgagggttgagttaatcacattcctcagttcatagcacatcatcatccctgacaaggggatcattgatccccaaaagtgttatcttatttttcccctcatctctgattctatgccttgtccctttctgctacagcttcccacaccaaagcgtttcataaatttcattaaatgtgcatgtgtctttataaaatgtgatggtgcattgtatgcatatgtcactgatttatccatttatttgatttatcagggctgtctttccaattcccctctaacccaaacaagcctatgacaaacaaccctttacaaaccaatgagaaatttccctagtttcatagccagcggtgattttgctgggtcatgggactccacaggcttaattgtctaaatagctgccatattgcttttcaatatggatttacaagtgtacactcgccagtagagtgcaagagtgcccatctgcatgcatctccaacaaaacttagttttctctaatctctgattcccatttttaaaaccatgttcacgggtgtaaaatgacacctcactgttattttcatttgcatttctctggtcactggtgtgagctctttaatttgtgtgctttctcggctttttcttatgtgtattaccgattctttggcctattttttgattgaaccacctatctttttcttgtagattttcaggaaaaaatgcttggtatattcaagatgttaattacttctcagttgcagatattgaagatatgtgtcagtagatattgaagatatgtatcattttgctttgtcgtctcttaccatttgtcagtggggctcttcatttgcggtatagtgattaagagcatatatgctggaaccaacctgcctgggtccaaatcttaactctgcctctgagctatgtgacctcagtgatggtccttaatcttctatctatatgtaaaactgatatattaaaatgaccatctcagcttgagcaacattctgagaccccacctctac

SEQ ID NO: 96001 - DNA, 1348 bp, Homo sapiens
cagggtttcaccttgttagccaggatggtctcgatctcctgacctcatgatccacctgcctcggcctcccagagtgctgggattacaggcgtgagccaccgcgcccggccagccatttttcttaacaccttctgccactttctctcggtgctaatggatggaattcctgcacaagttttaactgaacaagaaatcccagcaaaaggcattttctttctacttctttgattgtggaaaagcagacatttctctgaagcatgaccttattcttcgaaacggtattgctagtaaaatagcatgcaggacttcagacctcagggatcctttccatgcactgaccaagaattgtattaatcctttttatcattatagtttttttacattttctcattctgtcaaccatattggagtgaagtggcatagtcatcactcactgtaatctccaactcctgggctcaagtgatcctctagactcagcctctagagtagctgggactacaggcgcatgccaccatgcctggcaaattgttttatatttaggtagagattgggtcttcctatgttgcgcaggtaataaaactgtgaaaatcctggaatataagctaagaaataccaatgtggacatagggcctggcaaagatttcatgaagaagacactaaaaacaattgtaacaaaaacaaaaattgacaaatgggacctcattaaactaaagagcttctgcacagaaaaagaaactagcaacacggtaaacagacagcgtgtagaatggggaaactatttgcaaactctgcatctgacaaaggtccaatatccagaatctacaaagtacttaaacaattagacaagcaagaaaaaaaaacccaattaaaaaatgtgcaaagacatgaacagacacttttcaaaagaagacatacaagtggccaacaaacgtgaaaaaatgctcaatatcactaatcatcagataagtgcaaatcaaaactgcaatgagttaccatctcttaccagtcacaaagttggagatggtggtgaggctgcagaggaaaagaaacagacactgttggtgggaaagcaaacttgttcagccgctatggaaagcagtttggagatttctccaagaacttaaaatagaatacattaaggtggaatccataatccgggtttattccaggaacgattctttttccaaagaactgcaattgtcttacgggttcttatagagggaagagaactatggcgggagggttgtgaaatgggtcgaccggattggggcaaagaaatgtttgatgggggagtttttccaggggaaattgtggggggggaaacaagaagagagggggtttgggcatg

SEQ ID NO: 96002 - DNA, 303 bp, Homo sapiens
aactgggaacactatgtaaccacattaaagaggtctatagcaggaggaataaaagactcctaaagcctgctgactcactggctcatgactgatttcctacacattcagctggggttgtctgctttgcttgccctgtttcttgagcccaagcgacccacacacactgcctgctgatcagtaggttatgtcagaaggccgtaagggccaaatttaagctatttttcatttaaataggcgtccctagaaatagctacgtggacttacctaatatagtatttaagtccccagcttttgaagtgattc

SEQ ID NO: 96003 - DNA, 202 bp, Homo sapiens
gtccctacacattttgggcccgttctctcgattcctctgtagttctgatgttctgattccagatatgtcattcttggctcggactgttcaggagaatcatttctggatcttgctaaaaaatggactgctggtccccaactcttggtggttctggctcaggagggctgggtaagcctgggcaccccggagtgtttctggggcg

SEQ ID NO: 96004 - DNA, 543 bp, Homo sapiens
gcacacctgggtaaagctctgtaaggttactcttgcccctccatgtattccttaagtgtaccatatcacttaatggtaggtaatgataagtagggcagaaaacatcaaaaggacagcaatattcagttgggcatgtggtccatccataccaaggaccttttcctagtagaagcaccagaggatggtctgtgggaggaagtacctttttctgatttcaatctatatcacctcacatggggacaaattttctaatttttgagcatatattgggatgcagtataccagtgtgtctttgcgtaccatcaggatttcctagactttgatgatattttccatttctcaggaatttttaggataagaactttttaaagttcacttaattgcccagtcctgttgttgaaatgttgtttaatttaaagcataaaatatgctggggagagtggcacacgcctataatctcagctactgcagaggctgaggcaggaagatcacatgagccctggagttccaggccagcctgggcaatgtagggagacccgtctt

SEQ ID NO: 96005 - DNA, 491 bp, Homo sapiens
tcaggaggcctcatgatttggcttgggcagccacattcccgaatgtcaggccttcccctgttgcttgggagtgagaggccgcctccctggccagacagagggtttctggaatgtgtgaggccaggcgtcctgagggtgggcagaggtgttcagagctgcctctttccctcatcaatgttaggggcagagacacaccgagactcgtagccctacctccccgccagactccttctgcaggcctccaccccggcgtgtcctgagtccacgctttcctaacccaaactcagggcttctgcttgcaattcttgctctgtggagccaggttgggtccactctgccatctgatggcccccaggccagaggccctcatttccttctgctaggggctgggtcctcaatatcacagccctggccccaacctgagtcctatcttgccccagtgaatgtggggaccaccgggcccagcctccctgcctcatcccctgcaggag

SEQ ID NO: 96006 - DNA, 280 bp, Homo sapiens
ggatcttagggaaaacggtcagaaactcacttgggtgctcatgttcccaaatattctatatagcgcagtgcagcctagtttatgtattgaaagagcaggctctgaagaaacactgagttggattcaaatcctagttccaccagtttctaatgttataaacttgcacatattacctaatcactttgaacctcagatttccatacctctaaaatggaaatacaaattgaacccgcctcacagtcttgtgaggatgaaatgaagcaatgtgggaagcactggg

SEQ ID NO: 96007 - DNA, 466 bp, Homo sapiens
cggctccttcctggttcatggttgtcaatgttcctgatttgctgcaaggagtgctgttactcagcccctccaggaagccactagggaagcctgatcccctgccctaagcatggtgctttatctgaatgtgaaagtggtggaaagagcctccctcagatcgagttggacccagggggtcagctgctgcagcttgacaggcttgatggggtgtctgcagaaggctagtcctcacccgggggaaactgaggcagctggactagaagaagagccaaagacagcagccgggctcttcattgagcaagaggggacaggtggatcgagtcaatctgggacgatacacgagaccaggcctgtctgattacagaacttacacgcaagaggccaagctaaggctgggaaggtgggcaggggccaaagtccagagggcttattgacagatggaaatatggggctctgtctgcagggt

SEQ ID NO: 96008 - DNA, 318 bp, Homo sapiens
cctcaatattgctgtttacagtggatagcccagtgacatttatttaaagagggcagtcttaagagagtgtgttagggttatgaatctgattaagtgtgatctgataagtgggaaatggaccacttgggagaaatcaggttactttcagatataagcagaccaaactgggccttccacacaagcctgaatagctcgttttctccctatttctgttgccattgaggtacagctgggattcagggcattaggatatgtgaaaacttttagcttcctgaacccaaccagaccccagcaagagtccttttacagtttccccga

SEQ ID NO: 96009 - DNA, 1330 bp, Homo sapiens
cggggcgggggcggggcctcgcggccggcgaggggctgagctgacagggccgcatcggcttaccccaccttactttatcggaacgtgcctaagctgctgcagctggcacccggttgcgctcggcgaagagggctgggggcgggagatgacggtggtcttctccctgcttggcaccctgcgagcaccagctcccttctcctcgccactccaaggttgcagacgaagcagatgtgattataaagacttcagtggaataatcgcaagttcccatgtgagatctggttggagttggagggtgagagaaaatgaattctaatttacctgcagagaacttaaccattgcagtcaatatgaccaagactttgcctacagcagtaacgcatggatttaattccactaatgacccaccttcaatgtcaattacaaggctttttccagccttactggaatgctttggcattgtcctttgtggctacatagcaggaagggccaatgtcataacatcaacccaggccaaaggactaggaaattttgtctccagatttgcacttccagctttattattcaaaaacatggttgtacttaatttttccaatgtggactggtccttcctatatagtatcttaattgccaaagcttctgtatttttcattgtatgtgtattaaccttattggttgccagtcctgatagtcgatttagcaaagctggactattccctattttgctacacaaagtaatgactttgcattgggataccctatagttgaagctttatatcaaactacatacccagaatatctccagtacatttatttggtggcaccaatatctcttatgatgttaaaccctatagggtttattttctgtgaaatccaaaagtggaaagacactcaaaatgcttctcaaaataaaataaaaattgtgggactcggactcctgcgtgtattacagaacccaatagtatttatggtcttcattggcatcgccttcaattttattcttgatcgaaaggtacctgtatatgtcgaaaattttcttgatggacttggaaattctttttctggatcagccctattttatcttggtctcacgatggtgggaaaaataaagagactgaagaagtcggcatttgtagtactaattcttctcatcacagctaaacttctggtgctgccacttctgtgcagagaaatggtggaactcttggacaagggcgacagtgtggtgaaccatacaagtttatcaaattatgcatttctgtatggtgtatttcctgtagcaccaggagtggctatctttgcaacacaattcaacatggaagtagaaatt

SEQ ID NO: 96010 - DNA, 1284 bp, Homo sapiens
cggggcgggggcggggcctcgcggccggcgaggggctgagctgacagggccgcatcggcttaccccaccttactttatcggaacgtgcctaagctgctgcagctggcacccggttgcgctcggcgaagagggctgggggcgggagatgacggtggtcttctccctgcttggcaccctgcgagcaccagctcccttctcctcgccactccaaggttgcagacgaagcagagatctggttggagttggagggtgagagaaaatgaattctaatttacctgcagagaacttaaccattgcagtcaatatgaccaagactttgcctacagcagtaacgcatggatttaattccactaatgacccaccttcaatgtcaattacaaggctttttccagccttactggaatgctttggcattgtcctttgtggctacatagcaggaagggccaatgtcataacatcaacccaggccaaaggactaggaaattttgtctccagatttgcacttccagctttattattcaaaaacatggttgtacttaatttttccaatgtggactggtccttcctatatagtatcttaattgccaaagcttctgtatttttcattgtatgtgtattaaccttattggttgccagtcctgatagtcgatttagcaaagctggactattccctattttgctacacaaagtaatgactttgcattgggataccctatagttgaagctttatatcaaactacatacccagaatatctccagtacatttatttggtggcaccaatatctcttatgatgttaaaccctatagggtttattttctgtgaaatccaaaagtggaaagacactcaaaatgcttctcaaaataaaataaaaattgtgggactcggactcctgcgtgtattacagaacccaatagtatttatggtcttcattggcatcgccttcaattttattcttgatcgaaaggtacctgtatatgtcgaaaattttcttgatggacttggaaattctttttctggatcagccctattttatcttggtctcacgatggtgggaaaaataaagagactgaagaagtcggcatttgtagtactaattcttctcatcacagctaaacttctggtgctgccacttctgtgcagagaaatggtggaactcttggacaagggcgacagtgtggtgaaccatacaagtttatcaaattatgcatttctgtatggtgtatttcctgtagcaccaggagtggctatctttgcaacacaattcaacatggaagtagaaatt

SEQ ID NO: 96011 - DNA, 320 bp, Homo sapiens
cagtggaataatcgcaagttcccatgtggtaggtattactattattgccattttacaggtgaagaaggtgagacacagaaaagttaaagttaattcgttcaggtcgggcacagtggctcatgcctgtaatcccagcactgtgggatgctgaggcaggcagatcacctgaggtcaggagttcaaaaccagcctaagcaacatgtcgctacaaaaatacaaaaattagccgggcgtggtggcacacgaatcgcttgaacccaggagacagaggttgcactgagctgagattgcaccactgcactccagcctgggagacagag

SEQ ID NO: 96012 - DNA, 1433 bp, Homo sapiens
cggggcgggggcggggcctcgcggccggcgaggggctgagctgacagggccgcatcggcttaccccaccttactttatcggaacgtgcctaagctgctgcagctggcacccggttgcgctcggcgaagagggctgggggcgggagatgacggtggtcttctccctgcttggcaccctgcgagcaccagctcccttctcctcgccactccaaggttgcagacgaagcaggtactgtcctagatgttaaggacacaacattgagcaaaaacatgcatagtccctgcttccgtgacacttgagtgaactgaatgtgcaaagtccctgtggcacaaagtccctggggccagtgtgtgtggcgggtgtagaaggagctaaagagatctggttggagttggagggtgagagaaaatgaattctaatttacctgcagagaacttaaccattgcagtcaatatgaccaagactttgcctacagcagtaacgcatggatttaattccactaatgacccaccttcaatgtcaattacaaggctttttccagccttactggaatgctttggcattgtcctttgtggctacatagcaggaagggccaatgtcataacatcaacccaggccaaaggactaggaaattttgtctccagatttgcacttccagctttattattcaaaaacatggttgtacttaatttttccaatgtggactggtccttcctatatagtatcttaattgccaaagcttctgtatttttcattgtatgtgtattaaccttattggttgccagtcctgatagtcgatttagcaaagctggactattccctattttgctacacaaagtaatgactttgcattgggataccctatagttgaagctttatatcaaactacatacccagaatatctccagtacatttatttggtggcaccaatatctcttatgatgttaaaccctatagggtttattttctgtgaaatccaaaagtggaaagacactcaaaatgcttctcaaaataaaataaaaattgtgggactcggactcctgcgtgtattacagaacccaatagtatttatggtcttcattggcatcgccttcaattttattcttgatcgaaaggtacctgtatatgtcgaaaattttcttgatggacttggaaattctttttctggatcagccctattttatcttggtctcacgatggtgggaaaaataaagagactgaagaagtcggcatttgtagtactaattcttctcatcacagctaaacttctggtgctgccacttctgtgcagagaaatggtggaactcttggacaagggcgacagtgtggtgaaccatacaagtttatcaaattatgcatttctgtatggtgtatttcctgtagcaccaggagtggctatctttgcaacacaattcaacatggaagtagaaatt

SEQ ID NO: 96013 - DNA, 687 bp, Homo sapiens
agcggttctgtgcttagcttcactggagtgtcaacacttaatactagttatgtagaattacaactttatatttattacagtaaatacacaggcatgtaaggaaaaattctagaacagtttttcttagtatggtaaaaattttaatcaccatttcacttttgaagatcattctctcttgcacagagcactaaattcagtacgagatctgctatgatgtttctctcttatatgtaaccaagaaatttcccatgctgtcactaagaatcaggtattcctcctgctttctgctaaaggacctaaaattatattggaaatatcatcaaaggataaatcatactggatcttcttttggttacatttataggagctgccactcagtgaccatgtcaagggcacgttggctctcagccccagccactctcccatggccagcacacaaggccaccacagcctggtcctgacgtgatacccaagaccggtgggtacgaggggcatctgcttcactgcttctcaatattggaccagtttcttaaaactattttccaggaatagacaaaccctacctgcaaaccaagaagacagattttggcctatgtttagcaatattctcttgccatgatggagagtatcctctcatgaacaacgattataaatctgtcaatcaccctatgtaacttctcaaatgaa

SEQ ID NO: 96014 - DNA, 968 bp, Homo sapiens
agcggttctgtgcttagcttcactggagtgtcaacacttaatactagttatgtagaattacaactttatatttattacagtaaatacacaggcatgtaaggaaaaattctagaacagtttttcttagtatggtaaaaattttaatcaccatttcacttttgaagatcattctctcttgcacagagcactaaattcagtacgagatctgctatgatgtttctctcttatatgtaaccaagaaatttcccatgctgtcactaagaatcaggacctaaaattatattggaaatatcatcaaaggataaatcatactggatcttcttttggttacatttataggtatgttattcatataaattctataaaaattatatacatttataaaaatataatatcctatcagtcataattttgactatattaaaccttttctaaagttatatttatatagatattaatataaatattttaaagattatgtcaaatgtatggaagtctggtggttctaatgtgatgattctggtttttatcttactgtgctacatataatagaaatagctaaattttattgccaattgaaaattttcaaccaattttaaccatggttattacaagtttctgtcacccacaattcctggagggtaggagctgccactcagtgaccatgtcaagggcacgttggctctcagccccagccactctcccatggccagcacacaaggccaccacagcctggtcctgacgtgatacccaagaccggtgggtacgaggggcatctgcttcactgcttctcaatattggaccagtttcttaaaactattttccaggaatagacaaaccctacctgcaaaccaagaagacagattttggcctatgtttagcaatattctcttgccatgatggagagtatcctctcatgaacaacgattataaatctgtcaatcaccctatgtaacttctcaaatgaa

SEQ ID NO: 96015 - DNA, 731 bp, Homo sapiens
ggagtgtcagagaggggctcagagggcccccaggagcaaatgaagacagagaaataattagtcaagcaaaatagggaagtggtgagagggtccagccagctgaagagagcatgatactcaaggaattaaaataagcccagtgtaaccagatcaaaggagcggggcagctggagatgtggctagaaggtgaggggaacccagatcatgcagtgaatcaggtgagttaatttgtaggctcttagggtctaacacagtttgttacagacaagtatcatagctaagaaaagggtacaaatttcttaatatacaatggaaatgatagcctagtttcctattagcatccccaggttatagagaaaaaagtcattggggacatatcatcatttttaaagaattgaagttgggtagatttaaaattctttttatttcctttgcatgctggaaggtaaaagaaaagtcatatagaacctaaaataactgaaactgtctctgtaatttagcaaaaaaaaaaaaaaaaaaaacttcaaaaaaatggataaccatacacaacatcaaagggagaaaccggatctcttaataactaagtaatccttaaacctattttatagggccaaaattaacctcctgggaaatcgggccttcaacctcttttaccaccaaaccaacccaaattttttttaacaccttagccaagggccaatccctttatgaagggggccgcagggataaag

SEQ ID NO: 96016 - DNA, 254 bp, Homo sapiens
cgtggcagacacgtgagcagctactgcaagcttagagatgctactagacagacaaaaaggagtaaggctatttcgaccttcaagttaaccaaaaaattaggaaataacttatcagtgagaaaaaatgggtacatgtgctagtccctgtgtaccaaggactgggcaggattccatgcttttgccaagttggacataacctacagatgagtaaacctcagacctgccaatagtcaaacatttgaaaaattaatttg

SEQ ID NO: 96017 - DNA, 380 bp, Homo sapiens
agctggtacccccgactagcccgacagtccccgactagcccgacagtccccgactagcccgaagtccccgactagcccgacagtccccgactagcccgacagcctctattcccactctcctctccactcactcggcttcagctacacaagttccctgctgtcccttacacaccaagcactccccagcctcagggcctttgcacaggctgttccctctgcctggaacactcttcccccagatatctgcttggctcccccctcacttcctttgggtctttgctcaagtgtccttctaacatgtaactgcctcacctgcactgtgccaccccactccccgcctctaggcttaatttccctctacacccctgaagagcatctgc

SEQ ID NO: 96018 - DNA, 481 bp, Homo sapiens
tgctacgaatcggcggtcaaatggtttacagtccagaggcctgcatcagctcgagtgggcagtcacttaaaaaagccataccccagtctcacatcccagatgatatcacccagcccaggacctctccatgggagatgactttgcccctgtgattccttcccctgggacactaaaacctccactcaccaggacacaggacattttttggttttcttcctgaacccactgtttccttagcccatgatcctggtatcctccttgttctccactcaaatgtacacccctacacttccatactgcaaggaaaatccggaatgagttactacaattaatggtgactgttgctttcctcaggagacacctgcctcgtatcagtcaaccccttactccctaggggagaggaccacctacccactggtgtctttccctactaccccttccaactttccatcagaatctcctgacttgtgcctccggaatt

SEQ ID NO: 96019 - DNA, 223 bp, Homo sapiens
tgcactttaccagaaaataatgttaataagtcttgagttttcaagtccctctcactgacttggcacttagagaacagccagcacaggctcaggacaccctgctgggcattctatcaaggagaccatcctcatggaaatgcagcagaaagctacatgcagaagatggatggatgctctcctcccagagaccagcaggtgcaagtgtagagggagtgggccaggg

SEQ ID NO: 96020 - DNA, 375 bp, Homo sapiens
aatagagacggggtttcaccgtgttagccaggatggtctcgatctcctgaacttgtgatccgcctgcctcggcctcccaaagtgctgggattacaggcgtgagtcaccgcacccatcctgcacttcttaaaccagcagtaagtatagtcatgagccaaataatgacatctccatccacaaatatgacagttggtcccgtaagattataatagagctgccctataccagtgtgccactttattatatatatttttttaatttttaatttgtgtaggtacatagtaggtttacatatttatggggtagttgagatactttgatacggtataataatcacatcagggtaaatggggtatccatcatctccagcattta

SEQ ID NO: 96021 - DNA, 462 bp, Homo sapiens
tgtcctcattctgttggtttctcagttttacggatgcaggatcatgcacagaaccctgtaaatgagcatagttcgtttaagtatataaagtgctttcggtggataaaatgaattttaacaggcttaagtgatgtgcctaaatgcacacaattaatgcatggctggaattcaaaatcatgtcttttcctctgttctgattgttttataaatatgggttgttttaatgtgtggctggaattcaaaattgtgtcttttcctctgttctgattgttttataaatacaggtgtagtgattgattttctacccaccatgacagggaataggttcaaaacttaaaaccctgtttgttttataattaggtagactcaaatgacaggtcaaggcagggaggggagccagtcatttttactcccatatgggtttgctccttcaaagacaggattggggtagcagtgtcagtt

SEQ ID NO: 96022 - DNA, 437 bp, Homo sapiens
gccattaggttttaacacattttctggaaatttttaaaagtgagctattaaggtaggttgtctggggttagaatagggttcccctatgtataatatggcttaaccttaggaagtgtttcataagtgctttcccattactgtctaacctgactccacaataagttgacccatatgagattgccagtattagacgatttcttactttcaaaaatactaactgcaggccaggcacagtagctcatgcctgcaatctcagcaccttgggaggccaaggtgggtggatcatctgaggtcaggagttcgagactagcctggccaacatggtgaaaccccatctctactaaaaatacaaaaattagtcaggcatggtggtgcacacctgtaatcccagctactagggaggctgaggcaggagaatcacttgaaccagggaggcg

SEQ ID NO: 96023 - DNA, 2365 bp, Homo sapiens
caaacatactttcaatgtgttttacttctgaaatcatttgaaccaaaatgtttcagcaacacagattcatctgcaaccacaaatcagacacatttagaatgacaaagccccaaaagaatgccattttcaaggctgaaactgtattattctgggctaaatggaatccttgttttagtgacactgtaagagtagaaattaaagacactgaaaatcttcccttggggaaccacaattatctgtgaacaatgaaagtttgtctgaataattcatcagcctcaagggtacaggcctccccttattctggaatcccaggagtttaggcaagtgtgtcatttaatgggtctcaactgtgtcctcagttgttattattccagggcctggcatttatgggcacattcctataattttactaattaaaaaaaaataagctatatgggaaaccactgtcaaggtcaaaattttgaagctgcattgattttacctaggaagaaagaagcttataaagtgtccatcatgagaatccacctgggacctacacaacagatcaaatacccagaacaaatcaccacgtcagagccccacagaattctgattcccaaccaacaagcatgagtaatccttttaaatggtcacttacatatcagaacaggtcctttgtgaaatttctaagcaaggcctctggtttctgactgaaacagagatttattgagaaggaggggtaaagtgaaatcaagaactgctgggaaatttccacaagaaacaaggacaaatggtttttgttgtcagagtaaaaccagcctcccctagccatggtttggaaagttatttgctagcccacaggggacaatattctcaactggtttatcagggacccttttgatccaattatagttattgggcagatacagtcagtaccctattatcagaagacctagtttcaaatcctgagtcaactttctaattcactgtgtgaccttgtacaagtcacttaagctctctgatcattggttcaacatctttaatatgaggagagtaatgcctatctcaattacctcataaaattattgcaaagatcaagtgagttgatatgttacaaattatttctaaattataagattctgtataagtggaagggttaaatatactcccatattattaaataccctacgtatcactcaggattctatatgactctgagttctcaatttctagaaatggtcccatttttactttgttccctacaattctacggagtcttttttttttttaaaggaagggtgtaggcaaaggtaaatgggagaaaacatggaatcacataccactctttggtgctgctaggcaagaattttaaactgagtttaggtcaccatcgtggacttaaggtccatatcacctcagggagacaagtagagtgggaggcatccaaaaggtaggtgattcttctcccctctagtgaagaatacaaggtcaatttacaaaaaagcaccagcagcaaataattggaaaattaaattcataaaacatttataatagcgtcaaaaaaaagaaaatactcagaaataaatttgacaaaaattgtataagatctctacattaaaaattatgaaatacatgtaagagaaattaaagaaaacctaaatagagagatataccacattcatggattggaagattcaagattattaaaatactattctccccaaatggctctatagattcaacataatcccaatcaaaatcccagtaggctttggtagaaattgagatgttggttctaaaatgaaataaaatgcagaggacctagaatatataatttccctttaatttgacaaagaagaaaaacatgttgggaagctcacctaatttcagtgtaatatttacatacgaatcaacaaatggatcagtggtatagaatagagaatcctgaaatagatctacatatatatggccaacagatttttaataatggtgccaaggctattcaggggaaagaaaattcttttttaaaaatgggattggaaaaactggataagggaaataagtgaacctcgacccctcccttataccgtgctcaaaaattaattcaaaatcattctagacataaatgtaaaagttgaaactgcaatgactctagaagaaaatatagagaaaatatctctctgaccttggaggaagcaaaaatttctgtagtgacaaagacatatataataatcatataatccattaattataagaaaaataaactagacttcatcaaaatttaaaacttctgctcatcaaaagatactaataagattaaaagtagccaggttcagtggctcatgcccataatcccagcactttgggaggctgaagcagggggatc

SEQ ID NO: 96024 - DNA, 849 bp, Homo sapiens
caaacatactttcaatgtgttttacttctgaaatcatttgaaccaaaatgtttcagcaacacagattcatctgcaaccacaaatcagacacatttagaatgacaaagccccaaaagaatgccattttcaaggctgaaactgtattattctgggctaaatggaatccttgttttagtgacactgtaagagtagaaattaaagacactgaaaatcttcccttggggaaccacaattatctgtgaacaatgaaagtttgtctgaataattcatcagcctcaagggtacaggcctccccttattctggaatcccaggagtttaggcaagtgtgtcatttaatgggtctcaactgtgtcctcagttgttattattccagggcctggcatttatgggcacattcctataattttactaattaaaaaaaaataagctatatgggaaaccactgtcaaggtcaaaattttgaagctgcattgattttacctaggaagaaagaagcttataaagtgtccatcatgagaatccacctgggacctacacaacagatcaaatacccagaacaaatcaccacgtcagagccccacagaattctgattcccaaccaacaagcatgagtaatccttttaaatggtcacttacatatcagaacaggtcctttgtgaaatttctaagcaaggcctctggtttctgactgaaacagagatttattgagaaggaggggtaaagtgaaatcaagaactgctgggaaatttccacaagaaacaaggacaaatggtttttgttgtcagagtagccccaagcacagctccagagaaaggaggagggatcccacaataaaatatttatttata

SEQ ID NO: 96025 - DNA, 905 bp, Homo sapiens
tgcacattctgtttttacctctgtcactgactctgtgggtctagccatgtcatttaaccacacttgaatttcaggtattttgtctgtaaaatgaggataataacgcctgtctactacattaaaccacaagatggtttaaaggttagcataataaattattagagtatgacctaggagttacctaatctgacctctttattttacagatagaagtacagaaaggtaaattgaattgctcaaggtcacccagtgtgtggcaaaatcagaactggaaacttaggtcttctgccagtcccattcaagggctttttccattgtacagttaaattatatgttgtgtgtaagcatagtataaactgtaaaccatcatgcaaatgtcagatgattgttttccctcagtttttccagcgctgtttgttacccttattactatgcagtgtttaaatggatgagagtggtaagaaatgaaaaatacatcactaaccagtggtcatagtaattacattttcagagaaggccatggccattagaaagttcaagctccagggcagtagtcaccttcagctttctccaaagctttagtcccttccctgctggcttccatcccctatgagcctaacctaattctcattattgctgtgtcctgcccatgtggaatgggcagcaggtggtcatcagtctgaatcaattactgtaagacctcagataattagagcattactcaaccaaagcaaagtatattccacttttatgggaaagtaatcaatctcaaaataataataatgataataataacaagaagagaaggaggaagggagggaaaaagaaagaaagagaaaaaagaaaatgtttagggatgaaactgagttaataatattgactaaactgaggtttccgaacattcc

SEQ ID NO: 96026 - DNA, 285 bp, Homo sapiens
cgccagatgccaagccccatgccagggctgcactatctcgtgtcacgcacgcggactaggaaacgcagagggaactggcagccagcgaggcggggaccgggaccccacatctcaccctttgcccactccccttctttcccgactcactctctcgaaggccgcctcctccacccagccctggcctggccccagggtgaaccccctcctcccccaatcccacctcccgaaacttagaccgatttgcagaaggaagaagtctctctggctttcttcttacctctcttt

SEQ ID NO: 96027 - DNA, 459 bp, Homo sapiens
ccactcgttgctctggtggatgggggatgggtgggctgccagggaaggtgactgggggctgcagaggcagtgaggggcaggaacagcacagtccgcccctccaagcctcaactcgcatgcctccagcttgggccaccagacttgctggccctgtccacctctagacttttgcccacacgccctgcctctgcctggaacacgctctccccagctcagtctttggaaaccacactacttctttcagggactaactcaggttgctccttggtgctgggttctccatgcagctttccttaattcccaatccttatttttattttattttattttattttattttattttattatttttttgagacagagtgtcactctgttgcccaggctggagtgcagtggtgcgatcttggctcactgcaagctccgcctcccgagttcacgctattctcctgcctcagcc

SEQ ID NO: 96028 - DNA, 256 bp, Homo sapiens
ctctctggcgctcctgttgttggatattgggccttgtggacaaatccactcgttttatctatttcctattttctatgtatgggcaagtaggtgggcaataagtaaggatatttcttttttttttttttttttttgagacagagtctcgctctgtcgcccaggctggagtgcagtggtgtgatctcggctcactgcaatctccacctcccgggttcacgccattctcctgcctcagcctcccaagtagctgggacta

SEQ ID NO: 96029 - DNA, 784 bp, Homo sapiens
attcttagttctgttctggctctgaaacaaagactaaactttcaatgtttagccatgggtcatagcgcttcaatataactaactacacaacattttttctaactaatgtaactaactacactatatagggctatacatagggcttcaatacaactaactacactacagtttttcaagggcaaacttctgcttgttgtatactgaactctgaagtaacagtcacaacagcattttacagacacctgaatttctgcacaagtcattatagatcttgatttttaaattttgttggagaggaagttagaatctatgacctagagcagctttacccatgacttattcatccagggtacccttttctctatttctacagataaccaagagttagctttcattgctgaattggtagaaaatttaaaatatatcttctaaaagatacaataatccttcttcttttacccagttcgtggccagtaattcaacattatatcatttatgctaaaatggtattgccactccaccttctagaaaggaaatacttgaccaatattcaatgacttgtggactccaatatcccaaacagaactgaaattcaggaagtgagaaaaagatgatgtaattgatgcttctggaaagaatattaattatatccaattttaaaagtagatgagtcaggggtgcccataatgaattgtgtttaccctgagaacaaatccactacattggaattttaggcataaccagtatcattaaaaggagccccttgcaggtgagtaggtagcag

SEQ ID NO: 96030 - DNA, 502 bp, Homo sapiens
tccaaataaaaagttgcacatagccccacaacttcatacttactagaactctataccaattagaaacaggcaaagccacctgaatgccatccacatatgtgtccctgctactcaacagggatcctgttgattggcatggatacagcaagcagaggtgaaggctcacaccagcatcgagggtgtgggacccaacttgcttccccagagcctgcgcggcacagccacccagagaggtcctgcctgggagaaaggtaggttggactgcaagactctactccccacagtgggaggaaacagtatgcagccagggaagtagccctgtggcaaagaacaagttcctaagacaggtttggagtcatgggccgcaggggcaggtcccagtcctgcatcccactacctaatgttacaaagaagacagtgcatcaaacatactgcctactaagtgcctgacagtgccctcatttaattgtcacagtgaccttctaaagtagctactattctc

SEQ ID NO: 96031 - DNA, 195 bp, Homo sapiens
atccacccgctttggtctcccaaagtgctgggattacaggtgtgagccaccacgcctggccccaagggtgtgtattgaagttaggtcaggattaaggggaatcaagaggctgaactacctcctaatgcaggcttgtccaacccacggcctgtagggtgcatgcagcccatggcagctttgaatgaggcccaacac

SEQ ID NO: 96032 - DNA, 280 bp, Homo sapiens
tcaacatagtttctctgtcacctttcttgccggttttttcctcccaaccatggagtctccattttctaagcaattaaattatatattcaacaggaacattccatttaaaatggttcgggacagaagactgatgcacaaggtctgaagctggaagaaaatatttagtgcttgcctacagattctgtcacccatcatctgctcggaatgcgctccgtatctttcagcgtgtccggctcttatgattgcaaatggccctgttttcaaatggaaataagacttg

SEQ ID NO: 96033 - DNA, 510 bp, Homo sapiens
tcacattttggtcctcagaaacccatccgagggggacagagtaggtgttactgttctgattttacacatgaagagactggccactcgcccccacaaatttctggaagctagtcttcctcactgaactggagccagaagccatgtgaagccagcctgctcctgcctacaccctccttcctccaggtcaatgtcatttagaatatattgcatccttttcttggatctgtctgctaggacccgggccaccctcctgctggaggcaaccccgacagcccatattttaagcagctcttttcacagcctgcaaacctcacggattgtctcttacaactgtctgtttactcacttccctccacccagtcaattccgactccaggcccgggaggacaattttaaagtgtttctgcagacagaccctctggccgcgccggaagtgttttatggacctgtgagccgagttaatcccaggaggcgcggctggattagtcccgggtatgggtgggggattca

SEQ ID NO: 96034 - DNA, 192 bp, Homo sapiens
aagaagtaatcgctgacttcgaattctctttccaataagtggccatacgctgttcatttctccttcatgatatgtctggcatctgtctccttcttttcattcctcctgtcactgctaccacatctcaggctcttattaccctgtcctggaattagaggcccagtcttttggaaatagcagcaatattttatc

SEQ ID NO: 96035 - DNA, 683 bp, Homo sapiens
gctaagacatagtatagcatttagagccccaaaatgaaattccggttgaccttctatgtcacgagcaattaagcgactcagaggaagaaaacggtgaaatagatggagttaatcatcaacatttaccagcccgacgagctgaaccacaacgtcacacaatgtagtgtatgtgttgtaagtgtgaagccagaattaagctagtagtagaaagctcagcagacgaccttcgagcattccagcagctgtttctgaacaccctgtcctttgtgtgtccgtggtgtgcatcccagcagtaagcaacaatggctgatccagaaggctgtggcttgccttttcacttcttgtgtcctgtttaagaaatatctgctatcccaagataacactaacaaagttgaccttagaattggagtgcctgggttagaaccctgctggtaccacctgcttactgcatgcttctgatgtgagttcaggagaagacactggcaaggacagcaaagaacaggagaacactctagcttccctgatagcattcaaggtgctgtccaaactgactgtgatggcaccctccagacagacagcgatgccacatgttcaagatggcagaatcactatcagcttcaattcctgaatgactgcagagcaaaatttcttacctgcaacatacactctattttcagcctccc

SEQ ID NO: 96036 - DNA, 268 bp, Homo sapiens
aggaggaagacaataagcaagtaaataaatagaataatttcagataatgacaagtaatatgagaaaagtaaaacataatgatattataaagcacaactaggatgagaagggctgttttagataggaggattaggaaaggcatttctgaggaaggcattttatctgagacctgagatatgaggagactggaattatttatccatttattcagtcattcattcaaaaaatgtttattgagtacttactgtataccacaaattgttttagg

SEQ ID NO: 96037 - DNA, 692 bp, Homo sapiens
acacatggacagggtagatctcagacagacaatccacagtgaggtttctggcacccggggtgtgcagtccacacacaggaacaggatgtttccagcaggaggaggaagcacaaggttacacaggcttcagagtcaggctgccagggatcaaatcccagcacctcctttttcctgtgatggggcttgttcaacttctttgatatctctaaactagggataacaacagcacccgcttgagactattgggtggattgactgaactcatctatgtaaaatgcccagcacacaataagctttgttataattaaggtcagtccttgaaaaggcttagtggagtttgggcaggtggctacacggtgggagaggatccagctgtgcctgtcagtccccagctgccggccacatggatgctccccactcccctagccacctctgcctgtgtacgcttctgacactacgctgcctctgcttccctctccctgttccagcacgtcgggcacacacgtggagttgcactaatgccattccgctgcagctttctgcatggcccacacccatcttttcctgggtgtccactctcagccagtcaggatggtggttgcccatcctgcaggggtccaggacctgtagcctgtgtgatagacaccagcagcagctagtctatcagccacctcagtagaggcaggtgacaa

SEQ ID NO: 96038 - DNA, 439 bp, Homo sapiens
tgactcgttgatccgtccacctggccttcaaagcgctggattacaggcatgagccactaaacccagcacatttggagagggtgagcaaacaagtaaaccaaagaagatccttctgcgagaggctccagatggatgagaccaaccatccaatcctggtgccaaggagcagacactgctgacaacaaagaagtgggtgccttcagaggcatgaagttgacgtaggtcaagcaccttttcaccctgactgggatccacatccgacttcaggtctgagcaaggagtctggtgtgctacgatgtacacagtgacacttctatcagtgacaatgagaaatgacctgcccagcatggtggcatcacacctataaacacagcactttggggctgaggcaggaggatagcttgagcccaggagttcaagaccagcctgggcaacataa

SEQ ID NO: 96039 - DNA, 352 bp, Homo sapiens
gaggtctgtgttcttcggtgtctgtaggtccgtcccatctgaatgcttctgattttctacccccgtatcactttctatttctctgcagcgtgcatcgatcgccctggtgggagcttagaaggcggcaggcgaagaggggtaggaggggggagagccgaggagaagcagagagggtggcaggcgtggggatctgccgagccggcactgcaccgggtcctaggaaggctctcggaggggaggggaggccagggcgacccccgaagcaatggcccagtccgctagaacggcactgcgttaaggcacctgggatcaggaagaaatatctaaacaacaacaacagaaaaccaacaaa

SEQ ID NO: 96040 - DNA, 383 bp, Homo sapiens
gggtaaaggggctcagactcaatagcaagaaagcaaacagcaaaggacccgaacggctgtgcctcagaaggagccacaccgacagccagcaggttaacgaagagctgttcggcattattaaccatcagggagaagcaaatcgaagccacagggaggtgtcatttcatgccgttcagttggctattatcaaaaagacgaatgtaacaggtgttgacgagaacgcagagaaaaggcacctggcacgctgtgagggagagagagcgtcaatcagtgtggccactacacaaaccatctggaggtgcctccaaaagtcaaaaatggaactactggcccagggcggtggctcacacctgtaatcccagcactttgggaggccaaggcgg

SEQ ID NO: 96041 - DNA, 837 bp, Homo sapiens
  misc_feature (37)..(37): n is a, c, g, or t
  misc_feature (43)..(44): n is a, c, g, or t
gggggggtgaggggggccgagagcgtcgcccagcggnacatgnntcgtttagaaaatgcaacaacaagggtccatcttggaagcagagggcagccttcaccagacaatcaaacctgccacctgcctgtgccttgatgttggacttctcagcttctagaacttgccagaatttccagagccttcttgctcagatgccatctttttgtatgccatttcgaagagcttcagtgatgcctgctgaagagaggatgctgtttgtccaatgttttctcccgtttcgctgtcttttctatccagaagccccttcattttggaaatctcttcttttagcttttgcacttatcagcagtgtggtgaggagaaaggaagtgccagatttatcccatgatctgaaattcgaccacgtatgagcaactgtatatgagaaagagctactaaataagacattctgtttcctggtgaggaaggagagagtaatgagcaaatcatgctcctggtgttatatacccagtcattcaacaggatctcccaactagagcaaaatggaaaaaggttgtctgttcactctgactatgcagccataaaaagaaaggagatcatgtcctttggcaggacatggaagagctggaagccattatcctcaacaaattaacacaggaacggaaaaccaaacaccacatgttctcacttataagtgggagttcaacaatgagaacacatggtcacagggagggagagcattaggataaatagctaatgaatgtgggcttaatacctaagtgatggattgataggtgcagcaaaccatcatggcacacgtttacctatgtaacaaac

SEQ ID NO: 96042 - DNA, 324 bp, Homo sapiens
cacctgtacagcgggactaggctggttcatttcaacacagtaatgagtattcatcctctgttgccctaagaacttacacctactggttcataaatggtcataaatgttcaacatttacgaatttatgttgaagtacataaattcttcaacaaggggcctttacattcatatgtagggcatttggttgcttaaatattgaaacaattataaagaagttaaattaggctgggcatgggggttcattcctgtaatcccagcatgttgggaggccaaagtgggaggaccgcttgagaccaggaatttgagaccagtctgggcaacata

SEQ ID NO: 96043 - DNA, 360 bp, Homo sapiens
ctgggagagttttttaaacacagcagagtcttttctgccatcccccatcaggacctttgccattttagcctctctgcctggactgttctttaaacggctacatctgtcttgtcctttaaagattatgttttcagagaagtctttcatgaccaccaccccaagtagaggaaggtcctatttttctttcgaggcctttttgtttttcctttcgtgggacttagcacaatttgaattgtcttctgtatatgatgctctacttggttttgttgaccctgctagaatgagcttcataaaagcaggtacaacatctcttcgtagtcactgttctgtatctagtccctagaacagtgaatgctcaaa

SEQ ID NO: 96044 - DNA, 197 bp, Homo sapiens
gaagcaccgttaagaaaggattggagactttgtcatggtacttattttccagatgtttactttttaaataaggaaaaactacaacatgttaataaccaacttggaaaaaacaatattgtgatctgagaaagaacaaaacacatgccatacttaatatgttagtatccattttttccccttcaaatacaattctgcat

SEQ ID NO: 96045 - DNA, 627 bp, Homo sapiens
accagcgtggtaggtggcagtgtgtcaggaatactaaatggaatattatagaaactgagaacaaaactcaagaaacttgtttctgcaaagaaacccagacatcctgtttataaaaatgacgtggaggctggagcaccacactaaacaaacgaatgttctcttctcagatgtatctttacttgtcattatacttttggctaaacgtttcttttttctttctttcttttgtagagacagggtctctctatgttgcccagggtagtgttgaactgctggcctcaagctgtcctcctgccttagcctctgcatccagccaaaatattcctatgaaatataaatgtttcaaccaggcacggtgactcacaactgtaatcccagcactttgggaggctgaagcaggagcatcacttgaggtcaggagttcaagatcagcatggccaacatggtgaaactctgtctctactaaaaatacaaaaaattagccaggcatgatggcaggtgcctgtagtcccagctactcaggaggatgagcgggagaatcgcttgaatccaggaggtggaggttgcggtgagccgagattgtgcaactgcattccagcctgggtgacagagcaagatcctgtttcc

SEQ ID NO: 96046 - DNA, 493 bp, Homo sapiens
aggcggtttacatacacggatatatgtttagacaacaggcggtttacatacacggatatatgtttagacaacaggcggtttacatacacggatatatgtttagacaacaggcggtttacatacacggatatatgtttagacaacaggcggtttacctagacggatatatgtttagagatttattttaaggcattggatcccgcaatcatgggggttcaaaacctgcagggcaggcggcaggcaggagacacgcagtagggcacgtcaccgtcttgaggcaggtgttctcagtgaaacctcggttttcactcttaagggcttcctttgaagggatgagtccctcccagaaaaatcgaggctaatctccttcagatcatctgattgtggatattgagctcctctgcaggacaccttcccagctacacctgggctcatgtttgagcacttaggtactgtggcctggccaggattacaggtaatgcaaacctcatcc

SEQ ID NO: 96047 - DNA, 444 bp, Homo sapiens
gtatttacattgagtatttctttttctataaagcacttaaaatatatttaatgttgtaattttcagtagttaagcatctcttagtcctttttgagaagtgttttctgagaagtaattaagacttaaagaatagaattaaactttaattgattcttttatgcttacctgtttgtttctttaaaaaggtaccctcaccattagtttattaatccagtacttttccaacatcaatattttatagttactctatgagttgagtggctaaacttggtatttttgagttttctaaagtctacttcttaaaaatgccagtaattatcagcattcttataataatattggggtagttatagaacaacttcacaattcctctgttaacttcagtttttgtttcatttgttttataattttttctatttattaacaatagaactgtcaggaaaa

SEQ ID NO: 96048 - DNA, 388 bp, Homo sapiens
tatagatgcatgtcaccacacctggctaattttttgtatttttggtagagatggggtttcgccatgttgcccaggctggcctcgaactcctgagctcaagtgatgtgcctgcctcagcttcccaaagtctaggattacaggtgtgagtcactgcacccggccatagatcctatttttattgatcctttgttcactttaaggcaggggtccccaacccccaggccacatatacctactgggctgtggcctgttaggaaacaggccatacagcaggaggtgagtagggcaagtgagcattaccacctgagctccacctcctgtcagatcagtggtggcattagtttccataggagtgcgaactctattatggactgcacatgcgagggat

SEQ ID NO: 96049 - DNA, 580 bp, Homo sapiens
aagcatatgagtctttctaagtctccttttctacagacccatctgacctctcccctcctccccaggccgagctaggtcccaattcttcctcagcctccactcctccaccctataatcctttatcacctcccctcctcacacctggtccagtttaatttttttttatcaattactaacttgaggctttcattttacaacattattttggtcagttataaaaataatttaactgccaaatgggttttcccatttgacatttcaaatgttggtttaatacttatcacttagacctctatgaaggttgactcaggtttactgggggatattgcatagatcatgtcttttggtccaacagtttgggctgtgaatagtctaaatttgcatggaagctcccaactaccaagctatccaaaaactacagggacagggcggggtgaatgattctcagcaggtggcactcttccttctaattaggtcttgaatgaatgcaccagcattctgctatctcttgggtggagtgtgagactgaatcattcaataatgcttatagcgcttaagaaccaaattcaagggaactgtg

SEQ ID NO: 96050 - DNA, 199 bp, Homo sapiens
gcctgcctactcacgggctggattcgccaggcccactgtcccctctgtcctttgcacagaaggcaaatgaggtgagcacctgcatcccaaacaccctggcccattttcagagggccctttctcaccgtggcctccagctggcacccattcttgttctttttcttttctttctttcttttttttttttttttttttcctg

SEQ ID NO: 96051 - DNA, 117 bp, Homo sapiens
ctcggcctcccaaagtgctgggattacaggcatgagctcccgcacccagctggacaagcctcttgctgtcttaattctttaaaggacctgctgaagatggagatgtgggagtccagt

SEQ ID NO: 96052 - DNA, 137 bp, Homo sapiens
tgctgggtttacaggtgtgagccaccatgcccagcctaaattctgaagtttttaaagcatgttttcagaacataaagtttaatatagtgataaacttctaacaaaaaactttatgcagaactttatcttctttttct

SEQ ID NO: 96053 - DNA, 787 bp, Homo sapiens
agcgggggggcagagaagagatgcccaaggaggaggcggttggctttgtctgggtgcccaagcccagacccagatatccaggcctctgctcccttccctgaaagggtgctgtgcttcataaaaaatgagattagaaaacgagagaggaaaatatttttaatggaatcagggaatgtgaaaagcggtacatgcgaagaggaaaagatactgcagtcctggagttcgacctctgcagaggacatctggaatgctctggtccaacacgaaaaagaagaaataagcgatgaagccaggcacccagtcagtggcagaaccgacattagagcccaggcctcttcgtaatcagtcgtcttcaccccctttccaaggagagaggtgcttagaggcctagaccaggccctacagctttggagccagggcaccagaaccgctactaccctcaccttctctgtgccagacttggagttgaaaaaggtagcaacctggaaatgccaacaggagtagtcgaaaaagcccaaccaaagcctgctgtctttagccaaagaaccatggaagaggcagcctagcaagatagagaagttttaaacatcactatggattgcattgtgtctccccaaaattcatgtcgaagccttaactcccagtgtaattgtatttggagatggggcctttgggagataattagggttagatgaagtaatgagaataaggccctcatgatggaatcagcagctttataagaagaatgatggggttgggtgcagtggctcacatctgtaatcccagc

SEQ ID NO: 96054 - DNA, 297 bp, Homo sapiens
tgagattgtgccactgtactccagcctgggtaacagagcagactctgtctcaaaaaaaaaaaaatagaccaggcatggtggctcacacctgtaatcctggcactttgggagcacttcctagcactccaaaattggagaatcacttgaggccaggagttcaagaccagcctggtcaacatagtgagacccccccacctctaatatttaaaaaaaagaagatgaaatagaaaataaaagaggaacctcactcagaaattttttacaaaacagaaataaataaaaatttaaaataggccc

SEQ ID NO: 96055 - DNA, 773 bp, Homo sapiens
gctttcctaaactgggatgcccaaagggttacttgcacacaagtctcataggaacaagacacatgtcacaccaagtcagaacaaccaaccaatcattctgaggcttgtctctgacaatgacattaaaggctattttgtaaaaaactcattcattttacctatatctctcatgactggtcatatcctttacaatcctttccatccagaagagttcttcatctgtatgactttagttgtcactactggaatatctgagtagagcagagaatcatgggaatctgcagatacacataatctgcctatttagagtaagcaatttacctccctgggagatcattccagagaatgagctcactcacatttcgaaaatggaatgcaagaaagtggtttcaactcaacattttgattaaacttccgattatatgtaaacctcagaagcttgtgtataataacatgagtaaatgtactaaaattccttctatctttggcctttaaaaagaatataccatttttcgagaggctttcccagaagtagattaaagctctactctaggctggtgaagtatctaatatctatctgaaaggcaatcagtggttttatttttaatgtgttgagtcatgtgaagattacaaacatgtatacacatctgtgtagtctttgcaaataaaaaaatattttattcttaattgacactgaaccctggattattttttgtaattacatgttaacatgggaaatttgggatatttccaaaactatcttataaaaccca

SEQ ID NO: 96056 - DNA, 366 bp, Homo sapiens
tctttaagcttatgagacatggggaatcctctgtgtaaacaaaacaaaaagcttagtgaggtttgaaatggttttaaaaatctcctgatttaaaatctgcaaagagtgtaagcaagtctttactgattaatttcaatatatttaaacatatttcagtcccatatttggccaacaactagaaggcaatatatttagaggaaaaagtaatagaaggaaagagggggccgggtttaagaagagttctaaactgtttaaacacaccctgatgttgtcttgaacataggattatttgtcctaaactttcgatatagttggctgtctatatgcatttggtttttatagaatgtgatttttattcctattatt

SEQ ID NO: 96057 - DNA, 407 bp, Homo sapiens
cctgcctgacagttgagtccgcaacctccactctgacctaacaaaaagtgtgtttcttgcagtattccacttccaggacccaaattctctatcagttagatatgctttcagctataaaccattaaaactcaatgaactacagatgaaacaaataaaaatatttttctctaacagaaatctaggtgtgagtagtagcattggttccaaggcatcaaggccctaagtcagcatctctgtgattctcgtggcctcctgctcatagtcacgagatggttgcagcacatcatcacatcaccttggaaggcaggaagcaggtggtagtgtgatgcagagcttttcttctcagcctctgtctcttatatcaagaagtaaaatttttcccaaagcccctcaacagccttttactt

SEQ ID NO: 96058 - DNA, 520 bp, Homo sapiens
tcctgcctgcacataaacagtccctgccctttgttcacaaaatatcagtaactgtatgataaaataaatgtttttgtgaagcagatgattgctcatgaaaacgttatagctaggggatgagtcactgcataagctcaggatcaaataaattttatatacaatcaaggaaatcttagcaaagtttaaacatctataaactttcctttagcatttaaaataaaattgtactccatataacacaaaatggatagatttattatatgtattgcttttgcaagggattatgaagtccataaaatgtgcatgtaatataacttgattgtatcacaaatatgatttaaacaaatatgcttgctgggctcagtggctcacgcctgtaatcccaacactttgggaggtcaaggtgggaggatcatttgaggtcaggaattggagaccagtctggccaacatgatgaaaccctgtctctactaaaaatacaaaaaatttaaaaaaattagctgggcatggtggtgcatgc

SEQ ID NO: 96059 - DNA, 344 bp, Homo sapiens
gacattggttgcttagtctaagtttaatgaggcttttggctaggcattaaattttggcacaggctgtctaatctattatagtatatcttggtaagttaacatctattaattaattttcacaatagccaaatgcttcctcagcttctcttttgtgagaacataacgaaaattacaaagcaaggacaaaactatttaaaaactcttaacccagtattcgtaggcaaaagatggggaaggtaggtatcaaaatattaacactaatgattttgagccataagattatatttgatttcaattttctttaaatatgcattttccatattgttagtgttttctttataacc

SEQ ID NO: 96060 - DNA, 737 bp, Homo sapiens
tgcccacagttctgcagccactcggtacggcgctaacgccgcgaggtagctcggtgcgtctcgcagtaccagtgcgaacctttgggctctccaggtccgagatcctagtctcctgtcggctctgaggaggatggatccttctgcggatacatgggacctctcctcacctttaatatcattatggataaacaggttttacatttatctgggctttgctgttagcattagcctttggatttgtgtccagattgtcatcgagatgcagggatttgcaacagttcttgctgaagcagttacgtccctggatctgcctgtggccattattaatctaaaagaatatgatccagatgatcatctgatagaagaggtgactagtaaaaatgtctgtgtcttcctggttgcgacatacactgacggcctaccaaccgaaagtgcagagtggttctgcaaatggttagaggaagcatccattgattttcgatttggcaaaacttacctgaagggtatgagagatgcggtatttggcctgggaaattctgcctatgctagccacttcaacaaggttggcaaaaatgttgacaagtggctctggatgcttggcgtgcatcgtgtgatgagtcgaggggagggcgactgcgacgtggttaaaagcaagcacggcagcattgaggccaacttcagagcatggaagaccaagttcatctcccagctgcaggcacttcagaaaggggagagaa

SEQ ID NO: 96061 - DNA, 1088 bp, Homo sapiens
agctgctgcctggaaccagtgttttgactgagtcacctctggacgtgggcccacaagatctgagagtgcccagacgagaagttgaatgccttgtgttgacctgagtgtttggaaaaaagccccaaactttgaaacaattttcataattttgagcttcaggatgtggaatcacttctcaagtattctggagttctgtccattagagcgggtcctgccaatgctgccctgtgcagcgcttcaggctgcatccctcccactagggggcgcctttcacatagtggcgcctgccttctagaggagcaacatttcctgaactgcagggttccctcggggctttgtgtaaaacacatccactgcatagaatttgtgttatttccattttgttttcttgacaatatttaattaattacaaaatgatgtatgttatgatagtttaagcaatacagagagtaaccaaacaaaagcttggtcttttattctcgcactctgaatttacagtcctgaaaactctaaactcatcatataatctatattgtaaagactttgataatcccttcccttgcctttcctttccccattcccccttccccttccttcttctacattgtatgatgtttttcatatttacattctaaccaattgtgtcatgtgatactaatttgcagaataaagcatgttttgcacatatttccaagtcatataacatgcagacatacttcattttgtaaatatcttccttctcttactataagattgagaataggtaaagagcaactctccaatgcaggtgatgagtgtgatttgcactatcactttggacagccaattggaatatttattgaagtcatagatgcccagcaattctgttactggatgtgtctcatagacaaactcttggacattcttatagaacactgagcccaaagaagacacatcatataatgtaagaagctaggacagcttaaaaaaaaaaggcctagatctgtgtaattgtgtgagtgttctcggacatactgtttgtaaaaaatcgagttattgagtagtttgataatatgataatcatgaaaataaaggataaagcagcgagt

SEQ ID NO: 96062 - DNA, 301 bp, Homo sapiens
attaggtgttttgagagtggcaaaaagcccagaacttaaatacccaaagatgtttaagacaagtcatgtaattactttagatcacaaggaaaacacatctgctgtacttggggatcaaatcagtgcttgggatatgaagatgtctcttggcacataagaactggataatatttgtggaaccagtatttccttattaggtatgaaagttacccccattaaacagtaccaaaaatctcttaaaacttttcattgcatacattattagagccaaacctatttagtcttttctctttttttttga

SEQ ID NO: 96063 - DNA, 578 bp, Homo sapiens
caccctcacagatcttccttgacttgtccccactgcctgaaacagagcaacacctttgatcctttcctgtgtgtgtccctacctatccccttgcgccagacgaggttcttgagtgtcaccttggtcttcccctctaagagccagcggttcctgcgggttggcctggccgtgccgatcctcagcacagtggcagccctgaggaagatggttgcagaggaaggaggcgtccctgcagatgaggtgatcttggttgaactgtatcccagtggattccagcggtctttctttgatgaagaggacctgaataccatcgcagagggagataatgtgtatgcctttcaagttcctccctcacccagccaggggactctctcagctcatccactgggtctgtcggcctccccacgcctggcagcccgtgagggccagcgattctccctctctctccacagtgagagcaaggtgctaatcctcttctgtaacttggtggggtcagggcagcaggctagcaggtttgggccacccttcctgataagggaagacagagctgtttcctgggcccagctccagcagtctat

SEQ ID NO: 96064 - DNA, 462 bp, Homo sapiens
tgcatctgaaactatcttatttttttctctacttgtctgtctctctcactaaagtctatgatctttgaggagagggacttcactatatacattccagaattcccagcgtttagaacagtacttggcatgtacaggaaactcaaatacttgttgagtaactgagcaaggtccttggcacatggtcaatgctgaattaacgtcagctatcactccttcattttacaagacaattcctctttgactctgtttagtgtctagattagcaggtatttgttgagataaaaatgataatgggattttagaactggaaaaggccttgaagattatctagcccattaatttccaattacccatctcaacacactttaagataacacatgcccatcagcagccgtggctctgtaacagcagcatctcaactggcttggtgtgaaggtagtattattcccatccatctctctt

SEQ ID NO: 96065 - DNA, 369 bp, Homo sapiens
agtattcaattggcagtggttcctaagcagttcagctctgcatgtcagtaaaatatatcaaactacagtttaaatgtattaaatgattccaaaatgcatccttttagtgttaaaatggtttataaacatctcaagtaaattatcttttaaaacacaatggttctcgagcctgtatgtgcatgacaacaaacactaggggagatgcttaaaatgtagagatgcttgggtcatcccttgcccacagattctaactgcataggcatgggttaagtagagcctaggaagctttattatttcttaaaaggtctacaggagatcctcatgctggcggaggcagatctagttttgtgggtcctgaaacctacacac

SEQ ID NO: 96066 - DNA, 338 bp, Homo sapiens
tggccaaggaatcttacttttaagaatgtgaaggaatcttaagaccaaaaagtataagaaccactgacctaaatcatgattcaattcttcacttctctattctgacctataaccgcattctgttgtccattcacttttcatctctagccacttatattcatctctagacactagtctcctatagctaggctttgcatgttagaattgctttagaagtttcagaagttctcctaaatttaatatataaggtttgaacaagttctaacaccatcctaggttctcaggggtttttttgttgttttttgttttgagtcagggtttcactctgttgcctaggc

SEQ ID NO: 96067 - DNA, 438 bp, Homo sapiens
gaagacttgagtgatacaattctgtggctaccacagcaaagacagagagagtaattctcttacatatggggagattatatggatatgtgttatatatgttaacaggaataaaatataaataaaggtctccattactttagtgaagtagaaaacaggcaacctaaataaatatgttaaatgctattgacagaaatgcacaactggcaacattttgatgaaagaaaggtataataagtttctcaaaagcagccatgggagaatttttgcttgtcagattgaaccaaaattcactttgtaatcaattttcttctacctaattatgcattcacatactggcactttcgggttcttgcactggatcaaaaactattttaaaacttgcttgtatagagtacattctttttttcaatgactattcccctgtcacatactgttcag

SEQ ID NO: 96068 - DNA, 489 bp, Homo sapiens
ccaattgctctatgtttagaattgcctctttttcaagatggatttccttcacaggaatggagtgctcataattcagcatttgcagaaggactaccgagcttactacacttttctaaattttatgtccaatgttggagaccccaggaatatctttttcatttattttccactttgttttcaatttaatcagacagttggaaccaagatgatatgggtagcagtcattggggattggttaaatcttatatttaaatggtaagatttctgttttatttcattttttcctaagatttatccttaaatttgtgacttcggcataatgatcacatttcagatgtatatcgttttacttggaaaatctttcaaaaataccaggtaacttgaaacaccagattcataagtagaacttttaaaaggcacagaaatgtatatatatgtttttgtttttttttttttttgagacagagttttgcccttgttgcccaggat

SEQ ID NO: 96069 - DNA, 234 bp, Homo sapiens
atacaaatacccaaaatgaaacataaccaaacaaaatccagtaccagattaaaaacataatatacaacagacaaataggacttattccaataatatagactagtttaatacttggaaatctattaatatgataagccactataacacagcaaagaagaaaaatcttgtatccatgaagatacttgaaaaagcttgacagaaaaagctgatttaaaaaaacaaactaaagaaaat

SEQ ID NO: 96070 - DNA, 663 bp, Homo sapiens
agatggcttggaattagaaacagtcacatggtttgcaatctgcttaaaagactgcaaattgcaaatggtattgtttagtagttggctgagaaccttaacagaggttgtagagtctgaaaattatcgctggcatctctaattcttaagaaaaatgtcttggaatttcaggagtttctaagcagtatatttgtaagaaaacaaaataatttctgtcctctggggaatctcaaagtgctgagagctgacctgttaacaaagtggtaggagtggacagtgctttatgaagacggacattttatgttcagctgtggcaaccagcctggccctaagagatgctctgtagcaattaattctctttgtggtggctgatggcttcatactctgtgtgttgtagggatttagaaaggttttcctataaaatagagttgtctgtattccaaatcattgtgggttactttatgtaaattattccatttattttcttgaataacttttggtattgtttgcatgttgtattgatgttattttccatgattaaaaacaactcaatttcaggccaggtgcaatggctcacacctgtaatcccagcactttgggaagctgaagtgggtggatcacttgaggccaggagtttgagaccagcctgagcaacatggtgaaacc

SEQ ID NO: 96071 - DNA, 528 bp, Homo sapiens
aaaatactaacaaaccaaatccagcagcacatcaaaaggttaattcaccacaatcaagtaggctttattcctgggatgcaagtttgattcaacatacacaaatcaataaatatgatgtaccacataaacagaattaagaacaaaaaaccatatgatcatctcaatagataaaataaaagcttttgatcaaaatccaacatcccttcataataaaaagtctcaaaaaactaggcatcaaagaaacatacctcaaaataactagcgccatttatgacaaacccacaagccaacatcatgctgaacagacaaaagctggaagcattccccttgagaaatggaacaagacaagcctgcccactctcacctctacaaaagcactgtacaaaaatcagtagcatttctacacaccaataatgtacaagctgagagccaaatcaagaacataatcccatttacaatagccatacgcaaaaataaaacacctaagaatacatataaccaagaaggtgaaagatttctacaaggaga

SEQ ID NO: 96072 - DNA, 1818 bp, Homo sapiens
tttgttttgagcttctggaaacagtgtctcatttataagaagatggctttaaaagaaagagactccttcaaatccagtggccacagtgaaagcgggagaacgacaatggtgtgatgtgggaatttttaaaaataatacagctttggtgagccagttttatttgctgccaaaagggaagcaaagcatctcaaaggtaggaaatgcagatgtacctgactacagcttgcttaagaaacaagatcttgttccaggcacaggatacagattcagggttgctgcaatcaatggttgtgggataggtcctttcagcaaaatcagtgaatttaaaacttgtattcctggttttcctggagctccttctgcagtcagaatttcaaagaatgttgaaggtatccacctttcctgggaacctccaacctcaccttctggaaatattttggaatattcagcctacttggctatccgcacagcacagatacaagataatccaagtcaacttgtgttcatgaggatttattgtggtcttaagacatcatgtatagtaactgctgggcaacttgcaaatgcacatattgattatacatccaggcctgccattgtgttcaggatatcagcaaagaatgaaaagggatatggaccagctacacaagttcggtggcttcaaggtaacaataagaaagcacctttaaattgaattggtttttttactgaagctattgtgatgatgattatttattagtaactggttatgaagatttgtcatttaaaagagtattctctggctgtatttccagcagttatgaacttgagtttgtaaattgttcttaaaatgtatttgctgaattatagatccaaataaaagaaaagaagcaaagactctctgaaaattagtatatgagttcttccttacagatatagctcttttataaagaaaaacagtgaaattaagataaaagctagaaagctttattaccccaatatcttttataagggctgtgtaacccagtcatcctagagttattgagatgattctggtaactggctgttgtatactatgctgtcttatatagtaaatgttctctacattgtaaatgtcctacctttgagtactccttctatctttattctatatgagcagtgttcctctaacaactgtcttctattggataatatgtgtgatactataataattctaatagttatttgattcctttctttgtttacagttagcacagagcttaagaaattaaaaaagaggcaagtttagaaactgcttttgaacttttattattttccaagaatcatggtaaaatacaacaagaacaatgagttttcttgattcttaccaggccaatatatttgaatatatttttggccaaagcacttaacttatctggccctcattttcctcataacagatgagggagttaaagcagtttatcttttaggtccctttcagcactaaggttttgtgtttttagtagaagtgaagtatgtccctgaacattttcatctgtcttaatggctctaattttgcttttgctaaaattaaaatcttcataattgaattcaaaattaaagtatatgtcctcctattggagaaaaaaacaagcaccttaacaggacacaagttttaaaatagtgttttaaacatttgtaagatttttgtaaatgctctaaatgttttatttttgcattgtttttaccttgaaattgtataaacttttttactatgaaaatataagcattagacagctaactcaggttccattacaaccttaaagatacagataggcattataaacactctgctacagg

SEQ ID NO: 96073 - DNA, 2178 bp, Homo sapiens
ggatctagaaatgagccagcttggaatgaatttttctgtatttgctcctttggagcaagttgtaatgttacgctaaaggaattacattttctgagagagtctctgaaatgacaatgttctataaaatagctggcattttaacatatcactgattggaaagcatgctaactccagctaggttgatagtacagagctactgacttggagaatgcctgtcactcctgtgtttgaattggcatccctgtttcactgtcagttgacctaatctgttaagactttatttacttatgagttgttaatgttgtggtgtttatccaaatacctacttgtagatcactgcatggacttattaaatcttgaaatttttcgtatattcaataagagtcttcataaatttttttttctctgaaattagaaagagactccttcaaatccagtggccacagtgaaagcgggagaacgacaatggtgtgatgtgggaatttttaaaaataatacagctttggtgagccagttttatttgctgccaaaagggaagcaaagcatctcaaaggtaggaaatgcagatgtacctgactacagcttgcttaagaaacaagatcttgttccaggcacaggatacagattcagggttgctgcaatcaatggttgtgggataggtcctttcagcaaaatcagtgaatttaaaacttgtattcctggttttcctggagctccttctgcagtcagaatttcaaagaatgttgaaggtatccacctttcctgggaacctccaacctcaccttctggaaatattttggaatattcagcctacttggctatccgcacagcacagatacaagataatccaagtcaacttgtgttcatgaggatttattgtggtcttaagacatcatgtatagtaactgctgggcaacttgcaaatgcacatattgattatacatccaggcctgccattgtgttcaggatatcagcaaagaatgaaaagggatatggaccagctacacaagttcggtggcttcaaggtaacaataagaaagcacctttaaattgaattggtttttttactgaagctattgtgatgatgattatttattagtaactggttatgaagatttgtcatttaaaagagtattctctggctgtatttccagcagttatgaacttgagtttgtaaattgttcttaaaatgtatttgctgaattatagatccaaataaaagaaaagaagcaaagactctctgaaaattagtatatgagttcttccttacagatatagctcttttataaagaaaaacagtgaaattaagataaaagctagaaagctttattaccccaatatcttttataagggctgtgtaacccagtcatcctagagttattgagatgattctggtaactggctgttgtatactatgctgtcttatatagtaaatgttctctacattgtaaatgtcctacctttgagtactccttctatctttattctatatgagcagtgttcctctaacaactgtcttctattggataatatgtgtgatactataataattctaatagttatttgattcctttctttgtttacagttagcacagagcttaagaaattaaaaaagaggcaagtttagaaactgcttttgaacttttattattttccaagaatcatggtaaaatacaacaagaacaatgagttttcttgattcttaccaggccaatatatttgaatatatttttggccaaagcacttaacttatctggccctcattttcctcataacagatgagggagttaaagcagtttatcttttaggtccctttcagcactaaggttttgtgtttttagtagaagtgaagtatgtccctgaacattttcatctgtcttaatggctctaattttgcttttgctaaaattaaaatcttcataattgaattcaaaattaaagtatatgtcctcctattggagaaaaaaacaagcaccttaacaggacacaagttttaaaatagtgttttaaacatttgtaagatttttgtaaatgctctaaatgttttatttttgcattgtttttaccttgaaattgtataaacttttttactatgaaaatataagcattagacagctaactcaggttccattacaaccttaaagatacagataggcattataaacactctgctacagg

SEQ ID NO: 96074 - DNA, 3405 bp, Homo sapiens
agctggaggcgggtccccgccctccccagggagcagccggttgaggcgggagcggtgcattgtgggcagaggggcgggggttgggaagatggcggctcccagcctcctcaactggaggcgagtttcttccttcacggggccggtcccccgcgcccggcacggacaccgagcggtggccatccgggagctgatgatcatctttggagggggaaatgagggcatcgcggatgagctgcacgtctacaacacggctacgaatcagtggtttctgccagctgttagaggagatatccctccaggctgtgctgcccatggatttgtctgtgatggtaccagaatattagtatttgggggaatggttgaatatggaagatacagcaatgagttatatgagttacaagcaagtcgttggttatggaaaaaagtgaaaccccatccccctccttctggtttacctccttgtcctcggcttggacatagcttctctttatatggtaacaaatgctatttgtttggtggcctggcaaacgaaagcgaagattcaaacaataatgttcccagatatttaaatgatttttatgagttggagctacagcatggctctggtgttgtgggttggagcattccagtgactaaaggggttgtgccttctccaagagaatcccacacagctgttatatattgcaaaaaagattctggaagtcctaaaatgtatgtttttggtggaatgtgtggtgctcgcctggatgacctatggcagcttgacttagaaactatgtcatggtcaaaaccagaaactaaagggacagtgccacttccacgaagccttcatacagccagtgttataggaaacaagatgtacatttttggtggatgggtcccacataagggggaaaatactgagacttcacctcatgattgtgaatggagatgtaccagttcattttcttacctaaatctggatacaacagagtggaccaccctagtatcagattctcaggaagataaaaaaaattcaagaccaagaccaagagctggccactgtgctgttgcaatcggcactcgattgtatttttggagtggaagagatggctacaaaaaagcactgaatagtcaagtttgctgcaaggatctttggtatcttgatactgagaaaccaccggcaccatctcaagtacagctgatcaaagccactaccaactcctttcatgtcaagtgggatgaagtgtctacagttgagggctatcttttgcagttgagtacagacttgccataccaagctgcatcatcagattcttcagcagcaccaaatatgcaaggagtcaggatggaccctcacagacaaggcagtaataacatcgttcctaacagtatcaatgatacaataaacagcacaaaaactgaacagccagccacaaaagaaacttcaatgaaaaacaaaccagactttaaagcactgacggattctaatgccattttatatccatctttggcatcaaatgcttctaatcataatagtcatgtggtggatatgctaaggaaaaatgaaggtcctcacacttcagcaaatgtaggtgttctaagtagttgcctggatgtaagaacagtaattcctgaaacatctgtatccagtactgtttccagcacacaaactatggtaacccagcagaccattaaaactgaatcatccagtacaaatggggcagttgttaaagatgaaacttcactaacaacattcagtaccaaatctgaagttgatgaaacatatgcactgcctgcaacgaagatcagccgtgtagagacacatgctacagcaacgccgttttctaaagagactccttcaaatccagtggccacagtgaaagcgggagaacgacaatggtgtgatgtgggaatttttaaaaataatacagctttggtgagccagttttatttgctgccaaaagggaagcaaagcatctcaaagaatgttgaaggtatccacctttcctgggaacctccaacctcaccttctggaaatattttggaatattcagcctacttggctatccgcacagcacagatacaagataatccaagtcaacttgtgttcatgaggatttattgtggtcttaagacatcatgtatagtaactgctgggcaacttgcaaatgcacatattgattatacatccaggcctgccattgtgttcaggatatcagcaaagaatgaaaagggatatggaccagctacacaagttcggtggcttcaaggtaacaataagaaagcacctttaaattgaattggtttttttactgaagctattgtgatgatgattatttattagtaactggttatgaagatttgtcatttaaaagagtattctctggctgtatttccagcagttatgaacttgagtttgtaaattgttcttaaaatgtatttgctgaattatagatccaaataaaagaaaagaagcaaagactctctgaaaattagtatatgagttcttccttacagatatagctcttttataaagaaaaacagtgaaattaagataaaagctagaaagctttattaccccaatatcttttataagggctgtgtaacccagtcatcctagagttattgagatgattctggtaactggctgttgtatactatgctgtcttatatagtaaatgttctctacattgtaaatgtcctacctttgagtactccttctatctttattctatatgagcagtgttcctctaacaactgtcttctattggataatatgtgtgatactataataattctaatagttatttgattcctttctttgtttacagttagcacagagcttaagaaattaaaaaagaggcaagtttagaaactgcttttgaacttttattattttccaagaatcatggtaaaatacaacaagaacaatgagttttcttgattcttaccaggccaatatatttgaatatatttttggccaaagcacttaacttatctggccctcattttcctcataacagatgagggagttaaagcagtttatcttttaggtccctttcagcactaaggttttgtgtttttagtagaagtgaagtatgtccctgaacattttcatctgtcttaatggctctaattttgcttttgctaaaattaaaatcttcataattgaattcaaaattaaagtatatgtcctcctattggagaaaaaaacaagcaccttaacaggacacaagttttaaaatagtgttttaaacatttgtaagatttttgtaaatgctctaaatgttttatttttgcattgtttttaccttgaaattgtataaacttttttactatgaaaatataagcattagacagctaactcaggttccattacaaccttaaagatacagataggcattataaacactctgctacagg

SEQ ID NO: 96075 - DNA, 452 bp, Homo sapiens
gtatgtattgtatgaatgaggtttggggtttctgctctcctaatgcctttctgtactatatgaacttttcacagtaagcacattttatctttataaatagaaataaaatgcaaataaagggtatatattatctgaatgttttaattttttctatgatatcctagatatttaaatgatttttatgagttggagctacagcatggctctggtgttgtgggttggagcattccagtgactaaaggggttgtgccttctccaagagaatcccacacagctgttatatattgcaaaaaagattctggaagtcctaaaatgtatgtttttggtggaatgtgtggtgctcgcctggatgacctatggcagcttgacttaggtaagtttaacttgattcaggctcaggaatagggcaaattaaaaaatgctttgaaaaatattattgattgcagtattta

SEQ ID NO: 96076 - DNA, 543 bp, Homo sapiens
tgtatccagtactgtttccagcacacaaactatggtaacccagcagaccattaaaactgaatcatccagtacaaatggggcagttgttaaagatgaaacttcactaacaacattcagtaccaaatctgaaggtttgaaatgtgtttcacatactgtattttgaaccatttatgtatataaattcatcaaacttacttgtcttagatgggagttgcatttcatcttggaattttgttattagtcattttaacttaatttctgtgagcaagagttttcatttgacctaaatttaacttttagaatctttaagaattctttttagtttttgttttctttctatcatgactttatggattttgaccatatatttacctttatcagctttcatctttccagaatgtaatgtaaacagataaagcatttcatttaaaattattttataaaatattctctgcataaaatatttagattagcacacactattgaaatacaatcagaatgtgtctttcctaccatgaataaatttagcaaacttttttttag

SEQ ID NO: 96077 - DNA, 3591 bp, Homo sapiens
agctggaggcgggtccccgccctccccagggagcagccggttgaggcgggagcggtgcattgtgggcagaggggcgggggttgggaagatggcggctcccagcctcctcaactggaggcgagtttcttccttcacggggccggtcccccgcgcccggcacggacaccgagcggtggccatccgggagctgatgatcatctttggagggggaaatgagggcatcgcggatgagctgcacgtctacaacacggctacgaatcagtggtttctgccagctgttagaggagatatccctccaggctgtgctgcccatggatttgtctgtgatggtaccagaatattagtatttgggggaatggttgaatatggaagatacagcaatgagttatatgagttacaagcaagtcgttggttatggaaaaaagtgaaaccccatccccctccttctggtttacctccttgtcctcggcttggacatagcttctctttatatggtaacaaatgctatttgtttggtggcctggcaaacgaaagcgaagattcaaacaataatgttcccagatatttaaatgatttttatgagttggagctacagcatggctctggtgttgtgggttggagcattccagtgactaaaggggttgtgccttctccaagagaatcccacacagctgttatatattgcaaaaaagattctggaagtcctaaaatgtatgtttttggtggaatgtgtggtgctcgcctggatgacctatggcagcttgacttagaaactatgtcatggtcaaaaccagaaactaaagggacagtgccacttccacgaagccttcatacagccagtgttataggaaacaagatgtacatttttggtggatgggtcccacataagggggaaaatactgagacttcacctcatgattgtgaatggagatgtaccagttcattttcttacctaaatctggatacaacagagtggaccaccctagtatcagattctcaggaagataaaaaaaattcaagaccaagaccaagagctggccactgtgctgttgcaatcggcactcgattgtatttttggagtggaagagatggctacaaaaaagcactgaatagtcaagtttgctgcaaggatctttggtatcttgatactgagaaaccaccggcaccatctcaagtacagctgatcaaagccactaccaactcctttcatgtcaagtgggatgaagtgtctacagttgagggctatcttttgcagttgagtacagacttgccataccaagctgcatcatcagattcttcagcagcaccaaatatgcaaggagtcaggatggaccctcacagacaaggcagtaataacatcgttcctaacagtatcaatgatacaataaacagcacaaaaactgaacagccagccacaaaagaaacttcaatgaaaaacaaaccagactttaaagcactgacggattctaatgccattttatatccatctttggcatcaaatgcttctaatcataatagtcatgtggtggatatgctaaggaaaaatgaaggtcctcacacttcagcaaatgtaggtgttctaagtagttgcctggatgtaagaacagtaattcctgaaacatctgtatccagtactgtttccagcacacaaactatggtaacccagcagaccattaaaactgaatcatccagtacaaatggggcagttgttaaagatgaaacttcactaacaacattcagtaccaaatctgaagttgatgaaacatatgcactgcctgcaacgaagatcagccgtgtagagacacatgctacagcaacgccgttttctaaagagactccttcaaatccagtggccacagtgaaagcgggagaacgacaatggtgtgatgtgggaatttttaaaaataatacagctttggtgagccagttttatttgctgccaaaagggaagcaaagcatctcaaaggtaggaaatgcagatgtacctgactacagcttgcttaagaaacaagatcttgttccaggcacaggatacagattcagggttgctgcaatcaatggttgtgggataggtcctttcagcaaaatcagtgaatttaaaacttgtattcctggttttcctggagctccttctgcagtcagaatttcaaagaatgttgaaggtatccacctttcctgggaacctccaacctcaccttctggaaatattttggaatattcagcctacttggctatccgcacagcacagatacaagataatccaagtcaacttgtgttcatgaggatttattgtggtcttaagacatcatgtatagtaactgctgggcaacttgcaaatgcacatattgattatacatccaggcctgccattgtgttcaggatatcagcaaagaatgaaaagggatatggaccagctacacaagttcggtggcttcaaggtaacaataagaaagcacctttaaattgaattggtttttttactgaagctattgtgatgatgattatttattagtaactggttatgaagatttgtcatttaaaagagtattctctggctgtatttccagcagttatgaacttgagtttgtaaattgttcttaaaatgtatttgctgaattatagatccaaataaaagaaaagaagcaaagactctctgaaaattagtatatgagttcttccttacagatatagctcttttataaagaaaaacagtgaaattaagataaaagctagaaagctttattaccccaatatcttttataagggctgtgtaacccagtcatcctagagttattgagatgattctggtaactggctgttgtatactatgctgtcttatatagtaaatgttctctacattgtaaatgtcctacctttgagtactccttctatctttattctatatgagcagtgttcctctaacaactgtcttctattggataatatgtgtgatactataataattctaatagttatttgattcctttctttgtttacagttagcacagagcttaagaaattaaaaaagaggcaagtttagaaactgcttttgaacttttattattttccaagaatcatggtaaaatacaacaagaacaatgagttttcttgattcttaccaggccaatatatttgaatatatttttggccaaagcacttaacttatctggccctcattttcctcataacagatgagggagttaaagcagtttatcttttaggtccctttcagcactaaggttttgtgtttttagtagaagtgaagtatgtccctgaacattttcatctgtcttaatggctctaattttgcttttgctaaaattaaaatcttcataattgaattcaaaattaaagtatatgtcctcctattggagaaaaaaacaagcaccttaacaggacacaagttttaaaatagtgttttaaacatttgtaagatttttgtaaatgctctaaatgttttatttttgcattgtttttaccttgaaattgtataaacttttttactatgaaaatataagcattagacagctaactcaggttccattacaaccttaaagatacagataggcattataaacactctgctacagg

SEQ ID NO: 96078 - DNA, 3134 bp, Homo sapiens
gggaataatgacaaaaagaagacatgtgcagtgcagccaaagattttgtgaatattttcagtctgtggttagttgaatccatggatgcagcacccatagatatggagggctaactgtactaacattaagtgtaaataaatttctgattggcagtttatgtaagctggaaatgtttaagataatgttcaaataactgttctaaaatactttgtttcattttggtaagtccttgttttattttttaaaattatggaagttgaggtaatttactcttgttagatcaagttgctaatataattatttttacttttagaaactatgtcatggtcaaaaccagaaactaaagggacagtgccacttccacgaagccttcatacagccagtgttataggaaacaagatgtacatttttggtggatgggtcccacataagggggaaaatactgagacttcacctcatgattgtgaatggagatgtaccagttcattttcttacctaaatctggatacaacagagtggaccaccctagtatcagattctcaggaagataaaaaaaattcaagaccaagaccaagagctggccactgtgctgttgcaatcggcactcgattgtatttttggagtggaagagatggctacaaaaaagcactgaatagtcaagtttgctgcaaggatctttggtatcttgatactgagaaaccaccggcaccatctcaagtacagctgatcaaagccactaccaactcctttcatgtcaagtgggatgaagtgtctacagttgagggctatcttttgcagttgagtacagacttgccataccaagctgcatcatcagattcttcagcagcaccaaatatgcaaggagtcaggatggaccctcacagacaaggcagtaataacatcgttcctaacagtatcaatgatacaataaacagcacaaaaactgaacagccagccacaaaagaaacttcaatgaaaaacaaaccagactttaaagcactgacggattctaatgccattttatatccatctttggcatcaaatgcttctaatcataatagtcatgtggtggatatgctaaggaaaaatgaaggtcctcacacttcagcaaatgtaggtgttctaagtagttgcctggatgtaagaacagtaattcctgaaacatctgtatccagtactgtttccagcacacaaactatggtaacccagcagaccattaaaactgaatcatccagtacaaatggggcagttgttaaagatgaaacttcactaacaacattcagtaccaaatctgaagttgatgaaacatatgcactgcctgcaacgaagatcagccgtgtagagacacatgctacagcaacgccgttttctaaagagactccttcaaatccagtggccacagtgaaagcgggagaacgacaatggtgtgatgtgggaatttttaaaaataatacagctttggtgagccagttttatttgctgccaaaagggaagcaaagcatctcaaaggtaggaaatgcagatgtacctgactacagcttgcttaagaaacaagatcttgttccaggcacaggatacagattcagggttgctgcaatcaatggttgtgggataggtcctttcagcaaaatcagtgaatttaaaacttgtattcctggttttcctggagctccttctgcagtcagaatttcaaagaatgttgaaggtatccacctttcctgggaacctccaacctcaccttctggaaatattttggaatattcagcctacttggctatccgcacagcacagatacaagataatccaagtcaacttgtgttcatgaggatttattgtggtcttaagacatcatgtatagtaactgctgggcaacttgcaaatgcacatattgattatacatccaggcctgccattgtgttcaggatatcagcaaagaatgaaaagggatatggaccagctacacaagttcggtggcttcaaggtaacaataagaaagcacctttaaattgaattggtttttttactgaagctattgtgatgatgattatttattagtaactggttatgaagatttgtcatttaaaagagtattctctggctgtatttccagcagttatgaacttgagtttgtaaattgttcttaaaatgtatttgctgaattatagatccaaataaaagaaaagaagcaaagactctctgaaaattagtatatgagttcttccttacagatatagctcttttataaagaaaaacagtgaaattaagataaaagctagaaagctttattaccccaatatcttttataagggctgtgtaacccagtcatcctagagttattgagatgattctggtaactggctgttgtatactatgctgtcttatatagtaaatgttctctacattgtaaatgtcctacctttgagtactccttctatctttattctatatgagcagtgttcctctaacaactgtcttctattggataatatgtgtgatactataataattctaatagttatttgattcctttctttgtttacagttagcacagagcttaagaaattaaaaaagaggcaagtttagaaactgcttttgaacttttattattttccaagaatcatggtaaaatacaacaagaacaatgagttttcttgattcttaccaggccaatatatttgaatatatttttggccaaagcacttaacttatctggccctcattttcctcataacagatgagggagttaaagcagtttatcttttaggtccctttcagcactaaggttttgtgtttttagtagaagtgaagtatgtccctgaacattttcatctgtcttaatggctctaattttgcttttgctaaaattaaaatcttcataattgaattcaaaattaaagtatatgtcctcctattggagaaaaaaacaagcaccttaacaggacacaagttttaaaatagtgttttaaacatttgtaagatttttgtaaatgctctaaatgttttatttttgcattgtttttaccttgaaattgtataaacttttttactatgaaaatataagcattagacagctaactcaggttccattacaaccttaaagatacagataggcattataaacactctgctacagg

SEQ ID NO: 96079 - DNA, 2395 bp, Homo sapiens
ttggtcaggctgttcttgaactcctggcctcaggtgatctgctcgtcttggcctcccaaagtgctgggattacaggtgtgagccaccacgcccatccaggagcagctctttttttaaaagtgagtttcagcaaacagtattgaataaaagcatccttttcatatcttcatatactactttatgatgcaataatttactgttcctatacatattataaggtagaaaaaagtttttaaatccttataaagaggatgcagtttagaaggttaatatgtcagcttacccagacatattctatcaaggaaaacctagtggtagcaataaatctttggaaaggacttcttatactcatgtacctttaaaacatctaagcaatttaaaataatccctgttgagtttaaattcgagatgcatttaggtaaattggataaattcaacatttgaataaatccgtcaggttttagatggtgggattgatgaactttggtactttctcaatccaaaactaatttatttggaactagtacgttatggcttctcagtcatgaaaagctcagttatttggggtctacattttctcactgagagccttgatattttgccttctttgttatgcattataacttgactgtatcaccactgagtatctgctgtatcagaagttcagaagaaaaggtaaaactgaaatcagaatgggggtagaggaagttaaaaacaagttatttaaaaagaactcttggtttttggatgacttgaattctgttaaatctgtgttcttggccttgcacttccgttcctcttccatctctatccctgctagtcacaatggcattttagaactagaatgccactctgtagaggttttcccttttgctctgttgtgcctatttgtctaattcatatctttctgtggagtttcatatgtccttaatctaaagtaacttaaaattggaatggaagaacaagtttcagaattatttacagtcttatacatagaacttctagtgtaatgtttggttgtaaggagaatgtgaatttgcaggtaaatgaattgtatggcaaccagacagatccctggggtttgggagaaatagagcttgagatttgaaaaaaaggtacaaggtacaaaacaactctaactgccagtgccaaagggctaatttttaagcatgtaagctttaccacagtcttgaaaaaaatattaaccataggttcattcagctgttttatttaacccttagttccctggtggttgattttttttttaaatgggtctccagctttccagtgaaatgtgacactctcaatagaatgcataatgttggtttctaaagttacactccataattattgttattctgtagaaaactgtacagaaggtaaatagaatagcttcaatgggaatataatttaaatttttttaattttataaaaatttatttccattgcattaaaagaaatgggtagcatgtgtctttcagagaaaggagctatttggttattcactttgtcaatcttaggtttttttaaatctttaaacaatttcttctttgtgatgataaaaataatataaatttactgtttctgatcatgactgagtctattacttgtcatggcttttgtacgcaactgtgttttaaaaataccggttttgcctctttggttacatgtggtgagcatggatgtcaagattatttttcaactagattattcaatttgttttatatttcttatacttaatacttatgactacagtccaaatcagtcttttagaaggtgctcttgctaactgtggaatatttgacgacatgaaagtcctttttctttgctttcagtggttggctttcactgaaagaaagtgtaaaaaaagtcagaatttatagctttcactatgtccaagactaggactgggttataaagattttcttttgtgaaggaaaataaaagaaaatttgccactactgcatttactttactattgtaaacttaagattcattccttagtctttggaattttgatgtctcaaaaccagatgagtggaagtgctgaatttgcaaaataaagctaagaatgcttaactctgcactttaagttctactctgaccaaattgaagatgagcagagcagccctgaacagcattttgtttatacagtcttgtttaagaatagaatttttttaactcttcattttttgtctctgtggaagctgtgtaactctttttaaaatgcaatttaaaacattttgttattctaacaattctctcaaaaaacagcatttccaatggtaatcggtattgttacgctgtacttatgtattccctgtacctgaacacttgttgctgcctcacaagaaaatagaacttttatgttaaaaataaagtctgttcttcttga

SEQ ID NO: 96080 - DNA, 2713 bp, Homo sapiens
ttggtcaggctgttcttgaactcctggcctcaggtgatctgctcgtcttggcctcccaaagtgctgggattacaggtgtgagccaccacgcccatccaggagcagctctttttttaaaagtgagtttcagcaaacagtattgaataaaagcatccttttcatatcttcatatactactttatgatgcaataatttactgttcctatacatattataaggtagaaaaaagtttttaaatccttataaagaggatgcagtttagaaggttaatatgtcagcttacccagacatattctatcaaggaaaacctagtggtagcaataaatctttggaaaggacttcttatactcatgtacctttaaaacatctaagcaatttaaaataatccctgttgagtttaaattcgagatgcatttaggtaaattggataaattcaacatttgaataaatccgtcaggttttagatggtgggattgatgaactttggtactttctcaatccaaaactaatttatttggaactagtacgttatggcttctcagtcatgaaaagctcagttatttggggtctacattttctcactgagagccttgatattttgccttctttgttatgcattataacttgactgtatcaccactgagtatctgctgtatcagaagttcagaagaaaaggtaaaactgaaatcagaatgggggtagaggaagttaaaaacaagttatttaaaaagaactcttggtttttggatgacttgaattctgttaaatctgtgttcttggccttgcacttccgttcctcttccatctctatccctgctagtcacaatggcattttagaactagaatgccactctgtagaggttttcccttttgctctgttgtgcctatttgtctaattcatatctttctgtggagtttcatatgtccttaatctaaagtaacttaaaattggaatggaagaacaagtttcagaattatttacagtcttatacatagaacttctagtgtaatgtttggttgtaaggagaatgtgaatttgcaggtaaatgaattgtatggcaaccagacagatccctggggtttgggagaaatagagcttgagatttgaaaaaaaggtacaaggtacaaaacaactctaactgccagtgccaaagggctaatttttaagcatgtaagctttaccacagtcttgaaaaaaatattaaccataggttcattcagctgttttatttaacccttagttccctggtggttgattttttttttaaatgggtctccagctttccagtgaaatgtgacactctcaatagaatgcataatgttggtttctaaagttacactccataattattgttattctgtagaaaactgtacagaaggtaaatagaatagcttcaatgggaatataatttaaatttttttaattttataaaaatttatttccattgcattaaaagaaatgggtagcatgtgtctttcagagaaaggagctatttggttattcactttgtcaatcttaggtttttttaaatctttaaacaatttcttctttgtgatgataaaaataatataaatttactgtttctgatcatgactgagtctattacttgtcatggcttttgtacgcaactgtgttttaaaaataccggttttgcctctttggttacatgtggtgagcatggatgtcaagattatttttcaactagattattcaatttgttttatatttcttatacttaatacttatgactacagtccaaatcagtcttttagaaggtgctcttgctaactgtggaatatttgacgacatgaaagtcctttttctttgctttcagtggttggctttcactgaaagaaagtgtaaaaaaagtcagaatttatagctttcactatgtccaagactaggactgggttataaagattttcttttgtgaaggaaaataaaagaaaatttgccactactgcatttactttactattgtaaacttaagattcattccttagtctttggaattttgatgtctcaaaaccagatgagtggaagtgctgaatttgcaaaataaagctaagaatgcttaactctgcactttaagttctactctgaccaaattgaagatgagcagagcagccctgaacagcattttgtttatacagtcttgtttaagaatagaatttttttaactcttcattttttgtctctgtggaagctgtgtaactctttttaaaatgcaatttaaaacattttgttattctaacaattctctcaaaaaacagcatttccaatggtaatcggtattgttacgctgtacttatgtattccctgtacctgaacacttgttgctgcctcacaagaaaatagaacttttatgttaaaaataaagtctgttcttcttgagtttttttctgtgaatttttatgaatattgtccaaattcaagttacatttctttttggactggttatttatctagcttttaagcggtacattgtttttctcagactaatagaaaaatttgtttgtgttcagcagcaagttccttgctacccctcacctgccctagaactgaaagtacctgctctttggggtaagtgctaggcacacattaaaatataagcagcacagagagatacccacgcgtgaggaattcactgcttcagagttttgttagaggtaacttagctggggcagtcacttacattcattataaagtaca

SEQ ID NO: 96081 - DNA, 513 bp, Homo sapiens
gttcaatacaagtctcaaagggtgtttttggcttccatcccaacagcttctgttagaacaaatggaaaccatatagacataatgatacagtgagatgaagagatttatattgatcacaaagtagttcttagtacaagttctcaaaatctacttgttttgggataactccacgttgaggacctgtgtccccaagaaaaatataaaagaggctgggtgcggtgactcacacctgtaatcccagcaaattgggaagccaaagcaggagaatcgcttgagcccaggagttcgagaccagtctgggcaagatggcaagaccctgcctctaaaaaaatttaaaaaatttaaaaaattaggtgcacatggtggtgcatggtggtggatgcctgtagttccagctacttggtaggctgaggtcagaggcttgcctgagctcaggagttcaaggctgcagtgagctttgatcacttcactgcactccagcctgggtgacagagcaagaccctgtctctattt

SEQ ID NO: 96082 - DNA, 426 bp, Homo sapiens
tggtcccagctacttgggaggctgaggcaggaggattgcttgagcctgagaggtggaggctgcagtgaactatgatcgtgccactgcactccagcctaggtgacagagcaagaccctgtctaaaatagaaaaaggaatattcatccaggagccacccctctctcctgcatcatcttcccgggttgtatgtcatgaccatcagaatctaaatgggctctaatatattaaaccctccccacctacagccctccagctactgctccattatcttattgtcctctgcagcaagggcccatgaaaggactggctgcaccatcagcctccaaaattctcttttcttctctcttgaagccactccagtcaggcctttgactatgccactccttgaaacacctccagtgagttgtgcactgtgaaatccagcag

SEQ ID NO: 96083 - DNA, 427 bp, Homo sapiens
cagatttggaagttgactcaggaggccacgtgtagatcagagacagacagactcaaagcagggaggccattctggaaatgttgctgtagtccaggaagagaagatgcggcacaaaccttacagaaggaatagcagagcaagatcacatctccaccactgtcctcagttacccttcagccctgcagccgttttgcgcttacagaccaagctcagtctcacctcaggacctgtgtctagctgttgcctctgcttggaatgcccaaggttttaatgcaagtggctcatgccagtccttccctgacctctaaattagcccttccctctacatttagactgtcctgacctcacttccagtattgttacatcaccatatcgtccctggaccaccgtcacttgagattttctggtttggttttgtttgtttgtt

SEQ ID NO: 96084 - DNA, 575 bp, Homo sapiens
aaataagaacacctaggagtgaggcctggggcatgtccttttaaacaaactgccccttgtgattcttaggcactgtcaggtttgaggacggctgcctaaatggtgtcattgaggaactgaatgaaggccctcccgcttcgggctctctgttgccagaaatctctccttgctttggcttgctgcttgtttattcattgcagcaaacatttcttgagtcggtgtagagcctgtgaggcctgtgtaggatcagctatgcagactccaccctaaaaggagcctgaaaatggtcatgggtaaatcctgagaagggctgagaaaccccagactctgaccgggccactgggtaccaactacccgtgaacagattgtctggcttggggtagggggtggttagagagaggaagttcctctgactgaggaccaagatcccaaggcagcaggcacactgatcctgaccctgaccctcatctccagccctcagcagccagggtaaacaaatactcccctcactgggtatttgtagattacacaaagtaacctaggtgctgactgctgaaaatatacactcccttccc

SEQ ID NO: 96085 - DNA, 315 bp, Homo sapiens
caagagaaaaatcttcaaagctgtagcacagatgcttgataaaagcataatgcttcaaaggacaagttttaaggggcatccctgaatgttttgtggcctttcttcccaatgaagatgaaataaaaacattccacagctggatttttttctgaacagaatgccctgaagccaatggaaaaccagttaacccaaaagttcaggaatgggatgattctgatcattggaatagtcattaaattaatcaaccagaacttcctttttgattcaactctgattggttgattaactttattagagatctttttattttttttg

SEQ ID NO: 96086 - DNA, 544 bp, Homo sapiens
agccaaaagatgaaaacaacccaggtgttcatcaaaagatgaacggataaatgaattgtggtattacatataatagaatattattcaggcataaaaagcaataaagttctgatatatactacaacatgcatgaactgagaagacattaggctaaatgaaaaaagccatgcacaaaaggagaattattgtgtggctgcacttacatgaaatatttacaataggaaaatttataaagatagaaagtagattaaaggttaccagggattatgggaaggaagaaatggggagttattgcttaaaggttacagagtttctggggtgatgaaaaagttttaaaaacaggtagtagtgataattgtacaacattgtgaatataattaataccaatgaactgtacacttaaaaatggctaaattagggccaggcacggtggctcatgcctataatcccaacacttagggaggctgcggtgggcagatcacctaaggtcaggagttggaggccagcttggctaacatggtgaaaccctgtctctactacaata

SEQ ID NO: 96087 - DNA, 573 bp, Homo sapiens
ctccacctcctgggttcaagcaattctcctgcctcagcctgccaagtagctgggattatgggaatgagccaccatgcccggctaagttttgtagttttagtagagataggatttcaccatgttggccaggctggtcttgaactcctgacctcaggtgatctgcccgcctcggcctcccaaagtgcttggattacaggcgtgaactactgcacctggcctgttttatcttttatatatagatgggatctcactttgttgcccaggatagtctcaaactctggagctcaagcagtcctcctgccttggcctcccgaagtgctgagattacaggcatgagctaccacacccagccagaaatgtactttataaattccttaatgttattgaccaaattaggcaattttacacgaccttaatgccaaagtcacttatttacagtaccaaatcatgatatagcagccaagccctgttagaatttgtcagtttaaattcttctgaaatacgtagttcagatgttttccttctcttcattgttctcttcactggtcatggaaacgtcattgctaattcccc

SEQ ID NO: 96088 - DNA, 4458 bp, Homo sapiens
  misc_feature (353)..(353): n is a, c, g, or t
  misc_feature (1830)..(1830): n is a, c, g, or t
  misc_feature (1925)..(1925): n is a, c, g, or t
ctagtctataccagcaacgactcctacatcgtccactctggggatcttagaaagatccataaagctgcctcccggggacaagtccggaagctggagaagatgacaaagaggaagaagaccatcaaccttaatatacaagacgcccagaagaggactgctctacactgggcctgtgtcaatggccatgaggaagtagtaacatttctggtagacagaaagtgccagcttgacgtccttgatggcgaacacaggacacctctgatgaaggctctacaatgccatcaggaggcttgtgcaaatattctgatagattctggtgccgatataaatctcgtagatgtgtatggcaacanggctctccattatgctgtttatagtgagattttgtcagtggtggcaaaactgctgtcccatggtgcagtcatcgaagtgcacaacaaggctagcctcacaccacttttactatccataacgaaaagaagtgagcaaattgtggaatttttgctgataaaaaatgcaaatgcgaatgcagttaataagtataaatgcacagccctcatgcttgctgtatgtcatggatcatcagagatagttggcatgcttcttcagcaaaatgttgacgtctttgctgcagatatatgtggagtaactgcagaacattatgctgttacttgtggatttcatcacattcatgaacaaattatggaatatatacgaaaattatctaaaaatcatcaaaataccaatccagaaggaacatctgcaggaacacctgatgaggctgcacccttggcggaaagaacacctgacacagctgaaagcttggtggaaaaaacacctgatgaggctgcacccttggtggaaagaacacctgacacggctgaaagcttggtggaaaaaacacctgatgaggctgcatccttggtggagggaacatctgacaaaattcaatgtttggagaaagcgacatctggaaagttcgaacagtcagcagaagaaacacctagggaaattacgagtcctgcaaaagaaacatctgagaaatttacgtggccagcaaaaggaagacctaggaagatcgcatgggagaaaaaagaagacacacctagggaaattatgagtcccgcaaaagaaacatctgagaaatttacgtgggcagcaaaaggaagacctaggaagatcgcatgggagaaaaaagaaacacctgtaaagactggatgcgtggcaagagtaacatctaataaaactaaagttttggaaaaaggaagatctaagatgattgcatgtcctacaaaagaatcatctacaaaagcaagtgccaatgatcagaggttcccatcagaatccaaacaagaggaagatgaagaatattcttgtgattctcggagtctctttgagagttctgcaaagattcaagtgtgtatacctgagtctatatatcaaaaagtaatggagataaatagagaagtagaagagcctcctaagaagccatctgccttcaagcctgccattgaaatgcaaaactctgttccaaataaagcctttgaattgaagaatgaacaaacattgagagcagatccgatgttcccaccagaatccaaacaaaaggactatgaagaaaattcttgggattctgagagtctctgtgagactgtttcacagaaggatgtgtgtttacccaaggctacacatcaaaaagaaatagataaaataaatggaaaattagaagagtctcctaataaagatggtcttctgaaggctacctgcggaatgaaagtttctattccaactaaagccttagaattgaaggacatgcaaactttcaaagcngagcctccggggaagccatctgccttcgagcctgccactgaaatgcaaaagtctgtcccaaataaagccttggaattgaaaaatgaacaaacatngagagcagatgagatactcccatcagaatccaaacaaaaggactatgaagaaaattcttgggatactgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctacacatcaaaaagaaatagataaaataaatggaaaattagaagagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagattcaactagcctatcaaaaatcttggatacagttcattcttgtgaaagagcaagggaacttcaaaaagatcactgtgaacaacgtacaggaaaaatggaacaaatgaaaaagaagttttgtgtactgaaaaagaaactgtcagaagcaaaagaaataaaatcacagttagagaaccaaaaagttaaatgggaacaagagctctgcagtgtgagattgactttaaaccaagaagaagagaagagaagaaatgccgatatattaaatgaaaaaattagggaagaattaggaagaatcgaagagcagcataggaaagagttagaagtgaaacaacaacttgaacaggctctcagaatacaagatatagaattgaagagtgtagaaagtaatttgaatcaggtttctcacactcatgaaaatgaaaattatctcttacatgaaaattgcatgttgaaaaaggaaattgccatgctaaaactggaaatagccacactgaaacaccaataccaggaaaaggaaaataaatactttgaggacattaagattttaaaagaaaagaatgctgaacttcagatgaccctaaaactgaaagaggaatcattaactaaaagggcatctcaatatagtgggcagcttaaagttctgatagctgagaacacaatgctcacttctaaattgaaggaaaaacaagacaaagaaatactagaggcagaaattgaatcacaccatcctagactggcttctgctgtacaagaccatgatcaaattgtgacatcaagaaaaagtcaagaacctgctttccacattgcaggagatgcttgtttgcaaagaaaaatgaatgttgatgtgagtagtacgatatataacaatgaggtgctccatcaaccactttctgaagctcaaaggaaatccaaaagcctaaaaattaatctcaattatgcaggagatgctctaagagaaaatacattggtttcagaacatgcacaaagagaccaacgtgaaacacagtgtcaaatgaaggaagctgaacacatgtatcaaaacgaacaagataatgtgaacaaacacactgaacagcaggagtctctagatcagaaattatttcaactacaaagcaaaaatatgtggcttcaacagcaattagttcatgcacataagaaagctgacaacaaaagcaagataacaattgatattcattttcttgagaggaaaatgcaacatcatctcctaaaagagaaaaatgaggagatatttaattacaataaccatttaaaaaaccgtatatatcaatatgaaaaagagaaagcagaaacagaaaactcatgagagacaagcagtaagaaacttcttttggagaaacaacagaccagatctttactcacaactcatgctaggaggccagtcctagcatcaccttatgttgaaaatcttaccaatagtctgtgtcaacagaatacttattttagaagaaaaattcatgatttcttcctgaagcctacagacataaaataacagtgtgaagaattacttgttcacgaattgcataaagctgcacaggattcccatctaccctgatgatgcagcagacatcattcaatccaaccagaatctcgctctgcactccagcctaggtgacagagtgagactccacctcggaaa

SEQ ID NO: 96089 - DNA, 2560 bp, Homo sapiens
caggaaggagtagagtgaactcacttcagatgcatgtagattatttgcactccagaagtgtagacggtgggcactccagagactaccagaagtgggggaaccacagtgactcattaggtttctctgttacaatcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctacacatcaaaaagaaatagataaaataaatggaaaattagaagagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagattcaactagcctatcaaaaatcttggatacagttcattcttgtgaaagagcaagggaacttcaaaaagatcactgtgaacaacgtacaggaaaaatggaacaaatgaaaaagaagttttgtgtactgaaaaagaaactgtcagaagcaaaagaaataaaatcacagttagagaaccaaaaagttaaatgggaacaagagctctgcagtgtgagattgactttaaaccaagaagaagagaagagaagaaatgccgatatattaaatgaaaaaattagggaagaattaggaagaatcgaagagcagcataggaaagagttagaagtgaaacaacaacttgaacaggctctcagaatacaagatatagaattgaagagtgtagaaagtaatttgaatcaggtttctcacactcatgaaaatgaaaattatctcttacatgaaaattgcatgttgaaaaaggaaattgccatgctaaaactggaaatagccacactgaaacaccaataccaggaaaaggaaaataaatactttgaggacattaagattttaaaagaaaagaatgctgaacttcagatgaccctaaaactgaaagaggaatcattaactaaaagggcatctcaatatagtgggcagcttaaagttctgatagctgagaacacaatgctcacttctaaattgaaggaaaaacaagacaaagaaatactagaggcagaaattgaatcacaccatcctagactggcttctgctgtacaagaccatgatcaaattgtgacatcaagaaaaagtcaagaacctgctttccacattgcaggagatgcttgtttgcaaagaaaaatgaatgttgatgtgagtagtacgatatataacaatgaggtgctccatcaaccactttctgaagctcaaaggaaatccaaaagcctaaaaattaatctcaattatgcaggagatgctctaagagaaaatacattggtttcagaacatgcacaaagagaccaacgtgaaacacagtgtcaaatgaaggaagctgaacacatgtatcaaaacgaacaagataatgtgaacaaacacactgaacagcaggagtctctagatcagaaattatttcaactacaaagcaaaaatatgtggcttcaacagcaattagttcatgcacataagaaagctgacaacaaaagcaagataacaattgatattcattttcttgagaggaaaatgcaacatcatctcctaaaagagaaaaatgaggagatatttaattacaataaccatttaaaaaaccgtatatatcaatatgaaaaagagaaagcagaaacagaaaactcatgagagacaagcagtaagaaacttcttttggagaaacaacagaccagatctttactcacaactcatgctaggaggccagtcctagcatcaccttatgttgaaaatcttaccaatagtctgtgtcaacagaatacttattttagaagaaaaattcatgatttcttcctgaagcctacagacataaaataacagtgtgaagaattacttgttcacgaattgcataaagctgcacaggattcccatctaccctgatgatgcagcagacatcattcaatccaaccagatggcacgagcccgggaggcagagcttgcagtgatccgagatcacaccactgcactccaggctgggcgaaagagcgagactccgtctcataaattaaaaccaaaaccaaaaaccaaaaaataaacccttatctggctttccattgcacttaaaataaaaactacactcatctaacatggcctaccagggcctgcctgatctcttcct

SEQ ID NO: 96090 - DNA, 384 bp, Homo sapiens
tataaagtccagaggctttgacttggttttcttaccactgcctatgctcagaagaaattctgatatttctaaaaacatacttggctgggcacggtgactcatgcctgtaatcccagcacttcggaaggcccgaggtgggaggatcacctgagttcaggagtttgagaccagcctggctaatatggtgaaaccctgtctgtactaaaaatacaaaattagttgggtgtggtggcatacccctgtaatcccagctactgaggaggctgaggcaggagaatcacttgaacccgggaggtggaggttgcagtgagctgagatcgtgccattgcactcagatcgggccattgcactccagtctgggtgacagagtgagactctgtctcc

SEQ ID NO: 96091 - DNA, 307 bp, Homo sapiens
attgcagctctaaccatttgactatagaagtggttgtggttatctaccaatagaatatacaggctatagaagtaagtccacagattcatgaatgaaaatagatttgtatatgttttaaaaatttataataagaaatgttatcatgaatatatctgtgattaactttttatagatcagaggttcccatcagaatccaaacaagaggaagatgaagaatattcttgtgattctcgggtattgtgtattattgatgttattctctaaaaatattaatattgagtgatgtgaaaatataaagtccagaggc

SEQ ID NO: 96092 - DNA, 2368 bp, Homo sapiens
gctcgctctagaggatccactcgcgttttgataggattgagagcagatgagatactcccatcagaatccaaacaaaaggactatgaagaaagttcttgggattctgagagtctctgtgagactgtttcacagaaggatgtgtgtttacccaaggctacacatcaaaaagaaatagataaaataaatggaaaattagaagagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagattcaactagcctatcaaaaatcttggatacagttcattcttgtgaaagagcaagggaacttcaaaaagatcactgtgaacaacgtacaggaaaaatggaacaaatgaaaaagaagttttgtgtactgaaaaagaaactgtcagaagcaaaagaaataaaatcacagttagagaaccaaaaagttaaatgggaacaagagctctgcagtgtgagattgactttaaaccaagaagaagagaagagaagaaatgccgatatattaaatgaaaaaattagggaagaattaggaagaatcgaagagcagcataggaaagagttagaagtgaaacaacaacttgaacaggctctcagaatacaagatatagaattgaagagtgtagaaagtaatttgaatcaggtttctcacactcatgaaaatgaaaattatctcttacatgaaaattgcatgttgaaaaaggaaattgccatgctaaaactggaaatagccacactgaaacaccaataccaggaaaaggaaaataaatactttgaggacattaagattttaaaagaaaagaatgctgaacttcagatgaccctaaaactgaaagaggaatcattaactaaaagggcatctcaatatagtgggcagcttaaagttctgatagctgagaacacaatgctcacttctaaattgaaggaaaaacaagacaaagaaatactagaggcagaaattgaatcacaccatcctagactggcttctgctgtacaagaccatgatcaaattgtgacatcaagaaaaagtcaagaacctgctttccacattgcaggagatgcttgtttgcaaagaaaaatgaatgttgatgtgagtagtacgatatataacaatgaggtgctccatcaaccactttctgaagctcaaaggaaatccaaaagcctaaaaattaatctcaattatgcaggagatgctctaagagaaaatacattggtttcagaacatgcacaaagagaccaacgtgaaacacagtgtcaaatgaaggaagctgaacacatgtatcaaaacgaacaagataatgtgaacaaacacactgaacagcaggagtctctagatcagaaattatttcaactacaaagcaaaaatatgtggcttcaacagcaattagttcatgcacataagaaagctgacaacaaaagcaagataacaattgatattcattttcttgagaggaaaatgcaacatcatctcctaaaagagaaaaatgaggagatatttaattacaataaccatttaaaaaaccgtatatatcaatatgaaaaagagaaagcagaaacagaaaactcatgagagacaagcagtaagaaacttcttttggagaaacaacagaccagatctttactcacaactcatgctaggaggccagtcctagcatcaccttatgttgaaaatcttaccaatagtctgtgtcaacagaatacttattttagaagaaaaattcatgatttcttcctgaagcctacagacataaaataacagtgtgaagaattacttgttcacgaattgcataaagctgcacaggattcccatctaccctgatgatgcagcagacatcattcaatccaaccagatggcacgagcccgggaggcagagcttgcagtgatccgagatcacaccactgcactccaggctgggcgaaagagcgagactccgtctcataaattaaaaccaaaaccaaaaaccaaaaaataaacccttatctggctttccattgcacttaaaataaaaactacactcatctaacatggcctaccagggcctgcctgatctcttcct

SEQ ID NO: 96093 - DNA, 532 bp, Homo sapiens
ctgctttcagctcaccttggacaccttgtaaaatgaggggtggtaaaataatagctatgtcacagggtatagagagaattacataattagatgtatatgaaagcatcattaaaaaaaaatcaggcacaggcattgttagcgccctctgcttgtctgcttgtcatctacaaataactgaatttaacagggaaggctcctctttgcagtttttgcagggagaatgtttcaaggtcattagccctcaatgaccagaacctgaggtcttttgatggctttttggcttaccacagtctgctcatcagggttgagtttcctccttacggtgcaaattcccagcatatcctctgttcctctttgtagaaacactatatgggtcattctctccctgttcgggtatttctgcctagtgagtggagggaggcaggtgtacatggagcagggactactgaagcagggccagaggtgtgtgcctaacacagccctcataacagccatgggtcatgcagaaaggagaaaaaaaggaaaagaaaaa

SEQ ID NO: 96094 - DNA, 119 bp, Homo sapiens
aaaatgttttagtgataataatgcatttgaccatatgaataaagcaatttcctgatagtaactgcattcttaaattttaccttgctcttaaaactggaaggacacagtttattgtgagg

SEQ ID NO: 96095 - DNA, 308 bp, Homo sapiens
ggcccaaggcacagcaggtcaggtgggcagggatgaggctctaggagaacaagagagcggggacactgagcaaggccagaagtggcgggaagtggctgtgggaacatttgggcagaaaattatccctggtgtggagtgactgtggccacaccacctgtctgttcactggacttttctgaagctgggtcccccagggcttcaggggcttgggggagcacctgactcagctgctggatgcaaagtggattcctgagcagcgaggtgtgggctggagtttggatctggctgggtggagatctttgggactt

SEQ ID NO: 96096 - DNA, 532 bp, Homo sapiens
gcagtcaggagaggaaacctctctctttctcttcctgctagtacccatacactcacttttcttttggtgagagcctacctcggtttttttctaggggccccctcctcccgctccccagctccagcgtcaggccatggctgagttaaatcatgtatcaccctgtggcgtggcttcagtgagcaagaccctcctgaggcagtgaggctgggcggctatttgctgggccttctgggaaaccagaaacgtgctcttcctttggagaagctaccgggagggaattcctttctcctcggaaagggatgctgagctgccactgccatcacatcaggcctctcgacctcagctctactgacatttggactgggccattctttcttctgacatttggactgggccactcttcgtcacagcagctgtcctgtgcactgctggatgttgagcagcacgtctgcctctagccactggatgccagtagcgccccctcctcagttgggacaaccaaaaatgctccaaacgttgccacatgttccct

SEQ ID NO: 96097 - DNA, 1050 bp, Homo sapiens
tttgtgtgcagtttgctaccgtgataagaaaataactaatacaataagctaatcgcagtctatattccatttgctatcagctattcccaaatacacaaccaggatgcattaaaatgcatttcgaatacgctgacaatgtatcataatgcaaagtacttttacatggtataatactattgcagacactgtataatgaacaacagtggttttcctgtaaaggaaataatggcagcaacttccaagaaatgtatttaacggagcttcagagaatcagtagtgtgtatgtgtagcatggcccgggtatcagcccgtggtgtaggtttttaatcccatgtcatcataactttgcttttgtaacagttctggaaaaatacagaaaagcagtacgaagtcctctgtgtgtcccattagtaactatgcacaatcattttgtaatgagaatatatgagtatattaaacatgcttttactttcctaaaagaagttgcttagaatggggggaaaaactctctccaagtgtaactctccattgataaattcccctcatttcctcatttccctctcctgccagcacccggttaactctctaataaaaattgaccagatttaaaaaactccatttagtggttcctgcgtaaagagatggtattttggtcactttaatttgcatgagatgttatctgaaatcgaccactaattcttccttctcacagccccccatcccattcctctctttacaaaccgcgtaactacatactatccaggacaatataaaagtgacctcaatactcctattgcaatcaatgaaatatggtgaacagtacaggtttgtctttcattgctccctgccttgaaaggtgtgggtagaggaagaaaaatctcccttacaaactatttctccagttacaagtctttgtccagaagcaaaagaaggttttaacgttacagtacttattctaatagaattttaattgccctaatcctgctaaagtgtgaagctgagtgtgtgtgtgtgtgtgtctgtgcatgtattcctaatagggaggggagt

SEQ ID NO: 96098 - DNA, 401 bp, Homo sapiens
atgagggggaagagctggccccaaaggggtgctcagtgggctcacttcacatcctctccgattttgtctaagtcttggttccctttccaataagggagaaacagagaacaaagagtgtatcagctgccccaaacctctcagcagccatccattacccatatgtgtgtattatttatgccttttctattccaaaaatgactcaaggctgtaattgagcagcttggttctctgttgcagtattccttttccctggcttctgacaccttagagacatatatattcctttggatattcaattatgtctctcaggttggattcttttaattatagaagagatgacttaagcccaaataaggtgctctaatcagtgctggaacacttagcagaccttcctctggttc

SEQ ID NO: 96099 - DNA, 7448 bp, Homo sapiens
ctgtctacggcagctattccagaggcaacaactgcttccctctgttctcatctccccattggtggctggcgacccgaatttgggaatggggagattgcccacctgttatctttgagcagactaatctcttgtaagcagaagtgccattcggagtctccagagccctgtggcttggggctgggaatgtccccctgacttcaggctttcctaagtgtattgcttttctctgagaatggtctaggtttttaattttttaattgtaagaatctgtaatacagcatttttatttcggtcttattcgttgtgctcaaaggcaggaaacaactattaatttgccttctcgaatcttaatagttataagattcattctctttcattgctctgctaggcataaaacacacttcgaacatgggtaactcattcgactgtggagttcttttaattcttatgaaagatttcaaatcctctggaagccaaaatgggacacagtaaacagattcgaattttacttctgaacgaaatggagaaactggaaaagaccctcttcagacttgaacaagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactctgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaagggatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcagggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaataaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttagaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtc

SEQ ID NO: 96100 - DNA, 7370 bp, Homo sapiens
cccggaagtgggccagaggtacggtccgctcccacctggggcgagtgcgcgcacggccaggttgggtaccgggtgcgcccaggaacccgcgcgaggcgaagtcgctgagactctgcctgcttctcacccagctgcctcggcgctgccccggtcgctcgccgcccctccctttgcccttcacggcgcccggccctccttgggctgcggcttctgtgcgaggctgggcagccagcccttccccttctgtttctccccgtcccctccccccgaccgtagcaccagagtcgcgggtcctgcagtgccccagaagccgcacgtataactccctcggcgggtaactcattcgactgtggagttcttttaattcttatgaaagatttcaaatcctctggaagccaaaatgggacacagtaaacagattcgaattttacttctgaacgaaatggagaaactggaaaagaccctcttcagacttgaacaagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactctgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaagggatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcagggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaataaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttagaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtc

SEQ ID NO: 96101 - DNA, 7168 bp, Homo sapiens
ctgtctacggcagctattccagaggcaacaactgcttccctctgttctcatctccccattggtggctggcgacccgaatttgggaatggggagattgcccacctgttatctttgagcagactaatctcttgggtaactcattcgactgtggagttcttttaattcttatgaaagatttcaaatcctctggaagccaaaatgggacacagtaaacagattcgaattttacttctgaacgaaatggagaaactggaaaagaccctcttcagacttgaacaagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactctgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaagggatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcagggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaataaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttagaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtc

SEQ ID NO: 96102 - DNA, 7108 bp, Homo sapiens
ctgtctacggcagctattccagaggcaacaactgcttccctctgttctcatctccccattggtggctggcgacccgaatttgggaatggggagattgcccacctgttatctttgagcagactaatctcttaagccaaaatgggacacagtaaacagattcgaattttacttctgaacgaaatggagaaactggaaaagaccctcttcagacttgaacaagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactctgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaagggatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcagggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaataaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttagaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtc

SEQ ID NO: 96103 - DNA, 7183 bp, Homo sapiens
tgtataagaatttgcacatcccaagttgctatgtgaataggaatgtacgtttccaggggaaggagaaagagacattacagagcagacagctctatgatgtttactatacttgctaaaatgtgaaattcagctaaattggaatacaaagtagtgccaaaacagcattaggtttgcggagttattttaaacataattgaaaaatcaaggttttttaatactttaaataaaacatctgtttttcaatgtggtaatttaagtcctacgatgagtttattaacatgtgctttttatttagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactctgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaagggatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcagggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaataaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttagaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtc

SEQ ID NO: 96104 - DNA, 794 bp, Homo sapiens
  misc_feature (17)..(17): n is a, c, g, or t
  misc_feature (24)..(25): n is a, c, g, or t
ggcgcactagaactagnggatccnncgggctgtaggaattcggcattagctcgtgccgttactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtc

SEQ ID NO: 96105 - DNA, 7591 bp, Homo sapiens
ctgtctacggcagctattccagaggcaacaactgcttccctctgttctcatctccccattggtggctggcgacccgaatttgggaatggggagattgcccacctgttatctttgagcagactaatctcttgtaagcagaagtgccattcggagtctccagagccctgtggcttggggctgggaatgtccccctgacttcaggctttcctaagtgtattgcttttctctgagaatggtctaggtttttaattttttaattgtaagaatctgtaatacagcatttttatttcggtcttattcgttgtgctcaaaggcaggaaacaactattaatttgccttctcgaatcttaatagttataagattcattctctttcattgctctgctaggcataaaacacacttcgaacatgggtaactcattcgactgtggagttcttttaattcttatgaaagatttcaaatcctctggaagccaaaatgggacacagtaaacagattcgaattttacttctgaacgaaatggagaaactggaaaagaccctcttcagacttgaacaagaaactgggtctcactatgttgcccaggttgatattgaactcctggactcaagcaaccctccctctttggcctctgaaagtactgggattacaagcataagccaccgggcatggccccacttctgagcattaatttatttattgggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactctgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaagggatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcagggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaataaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttagaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtc

SEQ ID NO: 96106 - DNA, 7679 bp, Homo sapiens
ctgtctacggcagctattccagaggcaacaactgcttccctctgttctcatctccccattggtggctggcgacccgaatttgggaatggggagattgcccacctgttatctttgagcagactaatctcttgtaagcagaagtgccattcggagtctccagagccctgtggcttggggctgggaatgtccccctgacttcaggctttcctaagtgtattgcttttctctgagaatggtctaggtttttaattttttaattgtaagaatctgtaatacagcatttttatttcggtcttattcgttgtgctcaaaggcaggaaacaactattaatttgccttctcgaatcttaatagttataagattcattctctttcattgctctgctaggcataaaacacacttcgaacatgggtaactcattcgactgtggagttcttttaattcttatgaaagatttcaaatcctctggaagccaaaatgggacacagtaaacagattcgaattttacttctgaacgaaatggagaaactggaaaagaccctcttcagacttgaacaagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactctgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaagggatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcagggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaataaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttagaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtcaaaaaacacagcacaacaaccaaacacacaacaccaaacaacacaacacaatattataacacaaagacaccaacaaaaatatggtcggcgcgcgcgccaccacagactttaaaccagtgcgtgcggggcgcaacggaaaagaaagatgattctacagaaccgcgcgaggggtgcctccaaaaaaaagcgggcaagccgtgcaaacacagggtgcggcgggcacagaaggac

SEQ ID NO: 96107 - DNA, 7432 bp, Homo sapiens
ctgtctacggcagctattccagaggcaacaactgcttccctctgttctcatctccccattggtggctggcgacccgaatttgggaatggggagattgcccacctgttatctttgagcagactaatctcttgtaagcagaagtgccattcggagtctccagagccctgtggcttggggctgggaatgtccccctgacttcaggctttcctaagtgtattgcttttctctgagaatggtctaggtttttaattttttaattgtaagaatctgtaatacagcatttttatttcggtcttattcgttgtgctcaaaggcaggaaacaactattaatttgccttctcgaatcttaatagttataagattcattctctttcattgctctgctaggcataaaacacacttcgaacatgggtaactcattcgactgtggagttcttttaattcttatgaaagatttcaaatcctctggaagccaaaatgggacacagtaaacagattcgaattttacttctgaacgaaatggagaaactggaaaagaccctcttcagacttgaacaagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactctgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaagggatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcagggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaataaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttagaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtc

SEQ ID NO: 96108 - DNA, 6231 bp, Homo sapiens
tttctcccccacacccctcgtgtgtgtttgcgcgtgcacgcacgtgcacacacgtgcacacagcaggatgagaaggggaggaggtaggaggatacctgtgaaataaatatttgttttattttcagtgaaaaaattataggccaaaaattagaaaatagtgacagttataatctctttgtagatatttgcatttaaggtatcatcttttctttcttttagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaagggatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcagggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaataaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttagaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtc

SEQ ID NO: 96109 - DNA, 7520 bp, Homo sapiens
ctgtctacggcagctattccagaggcaacaactgcttccctctgttctcatctccccattggtggctggcgacccgaatttgggaatggggagattgcccacctgttatctttgagcagactaatctcttgtaagcagaagtgccattcggagtctccagagccctgtggcttggggctgggaatgtccccctgacttcaggctttcctaagtgtattgcttttctctgagaatggtctaggtttttaattttttaattgtaagaatctgtaatacagcatttttatttcggtcttattcgttgtgctcaaaggcaggaaacaactattaatttgccttctcgaatcttaatagttataagattcattctctttcattgctctgctaggcataaaacacacttcgaacatgggtaactcattcgactgtggagttcttttaattcttatgaaagatttcaaatcctctggaagccaaaatgggacacagtaaacagattcgaattttacttctgaacgaaatggagaaactggaaaagaccctcttcagacttgaacaagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactctgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaagggatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcagggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaataaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttagaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtcaaaaaacacaaaaccacaccaaaaacccaccgacacaccacaaaacaaaagcaccgcacaaagaaccaaaca

SEQ ID NO: 96110 - DNA, 6737 bp, Homo sapiens
  misc_feature (6737)..(6737): n is a, c, g, or t
ctgtctacggcagctattccagaggcaacaactgcttccctctgttctcatctccccattggtggctggcgacccgaatttgggaatggggagattgcccacctgttatctttgagcagactaatctcttgtaagcagaagtgccattcggagtctccagagccctgtggcttggggctgggaatgtccccctgacttcaggctttcctaagtgtattgcttttctctgagaatggtctaggtttttaattttttaattgtaagaatctgtaatacagcatttttatttcggtcttattcgttgtgctcaaaggcaggaaacaactattaatttgccttctcgaatcttaatagttataagattcattctctttcattgctctgctaggcataaaacacacttcgaacatgggtaactcattcgactgtggagttcttttaattcttatgaaagatttcaaatcctctggaagccaaaatgggacacagtaaacagattcgaattttacttctgaacgaaatggagaaactggaaaagaccctcttcagacttgaacaagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactctgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaagggatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcagggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaataaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttagaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttcctcctgtcaaataacctcctaacgtgcggaaagatgcgctggagacatagtacaagtagagttgtgttccactn

SEQ ID NO: 96111 - DNA, 773 bp, Homo sapiens
ctgtctacggcagctattccagaggcaacaactgcttccctctgttctcatctccccattggtggctggcgacccgaatttgggaatggggagattgcccacctgttatctttgagcagactaatctcttgtaagcagaagtgccattcggagtctccagagccctgtggcttggggctgggaatgtccccctgacttcaggctttcctaagtgtattgcttttctctgagaatggtctaggtttttaattttttaattgtaagaatctgtaatacagcatttttatttcggtcttattcgttgtgctcaaaggcaggaaacaactattaatttgccttctcgaatcttaatagttataagattcattctctttcattgctctgctaggcataaaacacacttcgaacatgggtaactcattcgactgtggagttcttttaattcttatgaaagatttcaaatcctctggaagccaaaatgggacacagtaaacagattcgaattttacttctgaacgaaatggagaaactggaaaagaccctcttcagacttgaacaagaaactgggtctcactatgttgcccaggttgatattgaactcctggactcaagcaaccctccctctttggcctctgaaagtactgggattacaagcataagccaccgggcatggccccacttctgagcattaatttatttattggtgagatgaaagtggtaatttctgttcttctacctttctaggttttgagactcaaaattaataatacatg

SEQ ID NO: 96112 - DNA, 384 bp, Homo sapiens
aaaaaattgcttggtccccttggcatgaaaactttagatccagagtaagttggaatataagtattaagaatgttatcatatttaatccaaatacattgacatcaaccataatttttttttttttgccagggcaacaaaaggagatgccatctctacaaaaataaaagttaaaaaaaaaattagttgggagagattgtgtacacctgtagtcctagctactcaggaggctaaggcaggagtatcacttgagcccaggagatcaaggctgtagtgagctatgatggcaccactgcactccagcctgcttgacagaatgagacactgtattaaaacacacacacacacacgcacacacacaccaaaactcacaattaaagctgactc

SEQ ID NO: 96113 - DNA, 498 bp, Homo sapiens
tgctgtcaccatttcccacacaaccctcaactacaaccataccccacacaggtaccaccaccaccgccaccactcccacttacaactacggtcatcttctgcacaatgttcaattacaaccacaccccacacagctaccaccaccaccaccaccactgacaactaccatcatcatctcccacacaaccctcaactacaaccacaccccacaaattttagggatcatattgtatgattgactacgttgcttaaatatgacaagatgtagtttaaaaacagcttattataaaacatccactgtagccaaaattatctgggtttccttttctttggatcttttctgtctgtcactgagaaaaatacaccagcaagacacaagaaactgtaatactactccgattaacagtaatattacctctgagacaaatatagaaagtgatgcagttgccgaagatgaaagtctgcagggttgggactgtacggcagcagcactgggat

SEQ ID NO: 96114 - DNA, 2843 bp, Homo sapiens
ggtaatgatgagggataggtagaaaagatgggaagggggtcagcttgtagataacctagactagcaggtgtatgacttctagtctctgaactggagccatctgagatcagtttgagatatggtgtcttataaatgtattgagagaggttgaggagttgtctatagaatggaatggagtgaggtcagagatcagtggcaaggaagaccacataaaggtttttgcacaaacttgccttgatggcaagtcctcaaaagtacaattatcaagctttctgtttaaacatgcataagtcagtaaatataaacattaaaatttgcccaagactcttaactcagttgtatttcataattaaagtgtacattaaaaagccaaactagtcatgaaagtattacatacagcaagggcagtttagataagttaatgttgctatgggaaccccagcagatctccttgtgtctccgtttaaaaatcatggcccaaggtggtttcaaaaacaacagaaggtaaaattattctcacattctcacacatgtaaattgtactgtctctctcagttctaaatagcggattcaagccagcctcttgactggcacagtaaaattcggcttcgtgtctttctataatgtattacagcatgtgagttaacctttagaagcttcaaaaatacatcaaccaaatttggactgtgagacacaaactggtctcttttgggctctgtccagcatagccttcctattccacatggctgcgcagcagggccatttccaccagtgtcttctgcttgcctggtcagtctttctgtctcttaacctacctacaacaacttccttctcggggtttgctgctagatagaaatgtagattttggcacagaaagaaaagggaaagacctatttggaattttgtctatagatgttaagaaatcatgaagcgttgcaaatgtaactgcttgggtattagtttaaaatatttgataactgcatgaaattctaatttacccctcacatccataaagctaggaccagttggttaggcagagtttgatatttaaaaattcatcttctgagagagctgaatttcaaaaggaccattttctttccaggagtaaaaggtatattctttcatcttcttacagtacagaaacaatggaatatattgtttaaatgcacccttcatttttttctccatttctaaaaattcacttttgagcatcgtccaaatgtaaaaattctcacacatgaggaactgtttccgaaggttgtgagaaagtcaagataacagtttctattattaaaagttttgcattcggtatgacacatttgcctgtattgaaacacccatttaacattgacttctgagaacttatttgctttgcctctctcgattccatatgctttgtctacaaattgtgaacacgtcccggtttctacccgtgtgtgattctaagtcgttgctgtactctagcttgtacgtgaaaattcacccatatgcagatagctgccctcttggaggcaaaacttaaagctatcagaaccatctggattgttaaaccccaaaacttccaactcatcaaagtcctgaagcctgaatagatcacacattgttacttctaattggttttgatgtttgttatgctcctcacaagtgcagataacttcacatttgcatcactaatcgacctctttcaaagcctctgctcctcctgcttcctgcctctgttagtcatcaggagacttagtgttggcgtgggtattttccccgcttgtgaaagtgcattgtcaattctagagcattaaatatatgtgaggtattgttattaatctacaaggcagtacacacagtattccagcaacagtgactttttcaaaggttttatgagacattgtaagaaagacagtatctttccatggaaaaaagtgttgcctcagagtcaaacaggaagcatgggtcctagttcctattgaactgcttagctactcttaatttagctctgaatgctagattttgtgtatactatacacattatttaatcctcaaactcctaggaattcattttgatgataaccatttacagaagagatgttgggtaacttgctcaggataccacatctagtaagtagcagagtcacaactcggacccagaactctctgattccaaaacctctacttgctgctcttgtaatggatgggcccaaatgctgctgggaaaggcaccagggaagaaagagctttctgagtcaagcagaaaacgatagcagtggagaggagtttgtttcagacgaccttcaaggttatggctcattctagatccaatcattctagcaaataagtaggttacacttgtccacaattacaaattggaaaagaagagaaggaaaggaactgagaggaatgacaaagcaaaaagctttcaatcagttcttttcagcattctgcttctgcctagttctgcacttgccccaccccctcaggcttcagccttccacttggcatccctcctcgcagagcactctcacttgcatactcctcgcttaaagaaaaaaagcattctgtactgcagtggggaaaaaaaacccttaaaatgtcttcaaaaggattcagctctagggtaatgtaaaatatgtgaaatcaggaggtgtccataataaaatatgagtgaaaacatcgttatttaaaacattgtatgtacattaatgccacattaataccaattcaggcatgaaatgttgagcatttcttggaatacggtttcttggaatatggttggggatttgagaggcgcaaaggtacccgcaagatggctttggtgtagttataaatataaatagaagtaaaataacagt

SEQ ID NO: 96115 - DNA, 371 bp, Homo sapiens
gtttgttgaaaagactatattttctccattgtattaggtctgtgatccattttgagttaatttttatgaagggcgtggtctgtgtctagattctttatatatatatataaatggatatccagtcttttcagtactatttggggagaatgtccattgacttactgattctttgttagagatcaatgtgctatatttgtgtgggtctatttctaggctctctattctgttccactgacctgtttgtctgttctttcaccaataccacactgtgttgaatactgtagctttatagtaagtcctgaaatcagatagtgtcagtctcccaacttcgttcttctccttcaatattgtgttggctcttctatgtcttt

SEQ ID NO: 96116 - DNA, 287 bp, Homo sapiens
actgcaacctctgccccttttgctcaagcagtcctctcacctcagcctcctaagtagctgagatcacagatgcttgccaccacacctggccatttttttcttttttgtatttgtggtagagatggggtttcactatgttgcccaagctggtcttgaactcctgagctcaggtgatccacttgccttagcctcccaaagtgctgggattacaggcttgagccaccgcatctcgctccgtgctgcttattgtatacggttttctgttttttaccacctgtaactccacc

SEQ ID NO: 96117 - DNA, 403 bp, Homo sapiens
tctagacaatgaggataagaatagtacttgtgtctcatagagttcttgtaaggattaaataatatgtaatgtttctagagcagggtatggtactcaactggcatgcaatgagtaccagctgctatttgtggctgttactactattacaacaaacaaataagatcttcaaatttctcttttagtcgtgtcctcagataacgtaactaagaaaatctattcatgatctctcctttctcccaaataaaaacaaaaagttaataaaaacaaactggctttaatatttcctatattttcaactactccacaactaaaggtcatttcaaaatttctctttaaacgttgccttttattaaagcataatgaataggatccatttttctgtcacagataactcagtgttttt

SEQ ID NO: 96118 - DNA, 781 bp, Homo sapiens
aacatttgaatgaacataataaatgaggagttggggctgggtaaaaggccagaagtagaagtacttatagtacaaggcttggcagcaattcacatagtttgtaggcaactgcctactacccaccatgaagctggcccttccagtgaggtagagaagtgttacaaacgccttcagtttctagactaattctaccgagatatccataactcatgttgaaaaatcacagtaggttgagttcagtgatgatctatacctcacctgacctagacaagtaaggaagaaacagaaggaagcagaataataaagtatttgaacccaaggatttgaccatctggttctttggggggagtcatgcctcctgtccttactttatatttaaggcattctgtcattacaaaaggcagtgatagagtaatgaaagaccattgcccaaggggaatgaaagagtgcagctaagtgaaaccagggcacacccacacacacacaacagtacacttctgcttctattctttttaactccttcagcttcttcgtgctcctagatgctgctgctttattaatttttgctaactgtgtatctcatacccagaatccctaagagagaggatttggttagttccaataatcacggtagtccctgctgagcaacctctcatactgggcctatagaacccaatgacaaggctccatgcagattccctctgatggctgtgctctttgtgtacttcccttccggtgtgtttttactcccaacagtcagcacctgcaactgtttgtcaga

SEQ ID NO: 96119 - DNA, 920 bp, Homo sapiens
cacaaggtaactcagcatccccaaaccactgacctgccacttgcaggcggaaggagagctgctggcccccagcctcacagctatactctccggtgtctgcctggcctgcctgctgcaccaccagcctccgtgtacagcctgcagcctccacatgcactttcaagctggagctcagcttcttcccgtccttgtaccaagtcacctctgtctgggcctgggccacctcacagctcagtgtggcgctagcccctgcttcagcctgcacctccctgtgtgctggctgctccttagcaaacaccgccttgggctctggggaaggcagggatgcacagggtggccaccaccatctaggtcaggaaggcagcactggggagagaaggcctggaaggggaagtgcgagggacagatgctctccaggctctgcaccaccgcctcccagtacaaggaacacagtttctccatccattctgcatgcaggatctgtcacatccccagggcaccctgcagaatggtggcatgttcctgtggtccctgctgcttgggaggctggtctcgaatgcctgagctcaagcaatccttctgcctcagcctctcaaagtgctgggattacaggtatgaggcaccgtgccaggcctgatgctaaactttatcaaacagctgttcagaatttatgatgttaaatttcatcaaacttttcttctgcatttattgagattttctctttcaatctgttaatgtcatgcatgacattttctgatgttttgaatattgaatatattgagtatagcatttctaaattatgccttttatcatagtgcattttccttttgacatactggtcataccactttgaaaatatattgttgaagcattggcctggatatccataatgactggcctgtaatttcaaatctttatac

SEQ ID NO: 96120 - DNA, 204 bp, Homo sapiens
cctttacgggacttgataagggaacacagagcaacctccaccacagagaattatgcagcccacagtgtcaatagtgccaaaacaaaagggacattgtgatcctaaccccagctccatttatgaagatgataaattccttaccagagaaatagagaaatctcttgatatggtttggctgtgtccccacccacatctcaccctgaa

SEQ ID NO: 96121 - DNA, 358 bp, Homo sapiens
agaagcagtgagggacatattttactctttagaattatataagtaatttcctcatgcatcaatagaaagaaattagctacaggcttcggaatgcttagagtgggaatgcgagataatcgtaagtaagctctacatagctggtattactttttttattccatcaaagaaactacatttttttttgctttttttcgagatggaatctctctctgtttccagcctgagaaacagagcaagacgccatccccgtcccccacaaaaaagaactacgactcaacaagcagacaacccagttagaaaatggacaaaagatttgaatagatatttttcaaaagaagataagcacatgaaaagatgc

SEQ ID NO: 96122 - DNA, 870 bp, Homo sapiens
aacggaatgttctggcatatttcaaaatggttacttttcttcccccttgccagaagcctgaggggatttttctcagatctttactgggagaacttggtagagctcctggagtgtggggaccctctatgattggctcccctacagtttttaggtcttagacttttctacactgaacttccagcaatttatcatttatagtcaaggtttcctactctggtactggtttccatggaggcttctgctcgtgggtttctgctctaataaggtgtgattctctgtatttatctgtctgtctctcctattttgagggcagcagtttacccatgatctcacttctttggtggatctaagaagagttgtcagtttttccatttgtttagctttttacttgttgttaggaataagtgataaactctaaacttctcacatgccataccagaaactggaagtctccctttcctttttgccccacatcttgacaagctgataagaaagcccaagtgctaccttggttgacaccagcaggaagtttcaaccatgcaagctcaggcctacatgagggagctcttgctctagccccaccttctaaaaccacaagccagtcagtcagccttcaggttctcaagtcattttgggacatgcttgggatcttgccttgctctccctggaaagccttattatatgtgtaataaaccttttggtatcctcttagtacctcttggtactttggcatttcaatatctgattcaaattttgggtgggggagtttattgtctctggagggtaaccacaacatcttgcaagtagaaaatccaaatgaattaagaaaaccattggaaggccaggtgtggtggcttatgcctgtaatcc

SEQ ID NO: 96123 - DNA, 458 bp, Homo sapiens
ctctcagcccgagtgggtagctgcttcttgcagttactaacttaagtgatactgcagatttgtttttttgacttttcagttatctagttaataaccataaacctagttaacagttctctgtattacattgtctctgttaaataattggtatagtttctgtcccctgactgatgtatctttataagcttaattctctattacgatacatttgtttatggttgtgatttgcacctctgggagggttaggttctaagatcagggtatcaaacaataaaacttgttggtcccccaatacactgcctccttaatgtaatcgaaattggctgttggccctgggatggagccagctaccctagctaagacactgttgggcagtgcagagcagaatttggcagctgaggagaaggcctctcatctggctgtggtcagtgtcagttcctcagggctctctgcaaaca

SEQ ID NO: 96124 - DNA, 470 bp, Homo sapiens
aaatcggaacaggttgaaataatccccttgtcacttaaaggtctttaactgggccactggatgggcttttagggttttataaaactcttatactttgtatacagaagtttatttctgttttctgtttctcagaacatttgctcattcataactttttttttttaataatataggttttttttttttttccttgtagagacgagggctcactgtgttgtccgggctagtttcagacttgagctcaagcaatccttccacctcacctcccagagtgctagggttacaggcgtgacactcatgcctgggcctcttattaataactttttaaaggatttttgttcgaaaaaatccttcagttaagtctcttagccaaaattagctaagaatagatctttagaaccactctggcgatatagtagccagccgccatatgtgacaatttaaatttaattaaaattaaatagtttctc

SEQ ID NO: 96125 - DNA, 483 bp, Homo sapiens
ttgcagacaaatggggggatcagaggcaccgccaaggtgttcttccttgttttgtgggtattttactaaatgaaacaatgaacgaattgcttgaatagacgtgaggttaccgtgactccatccagaaaccacttggtccagactttgaaggcaataaaacagcaggaaaagacaggccctgcctcccggtccctgacaggcgccgtcactcttgagcctgtggtagggagtgcattttcaagtcgcccgctgcctcccgagcctgcctgcagggtctgcaagcctccagccaagcaggagggatcagctctgcagcttccgacaccccagcccatgtcctctcagcccactgggcccaaggcgggtgtaaaatcctggctcaccaagcagagactctgggaagaggcccagtggcctcccagacagaccagaggtcctgctcactggtgtcctcctgtgcgtccttggcaagtggcttcccct

SEQ ID NO: 96126 - DNA, 1093 bp, Homo sapiens
attaggctagtacgaggctcggtgtgaatcggccgagggttccacactgtggaagctttgttcttttcgttttttgcaataaatcttgttgctgctcgctttttgggtccacattgctttcatgagctgtaccactcaccgtgaagatctgcagcttcacttcagagcctagcgagaccacgagctcactgagaggaacaaacaactccagacgcgctgtcttaagagctataacactcaccgcgaaggtgtgcagtttcactcctgagctagtgagactacgaagccactggaacgaagaaactccaaccacgtttgaacatcagaaggggcagactccagacgcttcatcttaagagctgtaacactcactgtgaaggtctgcagcttcactcctgagccagcgagaccacgaaccgatctgaacatcagaagggacagactccagacgcgccaccttaagagctgtaatactcactgcaagggtctgcagcttcattcttgaagtcagaccaagaacccagcaattcccaacacacagggaccagcttctttcctaactcacttaggctcttcgtgctgctctggcaactaacacccttggctgcaggggcttggacactacccttagtcactgacaattgtgtgaaggctgctgtcgttaacttcacttgatcaccttaggctcctgtgaagtggtgagcaattcaaacaaattcctgtcgtcaaatcatgagtccacctgtcccgagttggaagtctgaactcatgttcctggattcctcccatgcatcttggtgctggtgtggggcctgaactcagccaatccgcaacacctccaggagtcttcctcttagatgctgaggccacggagaaggaagcagccacaaagaatgaaccctggagagggtgccagaggcaggcgggttccagccatgtggcggcacagccttactgggatagtctagctgtgtcactcaggtacggttgctctctgagaagccgccaaacccaaccctttcacacacacctaggatgatttgaagagctacctaataacctttcataaggttctgaaagccagccagagtgg

SEQ ID NO: 96127 - DNA, 950 bp, Homo sapiens
cctagcgggcgaatacagggtcctttgtggaagtcatggggcagggtcccctgaggcaccttgaaagtaaaggagaaacagctctcagggactcagctgcaagtcattagtaactaagcggaacagctgtcttcagcaaagcttgacctggatcccagaactgaaacagcgggagaaacagaactctcaccttccttaacctggatcccagaatttaaacggactgcttccccaacagcaggcgatggagtccctgagatgcctgctaaaaatacagacccctgttcacaagggccaagaggtgggagcaacccaggtgtgtacggatggataaatggataagcaaaatgtggtctagccatgcaacggaatgtcctgcagccttgaacaggaaggaaatcttgacgcgcgccgcagcatgggggagccgcaatgaggacgttatgctaagccagtcacaagtgcatgattccactcagaggaaggacccagagtcgtcaaattcagagacacagagatggagaaattgcactgcagagaaatctttaaaagcaattacctaatactgcagattgctgaactgtacccacacccaagactgagcattggatcaatccagaatatacatcaggtgttctgcaatgtctgcctaaaaccatgactctgcctcctccagctgttgctacatctcactatgggtttcctgtgacattttgagcaagtatgcctctgtgactggggttcttacactccagaatggatgagaagcaccgtaagtggcttttaaaatgaatattccctggcccttcagtcgctctataggtcaagaatctgaattctcaacctgtctagaaggttctggttttaatggtctgtgggctgcacattgagaaacctgttcagcgagtgcaacaaaggttccacatgtgagaaaggaagcatcaggtctc

SEQ ID NO: 96128 - DNA, 926 bp, Homo sapiens
agcattgacaactcgcggggattgttttccacactgtggaagctttgttcttttcgttttttgcaataaatcttgttgctgctcgctttttgggtccacattgctttcatgagctgtaccactcaccgtgaagatctgcagcttcacttcagagcctagcgagaccacgagctcactgagaggaacaaacaactccagacgcgctgtcttaagagctataacactcaccgcgaaggtgtgcagtttcactcctgagctagtgagactacgaagccactggaacgaagaaactccaaccacgtttgaacatcagaaggggcagactccagacgcttcatcttaagagctgtaacactcactgtgaaggtctgcagcttcactcctgagccagcgagaccacgaaccgatctgaacatcagaagggacagactccagacgcgccaccttaagagctgtaatactcactgcaagggtctgcagcttcattcttgaagtcagaccaagaacccagcaattcccaacacacagggaccagcttctttcctaactcacttaggctcttcgtgctgctctggcaactaacacccttggctgcaggggcttggacactacccttagtcactgacaattgtgtgaaggctgctgtcgttaacttcacttgatcaccttaggctcctgtgaagtggtgagcaattcaaacaaattcctgtcgtcaaatcatgctggagtgcaatggcgtgattatggctcactgcagccttgacctcctggacccaggtgatcctcccactttagcctttcaagtagctgggactacaggtgtgtgccacaatacccggctaattttttaaaaattttaataaagacagggtcttgctatgttgttcatgctggtctagaaccctgggcctcaagaagtcctcctg

SEQ ID NO: 96129 - DNA, 1167 bp, Homo sapiens
attaggctagtacgaggctcggtgtgaatcggccgagggttccacactgtggaagctttgttcttttcgttttttgcaataaatcttgttgctgctcgctttttgggtccacattgctttcatgagctgtaccactcaccgtgaagatctgcagcttcacttcagagcctagcgagaccacgagctcactgagaggaacaaacaactccagacgcgctgtcttaagagctataacactcaccgcgaaggtgtgcagtttcactcctgagctagtgagactacgaagccactggaacgaagaaactccaaccacgtttgaacatcagaaggggcagactccagacgcttcatcttaagagctgtaacactcactgtgaaggtctgcagcttcactcctgagccagcgagaccacgaaccgatctgaacatcagaagggacagactccagacgcgccaccttaagagctgtaatactcactgcaagggtctgcagcttcattcttgaagtcagaccaagaacccagcaattcccaacacacagggaccagcttctttcctaactcacttaggctcttcgtgctgctctggcaactaacacccttggctgcaggggcttggacactacccttagtcactgacaattgtgtgaaggctgctgtcgttaacttcacttgatcaccttaggctcctgtgaagtggtgagcaattcaaacaaattcctgtcgtcaaatcatatggagaaattgcactgcagagaaatctttaaaagcaattacctaatactgcagattgctgaactgtacccacacccaagactgagcattggatcaatccagaatatacatcaggtgttctgcaatgtctgcctaaaaccatgactctgcctcctccagctgttgctacatctcactatgggtttcctgtgacattttgagcaagtatgcctctgtgactggggttcttacactccagaatggatgagaagcaccgtaagtggcttttaaaatgaatattccctggcccttcagtcgctctataggtcaagaatctgaattctcaacctgtctagaaggttctggttttaatggtctgtgggctgcacattgagaaacctgttcagcgagtgcaacaaaggttccacatgtgagaaaggaagcatcaggtctc

SEQ ID NO: 96130 - DNA, 1255 bp, Homo sapiens
attaggctagtacgaggctcggtgtgaatcggccgagggttccacactgtggaagctttgttcttttcgttttttgcaataaatcttgttgctgctcgctttttgggtccacattgctttcatgagctgtaccactcaccgtgaagatctgcagcttcacttcagagcctagcgagaccacgagctcactgagaggaacaaacaactccagacgcgctgtcttaagagctataacactcaccgcgaaggtgtgcagtttcactcctgagctagtgagactacgaagccactggaacgaagaaactccaaccacgtttgaacatcagaaggggcagactccagacgcttcatcttaagagctgtaacactcactgtgaaggtctgcagcttcactcctgagccagcgagaccacgaaccgatctgaacatcagaagggacagactccagacgcgccaccttaagagctgtaatactcactgcaagggtctgcagcttcattcttgaagtcagaccaagaacccagcaattcccaacacacagggaccagcttctttcctaactcacttaggctcttcgtgctgctctggcaactaacacccttggctgcaggggcttggacactacccttagtcactgacaattgtgtgaaggctgctgtcgttaacttcacttgatcaccttaggctcctgtgaagtggtgagcaattcaaacaaattcctgtcgtcaaatcatcattaagaagaaaagaaagagcacttggaggtctgcttggagatccctgaggtttttcacaggcacaatgtccttatttgggagcctcaaaataccagactaacattgctcaaagcagctttgggaagagggcaggtgtctgagatgctgagaggccaactgagcagttttttagctggagccatgggccacaccaggaacaaaccactggaccaaattgactcaggacacctgctctggacccagtttcttctcatgtctcctcacccctaactctgcccaccacctcccacttcctctctgttccccatcccatcccaggtttgtatttaaatttctgcataatgcatgttctctgcatgttctgaagtactttccatcaagtccttcattttaaaagtgtttcttttaaatgaagctgtgcataacctctttttgaggctctctttggcttttcttgcacaattttaaattgaccaggtctacttgcaaaaataaagacactttttctgctctttgtt

SEQ ID NO: 96131 - DNA, 432 bp, Homo sapiens
tccaatgacagtttagttttcagaggccctgcaatgttatcccaatctgctttgtttttatggtatcgttgaggctcctcttcagtcgctgctggtgatatctgtgggggtgaaaggcacttccctgtgttactgggtgtcgctgagccacctcctataggggggtcagggagagagaagcttctgggtacagagacagcagggagacaaggggtttcattgctgctgctgctgctgctgggagcagatcgagctgcccaccagtgtcctggttgtggagcacaagttgagtaggcctggggtttgctgctgctgcaggtagagtagccagctcactatgtcctgtttatgaagcaggtctcaggctccccatgtggtctctgttgggctttgtctccccagtccattggccagggagagcagactgttctt

SEQ ID NO: 96132 - DNA, 211 bp, Homo sapiens
gagtcggcccatcttccctctctcacgacatacctttccttcagacttatccattttcaaattatacaattatttgattaccatctgtctcccccactagactggaagtataggactaaaagagaaaaatagaggtcaggactctgggattcactccataaaggaataatagctgaaggtttgggagtgaggagagctcagaaaaaccaca

SEQ ID NO: 96133 - DNA, 138 bp, Homo sapiens
aagagtcttgtgggccccagtgagtggtgggaatttcaacccaagtgcaatgggaagtgctgaagtgttttgagaagggtactggccgagtatagtagctcacacctgtaattccaacactttgggaggatgagacag

SEQ ID NO: 96134 - DNA, 383 bp, Homo sapiens
aaaaatcaaacacatatgaaacatggtctctctttctttggctacaaagcgtagtcagttattgccccctgctcactctcaaagtatgaaatagctagataatatttgtatctaatactctctgtaggtttacttataagcctacctctttcctgctttaaaatcttggggcttttttatgtgtaaaagggttttgtttttagcaatgccctgtggcattgcgcaggtggagaaatcttttaccagccgtgggctgtttgagttggggtaacatatcaaagtttgcgttggcatgataagggatcattttattactatgagaccagttaacttttttttctcctgaagatttttggtttgatatcttaaataagaggacttca

SEQ ID NO: 96135 - DNA, 297 bp, Homo sapiens
agcgacggttccgtccacgccggctctagggagggggcggtgttccgtggccgcctccctggcggcgctggggaaatgagcaggtaggaggccgacagcgacctccgcgtctcggagcgaaccgtgagcctccccgtaacgagagagtttgactgtcagccaaggtcaccgggcccggcgcagggaaggggtggggctcggctgagcccgcgagacccgccctgctcgccgcagcccccgccccgctagggccacagggtcccggtatggcgatggctttgacggacccggcgcagg

SEQ ID NO: 96136 - DNA, 206 bp, Homo sapiens
ctgaaggacaagagcccaggaaaaaagatgccatgggccccagaggcagagagagacccagagacatttccaccaaaggcaggaaccctgtatggatcgtgattcagatacaccaaggcaaagacagacaacagggacgcagacacaggctgcaggccatgtgagcagtcacagctgcatctcagacatggcgctattctcaccaa

SEQ ID NO: 96137 - DNA, 652 bp, Homo sapiens
acctggctaatttttgtatgtttagtagagatggggttttgccatattggccaggctggtctcgaattcctgacctcaagtaatctgcccaccttggcctccccaggtgttgggattacaggcatgagacactgcacctggcccattataagcatttttgaaaacatcatcccaaacaaaaactgaaactttgacaataacatacatctaactatgtggttccccctttcccaccccttttgtttctcaccatctgaggtgagcatttgaaacccatttttatcattcccttgctttcctttttatgcagttttatgcatctgcatgtatttttcaaactaaaaaaggttttgtgttgcatgtaatcttttggagtttattcaattcttgtttcaattttggtggactgttgatttcaggaattttttcaaaggtcctgtgattttcttttattcatccttgcagaggggatttatgcttgcctagggttgacatacaatcaaatgattgatttgggatctgtatgaaattttatagcagttcctggtcagaatcaaaggcagaacagaaggctataggctgccattgtggggacccagcaggctgtgtggactgagtggggcgctgtctccagttaaacattttctctcca

SEQ ID NO: 96138 - DNA, 327 bp, Homo sapiens
ttcgggatgaaactgctccacctcagatcacgaggcattagtcagattctcataaggagcacgcaatctagatccctcacatgcacagttcacaatagggtttgagctcctatgagaatctaatgctgccgctgatctgacagggggcggggctcagccagtaatgctcacttgcaccactcacctactgctgcgccgccccgttcctaacaggctgcagaccacagcccgggggtcggggatccctgcactaaaaaataatgtatgagattcgtggatttgtttaaagcacacaaaagcagcaactggaagagaacagctgccagt

SEQ ID NO: 96139 - DNA, 1086 bp, Homo sapiens
cctcaccttgtctcccaggctgaagtgcagtggatgatcagggttcactgcagtccctacctcctgggctcaagtgatcatcccacctcagccccatgaatagctgggactataggtgtttgccaccatggccagctaattttttgtatttttggtggagatggggtttcaccatgttgccttggcaggtcttgaactggactcaagcgagcagcccacctcagccttccaaagtgctgggatcacaagcgtgagccaccatgtccagccaaggatatattttagtagtaatgaacttatggtgacagaatatgtgggataacgtcacctactgtcacaagctggcttctctggaaacagttactgagactgactttggggttcaagatatttgttacagatcaagtcttgtgaagggaagggggagaaaccagtgttaggcagaggaagaagttgcatacgttataggcccaactaaacctcagtcaggccgtgtgtggtggcttatgcctgtaatgccagcactttgggaggccaaggtgggaggattgcttgagcacaggagtttgaggctgaagtgagctatgatcgcaccactgcaatcaatcaatcaataaacttcagtcaaccctgccaggagctatggaacaattattgtttgttggagtgttctgtgttgggctaaatgtgaagcctctttatacttctaccttactcagtcaccatatgggggctgccccagagaggtcatgacctcaagtgaggaagtactcagcagctgagccaggccctactgatagctggaggatgctgctgcccatgctgcccactgtgaggcagcaagcccttgcttgaagggggatctggatagtatgtttctgtgtctaccacccctagaaatggtgcctagagtgagtcatcacaaaaagaatcaggatagcttggtgtggtggcaggtgcctataatcccagctactcaggagactgtggcaggagaatgacttgaaccagggagttggaggttgcagtgaggtgaggtcacacaactgcactccagactgggtgacagagtgagactccatctca

SEQ ID NO: 96140 - DNA, 659 bp, Homo sapiens
cctcaccttgtctcccaggctgaagtgcagtggatgatcagggttcactgcagtccctacctcctgggctcaagtgatcatcccacctcagccccatgaatagctgggactataggtgtttgccaccatggccagctaattttttgtatttttggtggagatggggtttcaccatgttgccttggcaggtcttgaactggactcaagcgagcagcccacctcagccttccaaagtgctgggatcacaagcgtgagccaccatgtccagccaaggatatattttagtagtaatgaacttatggtgacagaatatgtgggataacgtcacctactgtcacaagctggcttctctggaaacagttactgagatgaagtattaaaaggcattttaaatagatccaaaagattcatttttaccttaattgcagtgattatgggattaattgcagtcacagctacggctgctgtggcaggagttgcattgcactcttctgttcagtcggtaaactttgttaatgattggcaaaagaattctacaagattgtggaattcacaatctagtattgatcaaaaattggcaaatcaaattaatgatcttagacaaactgtcatttggatgggagacagactcatgagcttagaacattgtttccagttac

SEQ ID NO: 96141 - DNA, 265 bp, Homo sapiens
aacatacccctcttagtaggaattaaataaatttttggagaatttcaagataagtccattgaacaaaataaaaaataacagcctggtctagtgacactgtgcccttttgaagtgacagcactgacattttctagcattaatgctatgtttattcaggtcttgggttatcatttcattgatcattattcagttccatgaatgatcactgtgctcttgaaagaaattacgtcttgcttattgcctcttaaatagaaatgaaaaaaaa

SEQ ID NO: 96142 - DNA, 173 bp, Homo sapiens
aagattgtgccactgcactccagcctgggccatagagcaagaccccgtctaaacaaacaaacagacaaacaaacacagaggtgaagtgacttgtccgggaaggctggcggccgagctggtcagcacttggagagtctggctgcccctctgggctccccaccctgaactcagtt

SEQ ID NO: 96143 - DNA, 447 bp, Homo sapiens
  misc_feature (299)..(299): n is a, c, g, or t
ccgcaatcccagcagtttgggaggtgaggcaggaggatcacttgaggagtttgagacttgcctgggcaacatagcaagcccatctctattaaaaaaaaatgaaattttaagaaacattgagtagacagtatgagtgaaagctgaaagaacatacaaaaaaaacagccatccaggccatgacgagaaggagcctaactcttaacactctgtctagacctcaattctctcttatttgtatttatttatttatttatttttattttattttttgagatggagtctcagcctgggcaacagangtgagctccgtctcaaaaaaaaaaaaaaaagcaaaggctgaatgaggccaagtgtggtggctcactcccgcaatcccagcagtttgggaggtgaggcaggaggatcacttgaggagtttgagacttgcctgggcaacatagcaagccc

SEQ ID NO: 96144 - DNA, 688 bp, Homo sapiens
gttttgtgaaagaagttggggatctatttatgtgaaacttccctatttttaaatgttagcagctaattttgaaaatcttaaatacttgtgtgagtccaagagaaacatctgcaaatagcatgcttcccactcgtgagtcactatttgaaacctctgatttcaactatagctttctgctcatttctggcctcggtgcatttgggtgataatagtaccaaggccttctgaaaataacatgatttctggtcatttttagagatgcagagttttttgttgtttctgctttattatgaggctggactggagggaaattctcatttattaaatgcctgctgtatcccaggtactttaaacacattatcttgcttattcttacaacttcctaaggcaggcattgtcgtttaccaacaggctaactctggctcagagaggttgcctcaagttccaccgctggctggttgacaaagtctttatgggatcccatgtaggtttgactgcagagcttagaaaaagagcaggtacagaatgggctggaagagtactaatagctttcttcccttacccgttcaaccatcgtaaggaggcagttccttttcatatcatgagctggttggcaaaaaagcgttactctattctgggtactctggatatagttacctagaaataaggcaagtgaaggtttaaaata

SEQ ID NO: 96145 - DNA, 859 bp, Homo sapiens
agcggagcgttggcctttttcccacagctccaccaggcagtaccctgttgaggactctgtgtgggggctccagcctcacactttccttctgtactgccctagtagtagaagttctctatgagggttccaccactgtggcaggtttctgcctgggcaccagggctttctcatacatcctctgaaatctagggggaagctgccaagccccacttctctcctgcattctgcatgccagaattaacaccatgtggaagccaccgaggcttacagtggctttgactctccaaagcagtggcctaagtagtatctggggccctttcagctgtggcaggggctagagcagccagataaagggagcagtatcccaaggctgtacaaggcagcaagagccctgggcctggatcctgaaattattctctcctccgaggcctctggggctgtgatgagagcggctgacttgaagatttctcaaacgccttcaaggccttttcctcattgtcttggctattaacacctggctcccttccaatcctgctaatctctctagcaagtagttgctccataggctgcttggattccttccctaccacaggcccaggctacaaattttccaaatgtttatactctgcctcccttttaggttcaactttaagtctttattttgctcccacatctgatggtaggttgtagatgcgggcatgtcacttcttgaatgctttgctgcttagaagcttcctcaaccacataccctaagtcatcactcctaagttcaaacttccacagatccctagggcacaaacacaaggcagctaagttctctgctaaggtatacatgggcgatcttcactccccttcccaa

SEQ ID NO: 96146 - DNA, 260 bp, Homo sapiens
agagggttacatttcagatcctccctttccagaattcagtgtttttcccttataccactaaacttcctagatttttgtcaagaggtgggaggaagttaaaagataaataagcttgtgaattttaaaacttgaaaatttatatacagcaaaatagttagacctaaaatatacagtttgaagtgttttgacaagtaaatatactcatgtaaccaacacccctttatcaccctggaaagtttctttcagccccttttacttct

SEQ ID NO: 96147 - DNA, 475 bp, Homo sapiens
atacaagtgtcatatcccccagcccatgcaagaagcaaaatgggaagagactaggaggtagcctgggcaagagctgacagctgagaatcctgaggtcagagagaccttaggatgtcaaggagctgaccctgcaagtctccggacaggcagctgggccttgtaggagagatctgacaggaaaaggaggttcacatgcaatagggttataagctaggggacacaggaccctagggacattctcaccagctaaccattcccacaggttgcagaatttcctggtcagaggtggaaatggtatatagggcaaacaagtttgctgaggtcttgggagagggtgagtggtggacataccaggtgagggaaacgagaaataaaaagaactgcagggatgggaaggtgctgacatccgagagtttgctattatgtgttcagagactaagctactaaattaaggttaaagaaggtggccaaggca

SEQ ID NO: 96148 - DNA, 328 bp, Homo sapiens
  misc_feature (266)..(266): n is a, c, g, or t
tgttcaactcttaccatagtagtaaaaggctaaacaaattagtgtggctatgctctagtaaagcttgattttggaaataagacagcagactagatttgacttgttgataataatttgctgatctttgctatagattatcctgtatagtaaattagttcttcaacgctaagtttattttgaaaagattatttttttcagatcttctttaaaaatattcctttattattctaaaataacgtttgggctgggattacaggcgtgacacncgtgcccggccctaaaatgaaattattaatgttggttctgaaacaacctcttagcattcaga

SEQ ID NO: 96149 - DNA, 1471 bp, Homo sapiens
tgagaagaatgttaacttccattatgtgagagcagatgaaaccaaagccttgggcccacacagcaaacctttgggtagcaacgagttctagaaaaatggagcctaaggagtccagattgtttttccttgaaataccaagcaagtctaaaatgattactacccatgagatatatttttaatgatgttaggtttgggggtgtgttagattgttttgcattgctataaatgaatacctgaggctgagtaatttgtaaagaaaagaggtttatttggctcacatttctgcctggcagtggctatagttggcttctagtgaggcttcaggaagcttttactcatggtagaaggcaaggggggggcaggcatgtcacatagcaagaggaggagtgagagagagaaggaggtgccaggctcctttaaattgtaaactaacagcaagaactcactcattcccatgaggaagggaccaggccattcatgagggatcctccctcatgacccaaacaccccgactaggccctacctccaattctgaggatcacattccaacataagattcagagagtgaaaacattcaaagtctaccaggaggtgattaaagtgatatgacaatgtgaggtatatgttacctggaaggtagtaggagcagatggtgggaagaagaaaagtgtagcaactacccagtcctctgcatgaaagagccctccctcaagagcttggaagcaacacaaaatggggagtagaccaggtctactatcagcacagagataagagactctgaacagagaagacggatccaagggggacagcctggagtcgggggacccagctggaggccagcacagttgcctgggcgagaggtgagccctccctcctggagaggtgagcccttcagaggaagagatgagaaacggaaacccctgactcattaccatcggccttggcttgctgttccattggcagccctttctacctgtgatcaacacatgcctatctagcagcatactaactctgtctctcattctagagcacgcatccgcccagagttaataagttttagaatgtcggcgtcctgtcattgcatcatccacagattcagtgaccagagaggaagaaacacagggaagctttatattaataaaggtcttgcgttgaatattcctaagcaactgtcaaaagtaagcagttcgtatgcttcttttctggtgacaataatagactgggccccatcccttcccagagctcccgataagcaactggatccagtctccactccagaacctgaatggactttttgctcaatacagctactgctggccagtcagcttcatgggacatgtgccaagaggtcttccattccatcttgagtaaacaaattagagtcctagcaaaaactcttcccatgagccctttaactgacctaaattcaacatatgtcataatctaggaggaagcaccaaaatggaaaact

SEQ ID NO: 96150 - DNA, 938 bp, Homo sapiens
tgagaagaatgttaacttccattatgtgagagcagatgaaaccaaagccttgggcccacacagcaaacctttgggtagcaacgagttctagaaaaatggagcctaaggagtccagattgtttttccttgaaataccaaagcaactacccagtcctctgcatgaaagagccctccctcaagagcttggaagcaacacaaaatggggagtagaccaggtctactatcagcacagagataagagactctgaacagagaagacggatccaagggggacagcctggagtcgggggacccagctggaggccagcacagttgcctgggcgagaggtgagccctccctcctggagaggtgagcccttcagaggaagagatgagaaacggaaacccctgactcattaccatcggccttggcttgctgttccattggcagccctttctacctgtgatcaacacatgcctatctagcagcatactaactctgtctctcattctagagcacgcatccgcccagagttaataagttttagaatgtcggcgtcctgtcattgcatcatccacagattcagtgaccagagaggaagaaacacagggaagctttatattaataaaggtcttgcgttgaatattcctaagcaactgtcaaaagtaagcagttcgtatgcttcttttctggtgacaataatagactgggccccatcccttcccagagctcccgataagcaactggatccagtctccactccagaacctgaatggactttttgctcaatacagctactgctggccagtcagcttcatgggacatgtgccaagaggtcttccattccatcttgagtaaacaaattagagtcctagcaaaaactcttcccatgagccctttaactgacctaaattcaacatatgtcataatctaggaggaagcaccaaaatggaaaact

SEQ ID NO: 96151 - DNA, 545 bp, Homo sapiens
gtgggactctccagtggctgcaggtgttggacagctggatggaaggatcacagcagcctcatgcatgcacagtggcagtggcctccgctgtctcctccatgagtccactctttctccagtgggccatatggatcacggcgtggtgacctcagtgttccgaggggtgcagggcaggatctgctgtgctcctaaaggtctaggctccagaactcacacgaccacactcctactgtattctattaatcaaagcaaaccacgggaccagcccagattcaaagaggtagacaggccgcaccatgtgatgtcagggacagcaatgtcacactgcaagggtgtagggccgggaagcaccattcactgggagtcagaattgtaaccatctcccatggtggcccaaattaagattctactctaagtaggaaaaggagagtggatactgaagggattcatttattctgaagtgagaaatccccaaaaataaaagcaagcagacgttcctggacttggccacttatcaccagatttatggtcctgtttattagtca

SEQ ID NO: 96152 - DNA, 340 bp, Homo sapiens
tgatactcaaatgaaagtctccggccttgatgaaggactgatgtatgagtatcgtgtatatgctgaaaatattgctggaattggtaaatgcagtaaatcttgtgaaccagtccctgcaagagatccttgtgaccctcctggacaacctgaagtcacaaatatcacaagaaaatcagtgtcacttaaatggtctaaaccacattatgatggtggagctaagatcacaggatacattgttgaacgcagagaactaccagatggccggtggctgaagtgcaattatactaatatacaagaaacatactttgaagtaactgaacttactgaagatcagcgttat

SEQ ID NO: 96153 - DNA, 452 bp, Homo sapiens
agcaaaccttttagaataaaaagcaatttacaaagtactcttatggaggcttgtgtagtattaaacacacactgtaaataggttaaaatgtggcactgtgttctttaaaaggctgacatttgtcttttgaatgttcataatcttgatttacaaactgatagatggggcaaaactatttttttttttgcataatatgggtacaagtcattcaagaaggatcaaagttataaatactgtggattttgttctcaggaaatttggaagattttgattaaaatttaaaacatcaataatttgcattgtagaaatggttttaaaactataaatggcatttaagagctttaaactagcacaaggactcatgaaaaatctgtatttggcattattttcctgttctgtttgtatagacttaattattcactggataatgatacaaaagggaacaaggctga

SEQ ID NO: 96154 - DNA, 584 bp, Homo sapiens
gccaaagcagccaacaaagccacagccctatcggctgtactgggctctgccttttgggcagctcgccggccactccccaaaagcagagcattccatcctttctctttttaaacccacgtcatcatctgatcataatggaaatcaatctcctcaaaccaccatgcaaaggcgtatccatggcaacctcaaaaggaaggacacagagatgatgcttcagtggctgcagcaggaaaagctcttcgcctctcggtaccttaagtatacctgagtagccagtggtcaacatgggtttgctgctctcctcactgcaataaatgacggaaacctgtagctcagtatggattcaggggcgcctcagacgctcgcaggaacggaggggagacccttgcagttctggaggaactctaaggcgcagtcactctgatcccaggagaacaatgctaggctgaagagctgagccctgactgaaaactgcgcaccgaccgcagccgggattacatcaatcaggcacaaagctggacacctgggacaggataagcgcacgcgcactgtgcctgggaagccgattaggaccataagaaatc

SEQ ID NO: 96155 - DNA, 499 bp, Homo sapiens
gccaaagcagccaacaaagccacagccctatcggctgtactgggctctgccttttgggcagctcgccggccactccccaaaagcagagcattccatcctttctctttttaaacccacgtcatcatctgatcataatggaaatcaatctcctcaaaccaccatgcaaaggcgtatccatggcaacctcaaaaggaaggacacagagatgatgcttcagtggctgcagcaggaaaagctcttcgcctctcggtaccttaagtatacctgagtagccagtggtcaacatgggtttgctgctctcctcactgcaataaatgacggaaacctgtagctcagtatggattcaggggcgcctcagacgctcgcaggaacggaggggagacccttgcagttctggaggaactctaaggcgcagtcactctgatcccaggagaacaatgctaggctgaagagctgaggtgggtcagaccggcctcggggcaaacgctcaggcggagcc

SEQ ID NO: 96156 - DNA, 180 bp, Homo sapiens
tgattcttttaaaccaagcggaagcctgcttcgatgacttggacttatgtctgcaccagggtctcattcctgtgtcttcaagcttttccatggagtggcaaaatgattcaaatccagaaaggaagggagtgaagttattaggagctaactaaagttaaaaaaaaaaaaaaaaaaaaaaaa

SEQ ID NO: 96157 - DNA, 680 bp, Homo sapiens
aaccagaaataatgtatggagggactatacaagggcatatatactagtaaaagtgttttctcaatagatcaccaaagaatttgccacacctgatatatagaaaagtttattgtgcagcacctctaccttcgctctcctgctcctgctctggccacataaaacgtgctggctcctcctttgccttctgctatcattggaagcttcctgatgcctcccaagaagcaaatgccatcatggttcctgtacagcctgcagaaccccccgaggtactgaagagtgagccgtatggggagaaggctgatgtctgggcagtaggctgcatcctttatcagatggcgactttgagtccccccttctacagcactaacatgctgtccttggctacaaaaatagtggaggcggtatatgaaccagtcccagaaggtatctactctgaaaaagtaacagacaccatcagcaggtgcctcactcctgatgcggaagctcgtccagatattgtagaagtcagttcgatgatatcagatgtcatgatgaaatatttagacaacttatctacatcccagttgtccttggaaaagaagctagaacgggaacgaagacgcacacaaaggtattttatggaagccaaccggaacaccgtcacatgtcaccatgagctggctgttctatctcacgtaagt

SEQ ID NO: 96158 - DNA, 622 bp, Homo sapiens
tgacaatggggcagagattagagcatgtgatgcctttacaatacaactaggaatgccaggcgccaccagaaggaggaaggcatggatgaggctggtcctcagggcctcagaaggaaacagcccctgatttcggacctctggcctctggaactgtgaaaatacgtttgtgttgttttaagtcccctcgtttgtgctaattggttacaacagccactcaagagactaaggtgtgagggtcccaggaacttcagcagggtaaggggccgagggtccatctggctcacagagctacagcccaccccttttctaggcccagagaggttgggcgatttgtccagggccacacaggtgcctatgaaagagcctgcaccaggatccagaacttggcggcccccatcccagctcctgtctccctgaatctttccctgcccggggggaggtctggggtggaggcatctgcacaggccacttgccctctcactttcccaagggttgaatggggacaaggagacccctccctctgggtggggcaaggcagtggatgaggttccacgagtccctggctcaggcgtggcccacaggctctgggtcagcagaagagactgtcttcccatctgtctgg

SEQ ID NO: 96159 - DNA, 873 bp, Homo sapiens
gataaaatacctgggtcctaggtgctcaaaattggcatctcagggagctgaagaaatgtaactggtgtatactgaaggaacttgaagataggaccatgtgaacagtgtcaataaactttaaataataacagaatttgtcttttttttcctaaaatgggaaaaaatgtatagatatcagaaatccatgctattttgtctaccaacccaatcataatttcaaaaatgatttgtcatatcatttgtgacaaagtgaaaaataaagcatggttttcataaagataaggactctaacctattttagaaagggcctatcaaactggcagaataaaataatgtggatatagtgatgacccatccctagtttcacccaatagctttaaaagacttaggggacaagcacctcaaacacagtaaacactcaacaattttatttcagcaagttatatgtaatattttaatgaccaccatctggagaaaaatatccagttacacagatattcacctaaaacatgagtgttattaatgcagaagaaatttatagcaaggctaataaaacagaatgatctttaaaatcatctctaccaccaccagcactaaaaaagggaatgtaactagatacatagataaagggtagggacactattgtcaggaatccatatggagctttaggattttagctggctacattcaaacaatcttaatatatactacacgatgagaaagaacccaagaggtacattcatccataataaaagaaataaaggctaacggtagaactgatatttaacagtggataatcttcagttaactgaagacattaagagcaaatcaacgtatctgatacagcatccagggtgtaagaaaattgtctat

SEQ ID NO: 96160 - DNA, 470 bp, Homo sapiens
caggataatctcttcatcgaactacttaatcacatctgcaacatccccttttgttttgtaaggtgacatactcagattccggggatcaggacaggagatttttgaaaagaaccaagaaggattatttcatctaccacacatcccttttcctggtttcttttttatcctcttttttgctttcctaatctatcaagatgcttgtggctgcaaagtagcagaggccttagttaaacaatgctgtaatcaacagaaagacagaaggcttacacaactggatacccagaggagagtgagcccgtgactcagcatcgccatcatggaccctggttctttccatccctcccatctgctacccatagcattagcttcatcccgaggctggttccttgagtggccaagggatgaggctggaagtgtccttattcacacccactgagggagatagttgagtacttatcactttccatttg

SEQ ID NO: 96161 - DNA, 609 bp, Homo sapiens
gccacagagatgggtgaggtggggtgcccacccatgtggggcttgtggtcaaggagcagagatggtggtaagcagaatcgcagtgtggtatagcaaatggagagcctgccagtgtcactgcgaggtggggacggtggttgctgctgtggagctcctctcccaggcctcccatcctttccctcagctgactcggctgttccctatggtggccgctgaaggcagatcatgtcttcatgtgcctcaatgccagcctgagcattgacctggaaaaggtgcttgacagacatttattctgggctccataaaggaccagtgttgccatggtaggtggaggagaggaggaagcccagagtgtgacttgccccacacacccctggatatcacagtcctgcccctgcccattttggaaagaaccacatggagagggctcacttccatggacctgaaatcgtgagtttgactttgtcatcagctgcagagcaaggagggaggcagtttacatctggatgcctgcattcaccttgcccagagatgctgactgctgaggatgcacctcagggctttacagatgctccccttcttgccatgttcagtctcctccctgagatc

SEQ ID NO: 96162 - DNA, 965 bp, Homo sapiens
gaggaaaaacagcacatagaggcatccacagtatttaatttgtttggataacagttacagataaacaggtacaccccatatacaattaccaatactttttatacagttcatatttcagtacatcaacactattttatttacactctatttatatacattaacatctttttaaattgggattattgtccatatgctttatattttttattccagtgatttcccttttaggaatttatctgaggggagaatactctgtaattactccataatttgcaggcaaatatcatcatagcattttttaggagagtaaaaagttattaacaacttatatttgtctcacattagaggaatggttaaataaagcatggtgtattcattggataaactataatgcagttgttgaaaatgattaccagggagtttttgctaaccatttatgggaacatgcttatgatatgtgaacatttttttaaaaacaagacataaagttgcatatactggaaataataccttcaatattgaaaaaaatactatttaggaaaaaggacagaagaaaatctgccaaaattttgacagtggttgcctttgtattaagaatataaaaggattccatgcctttttacatttttctctgctttccaaattttccacatgaatattatacatagtaatcagaaaaaaatacagggacactcactcttatcctttacatttctctcctgtttggacctcagattcctcagtagaaaattaaactagatgccagcctgggcaatatgatgtcaccctgtctttacaaaaaatgcacaaattagccaggtgtggtgttgtgcacctatagtcccagctgcttgggaggctgaggttggaggattgcttgagcccaagagatcaaggcggcagtgagctgtgatctcgccactgcactccagcctgggtaacaaagcaagaccctgtctcaaaac

SEQ ID NO: 96163 - DNA, 467 bp, Homo sapiens
atttttgtatttttagtagagacggggtttcaccgtattggccacgctggtctagaactcgtgaccttgtgatctgccctactcggcctcccattgtgctgggattacaggcgtgagccaacatgcctggccctgagcatctttttcttatcagtttgctttaacggtttgacagtctgacttggcttatgactctgggcaaatcatttaatcctttgggccccattttgggctcattttactcatttaaaaattgagatgcttagagatagataatctctaatgtttcttttggttttaaggtttttggcactttctgagtgggtgatttagatttagatttggcctcatggcttaatcaagatcttacaaagtctatgtgaatgttattgactaaggaattttcttgaaacatctgaaatgaattgagcctttcaggtgtctacctataaggactgtaccccctc

SEQ ID NO: 96164 - DNA, 783 bp, Homo sapiens
gatttttcaaattaatttggcctaaatattatcccaatttattaaccttaattggagaatgttgaaaatcttgtctcttcataaaaaaaaaaaaaaaaaaaaaagccatttccgaatacgtagtagctgaattcctaaggctaaactgagaaattctgtagtttaactacttgatttacctattatagcaattatataaagtatagaaaagaaatagcattttacatatactattgtattagtccattttcatgctgctgataaagacatacctgagactggggcaatttacaaaataaagaggtttaattggacttacagttccatgtggctggggaagcctcacaataatggtggaaggcaaggaggagcaagtccccatcttacatggatggcagtaggcaaagagagaatgaggaggatgccaaaagtggaaacccctgataaaaccatcaggtctcatgagacgtattcactaacacgagaacagtatggggaaactgcccccatgattcagttatctcccacccaggtcccctcccacaacatgtgggaattatgggagttcaattcaagatgagatttgggtggggacacagagacaaaccatatcaaccatatgaactctttgggtctgtagaataaatagctattgttttttaaatctagcatgatcccagttagctaggattgctaatataaaagaaataaagatagtgaatatgaaattaattatccagattttcagttcatagatttttatgtaaaccactgtccttttgt

SEQ ID NO: 96165 - DNA, 666 bp, Homo sapiens
actaggtcttacaaacaagctgttattccaagaatctcttcaaaaaacagcaacaaggctttcagctttcagctgggaggaggccaaggtgcaactttcttgggtcgtcctgaatctagccacctctgccatgctgccgaagttctaccccaatgagatcaaagtcacatacctaaggtgtactggggatgaagtgggtgccacgtctgtgttggcccccaagatcagccccctaggtctgtcttcagaaaaggttggtgatgacattgctaaagcaactggtgactgaaaggatctgaggattacagtgaaactgatcatttagaacagagaggcccagattgaggtggtgacttctgcctctgccctgatcatcaaagccctcaaggaaccgccaagagacagaaagaaacagaaaaacattaaacacagtggaaatatcacttttgatgagattgtcaatgttgctcaacacatgtggcaccgatctttagccagagaactctctggaatcattaaagagatcctggggactccccagtctgtgggctgcaatgttgatggctgccaccctcatgatatcatagatgacatcaacggtggtgctgtggaatgcccagctaattaagaagcacaaaggaaaatatttcaataaaggatcatttg

SEQ ID NO: 96166 - DNA, 607 bp, Homo sapiens
gatctctttctattatacgacagaaaataaaaattatatttttgtctttgaaatccaatcaaaatataaagtacttatgcttggtatagtgtctcatagtgtatgaaatataaatagccccttaaaggtcttgcttctagatattcaggtattaaataacatgattaaaatcgttttctgtcattcggagaatgaggaaggaaatataaaattattttatttatttatggcaataccaaaaacaaaagtgtgaaaaacttcacaatgcttagtacttataactcttataattatgtcttattaagggatctttcttaagacattttgaaaagctattttaatatttcactacaaacaagtgataatattaaaattaaagtatatctattacaaatacatcagtaaaatattttgtgaccgaattttaagaattttgttatatttttcaaatgaaattgaaaaaaattaaatgtttatctaacatcacttttattgacacattgatattgcataactttgaattttttcagaaactatacaagggaaattaaatcctgcatttacatttgctagcaactaatgagtgtggactgaggataatatttct

SEQ ID NO: 96167 - DNA, 606 bp, Homo sapiens
  misc_feature (570)..(570): n is a, c, g, or t
  misc_feature (579)..(579): n is a, c, g, or t
  misc_feature (606)..(606): n is a, c, g, or t
gtttcataaaggtagtaactctgaatttatggactgagcataggctttgaagctagcgttgtagctgtaaaaaaaaggaaacccagtcttgtctgtgatgaagattaaatgaaataatgaacataaaatatagaacatagggactggtatattgtagacccctggaaaatgataaccgcttatattgaagttgttctaactcttctactagcttacctcactgaacttgagaacttaagcagttccagtggggtgggggtttgctaaagagaaagttggatttttcagtctaaataaataagaaaacttatttataagaaaactggaatggctaagaaaaagggaactttggatttagcttggactgtatacacttatatgaagttcattttagcttattttatgattatgttccatattttatgttcattatttcatttaatcttcatcacagacaagactgggtttccttttttttacagctacaacgctagcttcaaagcctatgctcagtccataaattcagagttactacctttatgaaactcacaaaaacacaggcatttctantaacagaanatatagctctgtttttcataagctggn

SEQ ID NO: 96168 - DNA, 466 bp, Homo sapiens
gggaggtggaggttgcagtgagccgaaatcgcgccactgcactccagcctgggcgacagagcaaaactccatctgaaaaaaagaaaaaaaattagatgactgtatcacatcagttggggaaacagattgcgatatcaggcagcaaagcgatttgcctagtggaattagcccctaaccctgcttgccctggtggttaactcactgctttcgctccccactctctaatacctgttaatacaaaatgagaggaagggaaagtcagcagtggctgctgggagatggggttagggaagaggctgactagaggggcagcaggggaaagggtgcagccatgccacgtgctgtagcctgttacactccggtatggctttgccagcgttcatagaaccatctaacaaaaagtgaatttgaaggtgtgtaaattattttagagttgaatttctaaaaaagaataggcccaaacatc

SEQ ID NO: 96169 - DNA, 108 bp, Homo sapiens
taactctgatgttaagaggtcttaaggtattcagttagaagttgtaacatttgggggccgggtgcagtggctcacgcctgtaatcccagcagtttgagaggctgaggc

SEQ ID NO: 96170 - DNA, 715 bp, Homo sapiens
actgctttgggggttcggttagtgcgaagacgacgttcttcttttcccctggtgtcagaatgcctgttaaaaaaaaccaacagcctccacaactagggcatgcacacattggtgtaatttgatggtgaaaggcctggggaattcctgttaggaaacctgtagacaatacactttgatcgctaatgggagtgtaacatctaggggttgtactagatgacatcaaggtgtccctttcaactcttctgtgattaatgagccttggcggggggtggggggtgggcagtgggggcttaaaactagtttagaccattctgtctttttttctttagcaaaatataccattcttttaaaaatgacacctgaaacaaagccagctgctgtgtttaaaatattgaaataacaagacttggattagttggtgtatgtgtgtatgttttacaagagttgaataggctgggcacggtggctcacgtctgtaatcccagcacttcgggaggcggaggtgggctgatcacttgaggtcaggagtttgagaccagcctggccaacatggggaaaccccaactctactaaaagtaaaaaataaaaaaagctgggtgtgatagcagacgcccgtggtcccagctactcaggaggctgaggtgggagaatcgcttgaacccgggaggcagaggttgtagtgaatcgagattgcgccactgcactccagcctgtg

SEQ ID NO: 96171 - DNA, 222 bp, Homo sapiens
gctacctgccacacactttcacgtggccttattctgtgtgtttctcacagcacccttgagaaatagagactacgatcacatcttttacataaaagaaaaccaccatccagggaggcgaagtcccttgctcacagactgtcatgtgggaagctctctggatgcaatgatgtcctccagttgcattaccaggcaagctgtcccagagttcatggagcggaaagg

SEQ ID NO: 96172 - DNA, 643 bp, Homo sapiens
gttgcttgagatgctgacttacgagaagaagacttattcaagtttttcatctagaatatcactggcaagtgaagaccaccaacccagcagttctttcctcaatagaatcttatcacacttgttacttccctcaagatccaagacagagctacgcaaagtgagattggtctttggggctacaaaacttagcgacatctcttctgttatctctttcctttccccagagacactccacatcgtgtttcctgctgggcgatctgggaggcaaactgccttaaatttcccaatgcactccattatcaaaatgcatctattctgccaaggctgaattctgtacaggcacatctcattttattgtgctttgcagatattgtattttgtttttacagattgaaggtttgtggcaaccctgcctcaagcaagtctatcggggctgcttccccaactgcatgtgctcattttgtatctctgtgtcacattttggtaattctcaatatttcagacttttccattattatcgtatctgtgatggcaatatgtaatcagtgatctttgatgttactattgtaattgtttcggagcatcatgaaccatgtccatggtagagaacctaatcagtaaatgttgtatgtgttctgactgc

SEQ ID NO: 96173 - DNA, 785 bp, Homo sapiens
atttattcattcacctactgaaagatagcttggttgcttcccaattttggcaattgtggataaagatgctgtaaatatccgtgtgcaggtttttgtgtggacgtaagttttttcactttacttcggcagataccaaggagtatgattactgtattgtacagaaagagtatgtttgctgtttggaagaaactgcccacagtggctgtaccattttatattcgcaccagcaatgaatgagagttcctcttgccccacattgttgacagtgtttggtgatgtgtcttgagtttggccattttaatagatgtgttgtgctatctcattgttgctttaatttgcagttccctaatgatgtatgatgttgaacatgttttcaaatgcttacttgctgtctgtaatgtttgctcaggtcttttgtccattttttaatcaggttgttcatttttttgagttttaagtgtctatatatatttttatatatatataatataagatacatattttgagacggagtttcgctcttgttgcccagggtggagtgtaatggcacagtcttggctcactgcaacctctgcctcctgagttcaagtgattttcctgcctcagcctccggagtagctgagattacaggtgcccgccaccacgcccagctaatttttgtgttttagtagagatggggtttcaccatgttggtcaggctggtcccaaactcctgacctcaggtggtccacccacctcggcctcccaatgtgctgagattacaggcatgagccacagcgcccagc

SEQ ID NO: 96174 - DNA, 405 bp, Homo sapiens
actgcattccggcctgggcaacagagtgacactctgtctctctcacacacacaaaaggcacgtgatcagctagcatgaccctattcctgtgccctagttctgcccattgtacttcttccttgtttctgagattcgggcccacctggttctccatttcttaactgaagccatgttttgctgcctgtatctgagcctctgtcttacaagcttgctcagtactcctggttcatctagattctataagagtgtggtctgatttgctttcactaggtactacctccagtggaatagagtcttgcttgtgaatatcaagccagtcaccaggtccggttattagcgtgaacttttatgttacctactcctggatttggggccccttcctggggcaccatgggcccttcatca

SEQ ID NO: 96175 - DNA, 1094 bp, Homo sapiens
cttttagccttagtttcccctttaaattggtgatggattagatcagtggtggtcagccattttcttaaagcaactgaactgtatcttaatcagaaacttaactagtaaaacaattaaaatgcaagtctgttgcttcaagcaacaccactgtggctccatggagcactaatttgaaaaccacagagatgagatcatttctaagaaaacctttcaactttgtttccatgatgctacttgccacaatcttttttacttaagcaatgataccgtttctggctgaacactcaccacacagctattaatattggaaactgaggcaagataccaagagatttttgcacttgaattcctcagggttctcttacagccctgaaaacacctcttcaaggaaataaataacatctgcaaatggtgcagctgcccctaagtattcaaggcaaagaagccttagtttgcagagatgatgataaacttttcatccttccacagaaaatgagaaagccacaggaaatacacggttattttctaattaaagttcaatgtgtacgcttttaaattctgaagttatccttcttttatgatatcaaaatagccctcttttttgaaatgatggtagatcataccttttggtctttttcattgtccttacataaaagttggtaatcatatgtcagtcccagaagttttatttgacacttactggtctataaaatccaaaggaatggggatcactgcctgccttaaaggtttttttgtgtgtttgtttgtttgtttgtttgcatgtgaaggatttttatgtcacaaatccagctaacagtggatctaggatctaggcctcaccgaggatgtcactgaacctgtcagccccaatgacaggcacacaccttcaaagagcaagagtgcccatcactttctaggctccttgcctgctgctcattccatcatcacggatacagacttgtttctggtttcatcttccaccagagattgcaaagcatcctctgcccagtgcttctaggaggccttactgggatggttcataagccactttcctcttggtgacagcccctgtacactgtggcatgtacggctgg

SEQ ID NO: 96176 - DNA, 536 bp, Homo sapiens
ttcccatggtagtgaataagtcttataagatctgatgattttataaggggtttccccttttgcttagctctcattcattccctcttgtctgctgctacgtaagacgtgccttttgccttctgccatgattgtgaggcctccccagccacttggaactagatggagccgggcaggactaaccctgctgtgcagatggaataaaaggcagggacctgttccacgatgctcccaagctcagatcacagcgagctaaagggaacctgggaggtgggtctcctaagcctcaggcacaggtctctggaaaggacacgcactggatagaaaattgggaacagtttatttcaaacaacaaaagcagcccacagtcctcatggatgaactttgcagagggcctcacagccaggaacttcctttgacccctgggtggcctcgaccagacccttctcagtgggaatggccttggctatttgtgagtgagctgcctgcccattgcccatgggtcagtccatgggtggcttgggtcctctgtccagggt

SEQ ID NO: 96177 - DNA, 668 bp, Homo sapiens
cattagttagtgacaagatgaagtccagcctggcccacaggaccctttaggatctgcctctccagctgtttggtcccatcatttgacaataccaaattattggctgaaagcacagtcacacttgccatttcatatgccctggtctttacaccagcagtcctgtggcctggctaccttcctcccttgctaatatgaagtctacagacatccttctctgggaagcctgaattgggatcaacccattccctgaaagatgcttctcatctcatctgtattgccccagcaccttcttataccccatacagagactttttaggcacgatgttgtggacaccctacactcagcatccagctcagtgtgtgacccctggtaggcattccccaaatgttggtgcaaagaaccatgccgggggtggagccactgtttactcaaagtgatggttactggggaaggattggaggtcaggaccctagccaggtgccacctcggatgaggtccatgccatggctgcttacaccaggtcctctcttttcctccaccactgggacgcagcaccctccttcctcaagaattctgtcccccgtgcttaccacaggtaaaacacttccttggatggaaaggtaggctctcttcctcgggggtggtacattagtttcctgggctttgg

SEQ ID NO: 96178 - DNA, 602 bp, Homo sapiens
agtgggaggttacagcaccagtcggtggcaaggggccaggaagccacggttatgccctaggcgcagggagtgctggcgtgccccacccgtgggccccagcttcccagcccagcccagcccctcagcactgggagcttctccctgagctgccctgacaccatcctgcccttagcaacattctccaagcagcaccaccctcccttagcaaccgtctccaggcttcacaaactgtggccaggccagccccaagctcccctcatgtttttgtttaacagcaaatagtaacaaggccttgctggaccagctgcacccctgcccagggcatgcacccgtgcccagactggctcttgctgggtcctcatgacccttacagagatgctgtcctcactgaatgcctgcccgaccagcagcctggcctggccccaagccagcttggcatggagcttccagggagggggcctgctctgccaccctcacttccacccaagcaaggccttgtgccagggccagacaaagccagggccccagctgctgccctaacagtctttctggacagtgccactctgttccctgtgggcatcattatttcatctgctgaaccc

SEQ ID NO: 96179 - DNA, 615 bp, Homo sapiens
caaagtgctgggattacaggtgtgagccacagtgcccggccttgagttaatttttatataagtgtaaagtggggattcattgttttgcacgtggaaatccagttgtcccagcaccatttgttaaagatactattctttactcattgaattattttggcacccttgtcaaaaatcaattaaccattgtgtgaaggatttttccctggactctcaatttttgcatatgtactcataagaggttggtctgtagtttccttaggttgtttgtctgggtttggtatcagggtaatactgccctcagagaatgagttgttaccttttacttcaacctacttgtatcctgttatatttaatgtgagttacttaaagacagcatataattaggtttttataatccaaactgataatatgtcgaattggcgtgatgaggccatttatgtttaatgcaactattgaaatgtttggctttagatctaccattatgttgttttctgtttgttccctgttttccattgctgtttcttctttccttttttccttccctcctatctctccttctccctatacacacacacacacacccccaacacacacacatagtggttgttctagggg

SEQ ID NO: 96180 - DNA, 551 bp, Homo sapiens
ggcaggacagcgcccgcccgcccgggtaagcccctcgcgaccttccctgctgccactgccacagctccaggtgacgctcgccccgtcccctttacttgctctctcagcccaggaataattatagtaccattgcagacatccccgcaccctccctcttggagacccaggcggtgcagcaacgttctctcccaccccccgcagcgagaaacgaatgaaccccctcctactttcaaaagagaacaaaataacacgccccttaagaaaagaggcgatcctacctccgcaggcgctggagaccaccagtgatgcgtttgcttagcaatccctgagccccatttcccctggccgccttcgccctggggcctgggactgtgcgctagacgtggctgacactccctgcacggcaaccctggaaggagggagaggaaggagagttctataacccaggcttcactgccaacccctcctctgttcggttccccccaccccactaccaccaaatgcatacacccgcccaggatgcgttgtaaaaacaaaacaaaaccaggaaa

SEQ ID NO: 96181 - DNA, 2251 bp, Homo sapiens
aaacattcggtggagtcgcggacacttccgctcggggactgaggttgctgcagtttttccgcgatagtttggggcagttccgcgcgttgcaggcccttctgaatttcctggacctacgcattggatcctcaaagaactggtgatcgaattaggggaaaaggggcctcgtcggagagtagaggtttggaggggcaagggccgctgtttgcgttctcgtccgtggcaccttcttgggcttgggtctgtcctcgcttcccgggggcattggtacttggttgggtcgcgtctcacctggtttcagggtttccggggctctgagctcgcccactccgccccctgcaccccacgcgcgtggccacttcttcgcgatataacgttggggtgttaatctccttgggtttcccgttactgttctttaaaatggggactttagggccatcctaatggaatcgttttgggaactggaagaggtaacacaaatgagagccttaaagcagtccctgtcacttggtgactggtggtctcttgttaatttcccacgaaggaccgggtggggtcagagctccagctgcaggggcctcggcccttctccctgatccctgcaggacgctggatgatcccggaagccttctgacctctttttaggagagcgagggttgcgtccactttcatgaagggaaaggagcatttaacttttatgggggacggcgacgcggtcaaggtgtttcacagctttctcgttccccaacccgacctttccagaagagctgcagggagggacttcttggcttctgagggcaaagctctacgtgagtggtccttggctctttgaccgagatgctcaccccaaccgagagtgtataggttgtgtcctcgggcatgggggtcgataataattaagtcttaattagtaacttcattctaagggctttatacaaataaatttacgccacaccgtggctctgtggagaagtattgcttttttctattttaaaaacgaaagtgagacacagagcgcataggcacccgactagtgagaggtggagctggggttggaacctaagcagtctgggtcagagcctgatttgatcttctcttgggatacgttgtcattgaggcagaggaactagttggacttaggtggggaaagcaagacttaggggcttgaaattttctgagtttctaaaaatgttgtcaactattttgtttcaatcattacaaatattttgtattcttatagaaccatgtcattgtacagcattctatttttctttattaagaacaaaatgggccaccgcgcccagcctaacctaaattttttgtgcatgatactagaaaatttgccagtcacttgtgttttgtttcttcatttactcctcagaacagctgaatgaggctgttcttatcttcctcttaaacacatgaaatatgagaaacctgctcaggttcagacaggagaccaagggtccagaatattagttattttagcctttttactcagttgaaagagagagaaaaagaaagagagaattctccattgagggaactgtgccctgtggtgtgggtgtctggagtgtcctgttgagtgatgatgtccacaggtggcatcgctcctccctggacctaccttgggaggggggcatcttctcttcctgtcgtggtacctcttccatggcccccagcacttcaggcacccaaggacggcaattaccacaattgttatagaacattttaaaattcattatgggaaaagatgccttacacaaaccagaaaatgtaacagtctaaggtgaaaatatttaccatttggatatctaaaacaagatacaatccaaaataagaatcttatgcccagaccagggaagaaaatccaaagaaatacaaataaaggacattaccaggaatgtatagaaggagaaaaacagatgtcaataaatatttgaaaagatggtggtattcatttataatcaaataagtgagaataataaaacaaaatcatggccaggcctgtgactcacacctataatcctggcactttaggaggcttaggaaggaggattgtttgaaaccaggagctcaagaccatcctgggaaacatagcaagactctatctctacaaaaagaaaaaaaagaaaaaaacaatttcttcctaatcagattaccaaagtaatgggaaaattgataacttgcttttggctatgttaagaaaaaccagaataatgtatccccttgaaagattttgaagttaggt

SEQ ID NO: 96182 - DNA, 563 bp, Homo sapiens
aaacattcggtggagtcgcggacacttccgctcggggactgaggttgctgcagtttttccgcgatagtttggggcagttccgcgcgttgcaggcccttctgaatttcctggacctacgcattggatcctcaaagaactggtgatcgaattaggggaaaaggggcctcgtcggagagtagagctgaataccactagaaacatacctgtaaccagagacagctgattatagctttctgcagcaaggaagcccacgtaccaggggctgtcttggcacaattctgctttcccaggaactgcatcactcaggactctgcaagtttccagaagtaagagggaaaatgaccacgttcaaggaggcaatgaccttcaaggacgtggctgtggtcttcactgaggaagagctggggctgctggaccttgctcagaggaagctgtatcgagatgtgatgctggagaacttcaggaacctgctctcagtgggacatcaagcattccacagggatactttccacttcctaagggaagaaaagatttggatgatgaagacagcaatccaaagggaa

SEQ ID NO: 96183 - DNA, 1860 bp, Homo sapiens
aaacattcggtggagtcgcggacacttccgctcggggactgaggttgctgcagtttttccgcgatagtttggggcagttccgcgcgttgcaggcccttctgaatttcctggacctacgcattggatcctcaaagaactggtgatcgaattaggggaaaaggggcctcgtcggagagtagaggtttggaggggcaagggccgctgtttgcgttctcgtccgtggcaccttcttgggcttgggtctgtcctcgcttcccgggggcattggtacttggttgggtcgcgtctcacctggtttcagggtttccggggctctgagctcgcccactccgccccctgcaccccacgcgcgtggccacttcttcgcgatataacgttggggtgttaatctccttgggtttcccgttactgttctttaaaatggggactttagggccatcctaatggaatcgttttgggaactggaagaggtaacacaaatgagagccttaaagcagtccctgtcacttggtgactggtggtctcttgttaatttcccacgaaggaccgggtggggtcagagctccagctgcaggggcctcggcccttctccctgatccctgcaggacgctggatgatcccggaagccttctgacctctttttaggagagcgagggttgcgtccactttcatgaagggaaaggagcatttaacttttatgggggacggcgacgcggtcaaggtgtttcacagctttctcgttccccaacccgacctttccagaagagctgcagggagggacttcttggcttctgagggcaaagctctacgtgagtggtccttggctctttgaccgagatgctcaccccaaccgagagtgtataggttgtgtcctcgggcatgggggtcgataataattaagtcttaattagtaacttcattctaagggctttatacaaataaatttacgccacaccgtggctctgtggagaagtattgcttttttctattttaaaaacgaaagtgagacacagagcgcataggcacccgactagtgagaggtggagctggggttggaacctaagcagtctgggtcagagcctgatttgatcttctcttgggatacgttgtcattgaggcagaggaactagttggacttaggtggggaaagcaagacttaggggcttgaaattttctgagtttctaaaaatgttgtcaactattttgtttcaatcattacaaatattttgtattcttatagaaccatgtcattgtacagcattctatttttctttattaagaacaaaatgggcctggcgcggtggcttacgcctgtaatcccagcactttgggaggtccaggcgggcggatcacgaggtcaggagttcgagaccagcctggccaacatggtgaaaccgcatctctactaaaaaataattacaaaaattagctgggcgtggtggtgggcgcctgtaatcccatctactcgggagggtgaggcaggagaatcgtttgaatctgggaggcggaggttgcagtgagcggagatctgccattgcactccagtctgggcgacagtgcgagactccgtctcaaaaaaaaaaaaaggacccttctagtttggaagacacttcacaacgaaaaacaaagtacagaactctagttactgagacagtccacgcttaatggggggaaacaatgtggtcgaggtgttagaggccgggcatggtggctcacgcctgtaatctcagcactgtggcaggctgaggcagaaggatcccttgagcccaggactttgagaacagcctaggcaacaagtgagaccctgtttctacaaaacatttgaaatttaagccaggctggtgttgtgtgctgaatgtg

SEQ ID NO: 96184 - DNA, 1002 bp, Homo sapiens
aaacattcggtggagtcgcggacacttccgctcggggactgaggttgctgcagtttttccgcgatagtttggggcagttccgcgcgttgcaggcccttctgaatttcctggacctacgcattggatcctcaaagaactggtgatcgaattaggggaaaaggggcctcgtcggagagtagaggtttggaggggcaagggccgctgtttgcgttctcgtccgtggcaccttcttgggcttgggtctgtcctcgcttcccgggggcattggtacttggttgggtcgcgtctcacctggtttcagggtttccggggctctgagctcgcccactccgccccctgcaccccacgcgcgtggccacttcttcgcgatataacgttggggtgttaatctccttgggtttcccgttactgttctttaaaatggggactttagggccatcctaatggaatcgttttgggaactggaagaggtaacacaaatgagagccttaaagcagtccctgtcacttggtgactggtggtctcttgttaatttcccacgaaggaccgggtggggtcagagctccagctgcaggggcctcggcccttctccctgatccctgcaggacgctggatgatcccggaagccttctgacctctttttaggagagcgagggttgcgtccactttcatgaagggaaaggagcatttaacttttatgggggacggcgacgcggtcaaggtgtttcacagctttctcgttccccaacccgacctttccagaagagctgcagggagggacttcttggcttctgagggcaaagctctacctgaataccactagaaacatacctgtaaccagagacagctgattatagctttctgcagcaaggaagcccacgtaccaggggctgtcttggcacaattctgctttcccaggaactgcatcactcaggactctgcaagtttccagaagtaagagggaaaatgaccacgttcaaggtgggtaggacttgcttctat

SEQ ID NO: 96185 - DNA, 569 bp, Homo sapiens
  misc_feature (569)..(569): n is a, c, g, or t
gcaacacacacacacacacacacacacacacacacacacacacgatcatcaacacatacttagcctttttagatccataaagtccagaaggcagtagggatcccaagacgacctcacccaaagggctccctggctctcctctgatggaggggcactgcttgcttggcccggtcccctccgtgccagttcccaggcgcactctactccagcccttctccctccctcccttcctccctctcctggcccaccctgctcttccctcgccctgcaaattaggtgggtgtggcaagggcaccgcctggtcccaagtgtccctctgtacccacacccacccactcacttgtaagctccttgatgagcaaacccctaaggcccccagctcagactcagcaggcattcaggtcaactcaggcagactggctaaggaccagcccagggcaattttgcagaaatgatcatttgcacagaatgggtttccttcacagggagaaacttgcctctgaaagctattttctgatcaagaaaaggcccactttttaaaaagtgaaacaagtttgcagatacggttn

SEQ ID NO: 96186 - DNA, 1077 bp, Homo sapiens
acagagacaggagactcaccgtcttgcccaggctggtctcgaactcctgggctcaagctatcctcccaccttggcctttcaaagtgttgggattacaggcgtgagcaccatgcccagccttggtttacttttaaactcagagactgtatctcagaaacactataatcaccaaaaaattttaaaaacacaatagaggtgatcttctacagcaggaatttatattaagcttatttcagttggcaaataaatcagattttactaatgatgtttaagaatagcgatattggttcagtcagcttgaaatgtaaagtatccaaataatcaaatcgatcacctatcctgatatgactactcattcatattcttctgctgtgcagaagccaattacccaaaaccatgccagggaatttatgtgctcagtcagtctcggaagtgatttccacagttcttaaccaacctgtcagctattagggttgaaaatcatatcatactgccatagaagcaccggctagaaataaatcaggaatcatttgcccttaattaacatgccaggttcaaaccaactttatttatttacactctcctctcccagtgagtgctctagttgccactttatccaactttcaaaaatatctcagagaggatttgagatttctattttgctagagagacatgcttggtcagattcaacatttaccaactctctttcatggagggaatttgctgggctcttttccttgcaatttctaagccaagtgtcttctgcttctgtaaactacttcacttaactgaaatttataacgaattcttcctgccatttggaatgtggtagttttgcataatctatttgtaagtgcttgtttccaatgttgctgactgtatctgtggagcttgttgtacaacctttacataaccaggtttgtaaaacagttgagtgaactgttctttgaaattttattttttttaattttcttatgaatattataaaacttagaaacatgtttgattatctaatttttcttttattgtatttgattatgtcactctagttaaaataaaagcactttggtgaaaaga

SEQ ID NO: 96187 - DNA, 299 bp, Homo sapiens
ggactatgtcatgaagtcattttatattttagatccacccatgcataaatgccaattgagtactatttgtgaaaatctagaaaaattttttccacaattcgttcactcaagtatgagtgatccgaattcaaatttaggttttggaaattgtatttccatattctcgggcaattttttttatttctctgtgttacagtttcttcatctatcaaattggaatgatacttcaaataattatgatgaatactatctatctatctaacacctacatgatagcagtgactcccaactaataatag

SEQ ID NO: 96188 - DNA, 222 bp, Homo sapiens
cttccatcaggagtgaagacatatttgtggaaggtcccatctacacagatggcaatgacagagttgaatttcttggaagtattgcgaccgaaggagcagatgcaagctgactcagcaggcacagtgaacctcgccaggctccactgagagtccacgtactgcccaatcataggccccaccttgtccacggagccagcgcggagcagcggttaaggtgggtat

SEQ ID NO: 96189 - DNA, 436 bp, Homo sapiens
tcaccctaacagcgggagctgctccgcgccatgctaaagccactccaggacagcaggacgggccgatgggggtcagcgtgtcggcccagcatgcggggtcatcccaggaacccacgtcccagccccttggagcccagctggagagactgtggggccagagggaggtgtgggagaggggcaggggagggtaacccctgggaacaggacagaggtgggggatccaggcccctcggagggtgcagagccctgagctcagcaaggaggggcagggagctcccagggcccagccctgtgcttgggaaaggagccgggagggggatgggcaactgagcggccccagggcctcaggtccacccccttggccgggtcccctcggccctgtccccatggccccgtcccctcggccccatcccctcggccctgtccccacgtccct

SEQ ID NO: 96190 - DNA, 896 bp, Homo sapiens
agcgggagactagggggcggcgaggagtgggacccgctcgcggccattggttgtgcggccaggaggggcggagggacgacgcgcgggctgtgcggggccggcagcccggatccactcccgctgcgcctgctgtccgccgtgcgcccagactgcgcgccgcgccgctgcgcccaacattcccgaggacggcttcgcgggcgcgtatcgtccagaccggagcaccgccccaccgctagcgcaggagacctgccggggaagtcgcgtgtcctgacctgcagtctcaatgcacatctgatacctgctgcctttgagaaacaagttttgttgtgctgatttaacagcctgtgaattctgcaaacacgatcgtgaaaaaatgccaatctgtcctgtgtaagccctgtgtgaagttttgactttaatctaccagatcactccttcaccctccataaagatgtctgaacctgacacttcctcaggattttcgggaagtgtggagaatggaacttttcttgagctgtttcccacatccctgtccacgtcagtggacccatcctcaggccacctgtcaaacgtctacatctatgtgtccatattcctcagccttttagcgtttctgcttctgcttttaatcattgccctccagaggctcaaaaatatcatctcctccagttcctcctacccagagtatccaagcgacgctggaagttctttcaccaatttggaagtctgcagcatttcctctcagaggtccactttttcaaacctttcatcctgaggaaaatggaagagtccttgagtgtggcagcagttttgacatccccttacggaagtgtcccgtgaggcattgcctcatgaaagaaatgatccttttggtgtagacctgcttctccttctcc

SEQ ID NO: 96191 - DNA, 274 bp, Homo sapiens
tgggattacaggcgtgagccaccatgcccagcccatgtattattttaaactcactcaggtgcagttgttaacagtaaaatacaaattcacttttagaaatttctgaatttctgttagcttgcattttgaatattttaagtgaatagataatgatattatagccaatcatatgtggatgccctcaaaaaccactcttagtcttaaaatgttgttttaattctaaaattttgattaccactgctgtggagaatagtgtcttgaatccttagcctca

SEQ ID NO: 96192 - DNA, 312 bp, Homo sapiens
acccatgttcaaaataactcaacaaacccatgttcctcctgtccctggtccagttaacatttttgtcatataatcttaaaaattttaactgctttgtttaaaaaaaaattattctgacagtctcccttctcccagtgcagttccacgctcctcttctactcccccaaaggtgaatgtcaagaatttggtacgtagctttccaggctattttttcttttttttgagacagagtttcgctcttgctgcccaggctggagtgcaatggcgcaatatcggctcacctcaatgtctgcctcccgggttcaagcaact

SEQ ID NO: 96193 - DNA, 99 bp, Homo sapiens
gttgtccctgacagtgatataaaatgagaaaaagatataaaatgatacagattggaaagaaagaaaacaatcttcatttgccaatgacattgtctacat

SEQ ID NO: 96194 - DNA, 233 bp, Homo sapiens
tatcccggatgcagccagagatgcgcatttcaacagggaattcagagaaggagcctctcctcttagccatcacagcttggaatgtgctgggtcacacctgaagccagcatgtcttacagtctcacccaaggcccccggcatgtactacctggctaccgctgctgattattcagggcccaagggctctttagtcagcaggtgacaaatcctgccaggactgggttcttctcttc

SEQ ID NO: 96195 - DNA, 725 bp, Homo sapiens
agcggagaatcatgatgtgagggcggctcgcaccccagcgcgcacccaggcaccttagagtccccggctttggctcccctgggtcccctggttgtgcgccaggcaagatgttgagatgcacactggaaaaccggaacgctcaaaccaagcaactgcaagcagctgtctcaaatatggagaagcatttgggagaactgtgccaagtctttgctgcctatgtgcggaaaactgccagactgcgagacaaagtggaccgaggatgaatgaaatcaactcatatgccgctacagaggccccacatctaaggctgggcctgatgaactttgctgatgagtttgccaaacttcaggattattgacaagcagaggttgaaagacttgaagccaaagtagttgaaccctggaaagcttatgtaaccattgtaaaaatgaaacgggatgaccccaaagcaacattcacagcaaggaatcgagaagctaagcaattaactcaggtagaaggaacaggtcagcgaaacccacctcatctgatcgacatgttattgtatcctttgaatttcgacctttaaaaaaaacgttttttaggccaggcatggtggctcacgcctgtaatcccagcactttgggaggctgaggcgggcagatcacgaggtcagaagttcgagaccagtctggccaacatagtgaaatcccatctctactaaaaatacaaaaaaaaaaaaaaaa

SEQ ID NO: 96196 - DNA, 1166 bp, Homo sapiens
aacagaagccatcggcacagccagcagacagacgtcccctttcaaaggtgcttcccacacatctgttcatcgccccatctgcagttgttgtcaatcttcagggcctgccttctccctcctatccccactgacaccctacaccctaggctcctgactgcctgccatggagggctgtgagtccagcctgcagaatcccctcctgagcagacacaggagtgcgtttacactcgggggcagtgtctggccttccgggggcaaaacgactcactgaacccgcagcccagggccactgggcaagggcagaggccactgcacctgtcctcagactcatccccacacttgaccccataggaactgatgcatctgtgtgagccaggccctgccttagtcagcagaggccactacttgtgccaaatccactgtgggcctgctgtaccaggctgatgctggccaggcgctggatgtcccccacagtcccctgaggcctgactgttgtactcaggccctctcccagagtcctccatcatctccccattttaccctaccccgagccccagtcgccaagaaggaggtgttgttcttccagggtcttcctttcaatgtctgtttccacagtctcatgctatagaagcgctgagccctccagcgtggttggaggatcaagggatgaaatgggacaggaggagaggggtcctccaggctggtgacccctgccctgttggcctgtctcccaagtggcagccttccctgtgggccacatcaggaaacccacggagacagggtgattttgcatctcctggaaaatgagtgggacactcctggccccctggctctccccaccacccctacatatgtgctcagaaggagcccaatgcattgaatggttccactgtcgagccctctaagacctggtttgcctcctaaacctccagtgtacttctctgataggtgtttaagctacaggtgagactttgaagtccagagaagacagacacacctgaaaaccggtccccatttgggccgaaccttaaaaagcccattgtcccagagtcctagtgcccacggagctgtctgtgtgtcattgtcctgcccaggtcatcaggtgtgggctgaggacaggcccagggcataccctcccataaaggggttttcttctttcctcattt

SEQ ID NO: 96197 - DNA, 460 bp, Homo sapiens
aaatagcctaagaaaattttattttttaagttatgttttgatttctgtttacttttttatatgtttactttttattgaattttttaatgttaaaaaatttaatttttaagttatattttgatttttgttgttttttaaccatatgtttactttttattgaatttattaatattgcaaagttcttgcactgccaaaccatgcctaagaattcaaagaaagaaatggtacagtagacggcctcattcacccatcatacagtatcttaaaacttgattcatgtacattttgatattttcatagtcttttaagaagttataacgagttggaatttaaatctgctgcaggggctgagcacagtggctcatggctataatcccagcaccttgggaggctgaggctggaggattgcttgagcccaggagttgagacctgggtgacatagtgagaccctatctttcca

SEQ ID NO: 96198 - DNA, 372 bp, Homo sapiens
  misc_feature (209)..(209): n is a, c, g, or t
taagagggatgattatgattccatcttttatcttcatttacattctacaacacagatttggggaatgcatgccgggaggaactatcacctcttttaatctgactttgagggctcatggtatttaaaaataaaattttgaggttaaaggtttcaaagtgtaggaagaaagtaaaccgtttttttgttttattttgttgttgttgtttttnttttttaaaggaaatcgcagcatggcaacaggttgccacagaatacccttccctgtaggtgagaaaataaacctgcataatgtacacaggcgtctacacgagaaaggaaaggacatgatgcaacatctcctcctttgcagcccagatttattcaagcaaccaa

SEQ ID NO: 96199 - DNA, 482 bp, Homo sapiens
  misc_feature (393)..(393): n is a, c, g, or t
  misc_feature (421)..(421): n is a, c, g, or t
  misc_feature (440)..(440): n is a, c, g, or t
  misc_feature (451)..(451): n is a, c, g, or t
  misc_feature (473)..(473): n is a, c, g, or t
ctctcagtattcaaggggtattggttccaggacgcctgaatatcccaaaattgatgaatacttaggtcccacatttgggcctgcggaatcctcatatatgaaaagccagccttccacatacagattttacatcccaggaatactgtgcccggccacatataacctttcttctggtggacctacgaagccatgagatagattgtgattcatttattccaacctcgggaacactgatgacttgtcagcctctatggcaggaactggagagtcaggggtagaacagttctagcacagtgcctaagaaagtggggagcacaggctgtccagaggcagggagatcctgggggggtacatggtgggctttagctggaatggttcattcagggacagttnaaccaaactgggggttggacctttcttnggtaggaaagttccaggtngcctggaggantttggggtggctttttggaggntatgggcaa

SEQ ID NO: 96200 - DNA, 379 bp, Homo sapiens
agttagttatccggtgtgatacctttgcagtgtgtcagcttaactaggctgaactagagtttccagaatttcatttcttgtatgtttccagttgggatggtctataaagtatattttttcaagaggtggactataaatggaaaacagtggccatttagtagcatacacataccttctcccagctactcaagaaaaaactaatctaagccagacgtggtggtgctcgcctataatcccagttactttggaggctgaggcaggagaatcacttgatcctgggagacggaggtttcaatgaaccaagattaagccactgcactccagcctgagccaaaagagctagagactgtgtcaaaaaccaaaaccaaaacaaaaaaca

SEQ ID NO: 96201 - DNA, 181 bp, Homo sapiens
taacaaggtgaaacattataagaaagaattttggaagacactatacagtcaaatattatagagtccagtcccagttgtaattatcataagaacagaacgtgtgcacttgatcagcttctgataggcattccgggtcaagggtagatctgtaactttacacatagactaacggaagagaatg

SEQ ID NO: 96202 - DNA, 127 bp, Homo sapiens
caccacgcctggctcattttgtattttgaatagagacagagttttaccacattgcccaggctgctgtcgaactcctgatgtcaggtgatcagcccgcctctgcctctgcctctcaacatactgggat

SEQ ID NO: 96203 - DNA, 509 bp, Homo sapiens
gagtatcccattcagaacttagagacaaacgctcagagtttttcggcttcgtattgctcccttctttggaaagttaaaagatagtcttcacttaaattacttaaagaggtaactgccctattattttaactcagtgaagctcaaccagggaggattttcctaaccagggaggatttccctcccccaggggaacatgtcaatgcctgcagacatttctggttttcacagctaggggatgccactggcatctagtgagtagagtccaaggatgctgctgcggtacccaggacagcccccacaacaaagaattatctggttcaaagtctctgttgttgccgaggctgagaaactctgctttaactgaggagcaggcaattcgggacagacccatgtggtcaggactgctctgctaactgcagccttcatttttggattgttaaaactctgtctcttaaagttccagcctcctaactttcccagatatccttacttgatttttcctcccaccc

SEQ ID NO: 96204 - DNA, 357 bp, Homo sapiens
agcagtctgattgaagaatggttttccccctacacccaggaggggccacagtcttggggcagatgctggcctctggaggccctgggtggccaggccccctcatgggaaaggactgggcatccctttggtgtgtggaattgggaccttccaactccttcctgtagaggaacccagcaaacgtgggcctgacaacactacatttttttcgggttatcagtttaaaagttggaagcccagaaaaagagaagagccttgaggaaggtcaagctttccttgttgtgttttgcatgttacttaattcactcagcttgctgaagttggtggtgtttgtgaagacagacagcagagggtcacaga

SEQ ID NO: 96205 - DNA, 477 bp, Homo sapiens
atcacgaggtcaggagattgagaccatcctggctaacacggtgaaaccccgtctctactaaaaatacaaaaaaattagccgggcgtggcggcgggcgcctgtagtcccagctacttgggaggctgaggcaggagaatggtgcgaacccgggaggcagattttgcagagagccgagatcgtgccactgcactccagcctgggcgacagagcaagactccgtctcaaaacgaaaaacacacaaaccagtatggagcattctgatatgaataagacacttgctcacttctcaatttctttggtgtccagctctacaagtgtatatagacttccaaataatatttaaatcctttaacaaaaatgccacctaagaaaatatgaaatacttcagtctgtctgtcagtgctcacttcctgtctagaaactttcaggctccggcacaaatgaaccatgtacttcgcctaagtcatctatggaaca

SEQ ID NO: 96206 - DNA, 398 bp, Homo sapiens
tcgtcgtcttggagcaaaagaagcaagtgctgctttagactcccggcctaactttgttcaataaatccccacttccaaatatcttgtgattgcagtgtgggtcatttttagtacttagatccagagcagtctctgattgttagtgacagtgctgtcaaattgcatgctgttcaccagctataaacgaaaacatcacatttccttgaagtgcactttaacgtgtaattcaaagacttttccaagaggcttactggggaaaaatagaggtgtgtacctttggcattggacatggagtctctgattttagattgtagttgtttccccaaatctttaagattgtggcagaaacatgattgtgactacggcattcattttgtagggcagtgcgtgttatttta

SEQ ID NO: 96207 - DNA, 758 bp, Homo sapiens
agcggaaagtgtggacagtgagaaggggggcaaagcaataggatggagctgcaaggacttgaagggtagtgttcagcctctatctaattttacacagagatggggaaggaacaggagccactccgcacatggtggtttcaatctattttacagtgttatacagtaacattcgcttattcaacctggtaaaaatggttcagagaggcagatgttactctccttaaactgaatgccacattttccttcctgaataccagcactgctatgaattatgcagtagacatgatttttacatagatctgattttcataatcttacaaaatttatataaattcacatttttaatgtcaccatgaaggaaagagcctaaataaacacacctgtgtggataattaacaaatcaaattaacattgcttgaaagcagtcaccctgggaatcaatctttcttactatatacactatgcaaaatattttagaattctttgcaaaaaaaaaaaaaatagcagggatttaattttggaaagtggataaataaatcagagttaaggccagtgaatcacacacaggcaacgtgtttctggtgtcaaaagcaagatatgcctcgtagaagtacatgagaaaatttgattaaatcctgcataatattatctcttagaaaacgtcttcctatcggatacagatttttattattttcggtatgtctgtctttatgtgtaagggtaaccattggttttaaaatcagaagaaaggtatattg

SEQ ID NO: 96208 - DNA, 302 bp, Homo sapiens
gttcaactgcacatgtgtgcaggtattgttgccttgcctgtctgcacacacatgtacctgtatgttcatttcacacatgtattgctgggaacatgtgtgtacatggctatgcatacatgtgtatgtgcctgtgtgttagtgtaggcctggaacccacgtacacccagggcatgtggggctggagaacaggcgtggccaagctcacagatgggcagctgcacggacacccagggcatgtggggctggagatcaggcgtggccaagctcacagatgggcagctgtgcggacacccagggcatgt

SEQ ID NO: 96209 - DNA, 368 bp, Homo sapiens
agaaatgagtaggggtgtgtcgagcacacacacgacactctaacacccccgagtgcaccctcacgcagctgagatggactgggaccatggataggctgcagcaagagcagcccaaggatctggattcctggaagaagtcacagggagggccttctctaagaagatggccaatgccccccagacagcctgttccgctgcttctgtcccagttctgtacaagtgtgggattctgttaatcaggaactgggcagcctcagcagtgccccctactcacggaaatcatgctgtcctgacctggccatcaaggaaggacagacctgtcatccatcacttttaccggttccattaaaaatatgtatgtaataggt

SEQ ID NO: 96210 - DNA, 356 bp, Homo sapiens
agccgtgtgtcatgtctgatcagagcatgattaagcaggacaggatttcacatgtgggccacaaagccctggacctggccgctcaccctgagaggggcactgtggaccccacccgccattcactacccagcttgccagtggggtgggtgctttgcaggctcacagaaaaatcactcgcccttgaaatgtcttatctgggcctggacacctccttagtttctcttgtgtttcctttctgtgtaaggctggtccctcaccgctggtttgatcacagccctctgtttcctcagggtcactggtaggtcagcgtttgaactttgtgatttctgtctccctccttcagtccagtctttgac

SEQ ID NO: 96211 - DNA, 378 bp, Homo sapiens
ccagatttcaactgacaagttttctgcaagaaagatgcttctctggtatctgctgagatcatttgaaatcatggtagaacgcccagaattatgggctcttcttgaaattggatatcatcaaacgaggcactaattacagaacaattaacaaaagcctaaaagggtgtaatggagaatttctaatgaatcctgacttatcatggctgaaagaagacttgaagttggattaatgtagaaacactggaattctactgaaggagctggtgcttgatttgatagaaaaaaagaattattacactgttctattccctttttcagtttgtaaaactcctcagacaattgttttctaagaaaggattaaactcctatatgaaatgg

SEQ ID NO: 96212 - DNA, 410 bp, Homo sapiens
atggcttttttttttaagctaacaaatggtatttgtctggctctagtgttaacaatttattctcttttactgaaacatcagttaagaataaccttgtattcttttatttaaaataaggctctcggccggcacagtggctcacacctataatcccagcactttgggaggccaaggtgggcagagcgcttgaggtcaggagtttgagaccagcctggccaacatggtgaaacccctcctctactaaaaatagaaaaattagctggcgtagtggtgcgtgcctataatcccagctactcaggaggctgagtcaagagaatcgcttgaacccaagaggcagaggttgcagtgagctgagattgcgccactgcactccagcctgggtgacagagtgaaactccgtctcaaaaata

SEQ ID NO: 96213 - DNA, 803 bp, Homo sapiens
actgggataacaggtgtgagccaagatattgggattacacccagacaagatattaaaatatatttaatagacacaactgtacctcacacatatacatttgaatatcgcataaatatctttaatatatttatccaaaatgaatctaaaattagctaaaggattccagatttataagaggaagactgttataatttgtccaaattgcataatattcttcctcctatatttcttatgggatgatgatttccaacacatgttaatatcccaaacacaaaaatgagggctcatggttcattcattgttgtctccttaattattattgggctcaacctttatcccttcaaaatctcctacaggccagccatagtggctaaagcctgtaatcccagcacttctggaaactgaagtgggaggatcatttgagcccaggaatttgagaccactatgggcaacatagtgacacccagtctctacaaaaaaatcaaaaacttagccaggtgtggtggcatgtgcctgtggtatcagctacttgggaggctgaggtaggaagacctcttgagcccaagagataaaggctgaagtgaactgtgatcacttcactacattccaccctggataacagagcaagaccctgtctcagaggaaaaaaaaatcatatatggaattcaaaagacaccaggatgcctaaatagttgaaaagagatcattttggtgataattggtttgcaaacttggaagacttcaaacttgcaaaattctggggctgactgaagacaccctctttttgaagaggagaaggatat

SEQ ID NO: 96214 - DNA, 340 bp, Homo sapiens
atacttgttcaaaagcttgcaaattagtgtaagctcaggacctgccgaacatcctttcagcattatgagattccagaaaatgtgaataggatgtttcagttgttaggtaatttccagatgccttttttttgtgctcagataattcaaatggcttcttttcaatacttcaggcttgtcatgtacactatattagagtgtgtaacatttttgaaggaatttggcacaggcatcgcttttccacttctgactctctaagtttgaagagtgcctgccaagatcgttataaatacatcctaataaatatattttcaccaatttttgaagttcccttttacttcaa

SEQ ID NO: 96215 - DNA, 299 bp, Homo sapiens
taactagagtacatcttacagagggtcacaaagttgcaaaataaatcatttttctttccttgtgacataagatacatatgtataattccagaacatttttaagtgtatagaagttttataaaatgtatagaatgcatttaagtgggtaggtggattgggaataaaaggaaaaagaaaagatgggaaatttctataaggatatcagtcacttagaaaatgaatgcggttttataagagccttcaagaatattcattaggaagctcatggtagaattgaatgccttttgcttgcccctttc

SEQ ID NO: 96216 - DNA, 150 bp, Homo sapiens
ggattaagatcttagagcagaatgggcatgcttttggtgattgctgtccatcatttcttaatcctgaaaacaagccccacattattgagtcacggacatgttagtaacttgctcagggtcacagccctgcacccactttacctgccatgt

SEQ ID NO: 96217 - DNA, 354 bp, Homo sapiens
taagtattggccgtcgctgatcccgggggaaaaacctagaccgcgatgtccggattaggggtcggggggagatataggggagaccgccgcgatatatatggagggtctgtgctagaattgaaagtgaagtcatcagaagtaggtgagattgcctggttcagtgattttcaacataggcactacttaaaaaccacctggggagcttttaaagaatgaggatgggggatcgaggcatccacagggattctgtatcatttggtctggtgcagggccagaccttgttactttaaagatgcttcccatgagatggtgataggtatctaggactgagaactgggctgagagcccaaagag

SEQ ID NO: 96218 - DNA, 366 bp, Homo sapiens
aagaagcaaaatgcttctcaaaaagattaacatctgagtgtataggcctctgtgctaaattactaaaagttgtatcagtatttttacataatagccaaactaaatgaagttgacattgtgtactaccaataactgcagagaaacccaataaggccagattttgtgcgagtgcgttttttgtaaaatgatcattcctagttttgaggggaacaaagaaatagatcattgtaacaacactttgaaatgggagaaggctttgtgatcatgtgcaagaaaaagcactagctgaactagccctcagatttgagattgagtttgggccctgccacatccttggttttgttgttttttttttttcgagacaga

SEQ ID NO: 96219 - DNA, 470 bp, Homo sapiens
ctgagggactggatgaggaatgtgtcctagcccacttaggctaagaccaccagggacaaacctgtagtccagcactgtcagatttatttacaatggcaatgggagagtctgcacactagagataccataggccaggggtccccaactcccaggctacagacgggtaccagtctatggcctgttaggaatagggccacacagcaggaggtgagtggcaggcaggtgagcgagtgagagaagcttcatctgtatttacagccactccccactgctcgcattaccacctgagttccgcctcctgtcagagcagcagcagcattagattctcacaagagtgtgaatcctattctgaactgtgcatgtgagagatctaggttgccctccattttttttttgtttgtttgttttttgggttttttggttttttttttagatgaagtctcactctgtcgccaggctggagtgcagtg

SEQ ID NO: 96220 - DNA, 1168 bp, Homo sapiens
tttatcttcttaccaaaagccatcctgattgctccctctgaggtgatggacagagaaaattttccctccaaggactgacagagaaagaacaacggagatgtggtcgtctgctggcatccatgcacttgtgcaactagcaaagcaccgagtccacagggaaaagggagagaaagtgtaaatgaaggtacatacgcagaagcacaattgccaggtcaattagtaactctacgtttaacacttgaagaactgaggaactgacagactgttttccaaagaagcagtcccattttcttatattcccaccagcaatgcatgaggattccagtgtttccctatcttcaccaacccttattattatctgactttcattttatcgtagtggggtgaagtggtgtttcatagtgaaacatagttttgatttgcatttccctgatgatgttgagcatcatcatgtgcttattattaaatttgtttgggagaatgtccattcagatcttttgcccgttttttaattttttttttgagacagggtcttgctctgttgcccaggctggaatacagtgggcagtggtgcaatcatggctcactgcagcttcagacttctaaactcaaatgatcctcccacctcagccttcagagtggttgggactaccaacacatgctaccatgcccagataattttttaacttattgtagagacagggtctgacattgcctaggctggtgcaatcaagttctttatcagatatttgatttgcaaattttttttcaaataaaaaatgatgaccaggggcagtggctcacgcttgtaatcctagcactttgggaggcgaggcagaccaatcacttgaagttagaagttcaagaccagcctggccaacatggcaaaaccccgtctctattaacaatacaaaaattagccaggcatgctggtgcacgcccgtagtcccagctattcgggaggctgaggcatgagaattgcttgaaccccaggatgcagaggttgcagcgagctgagatcacaccactgcactccagcctgggtgacagagtgagactcatctccaaaacaaaaacaaaacaaaacaaaacaaaagatgaagcggtaactcaggaaacctttatattattgtattattcataaatcaaaataaacctttgtaaaaca

SEQ ID NO: 96221 - DNA, 236 bp, Homo sapiens
cttttttcagtgtctcgctatgttgcccaggctggtcttgaactgctggcctcaagtgatcctcttgcctcagcctccagaatagctaggactacaggcatgtgcaccatggttttcaaaccttggttctctcaacttccttctccacagctcctctatctacgtaatcatggagtcctccatcctacctcctatagcactggttcccactaggagtaataccaccttggcaattt

SEQ ID NO: 96222 - DNA, 772 bp, Homo sapiens
  misc_feature (529)..(529): n is a, c, g, or t
  misc_feature (533)..(533): n is a, c, g, or t
  misc_feature (540)..(540): n is a, c, g, or t
  misc_feature (555)..(555): n is a, c, g, or t
agcggcaagactgatatataatgataaaaaaggaggacatagattattactgtcagaaatgaaacatgagatataactacagaccttcacacatcataaggctaataagggaataataaaaataactttacacaaataaatttggcaacttggaatggaccaatttttttaaaaaaacaaaatctaccataacttactcaatatgaaatacaaaatttgaatagttttataactaataataatattaaattttcaattaaatacttccctcagtataaatctccagatggtttcattgtaaaattctaccaaattccttaaagaagaattaacgctcattttacactatctcttacagaatatagaagaaaaaggaaaacattatgactccttccaaaaagtgattactatctgactagtataagaagataaaggcaataccaaaaaaaaaaaaaaaaaaaaaaggctacggggccaaaattccctcatgtgaaattccggtttgaaacccttttttaccaagggtttntccnttaaaanccgggaatacttaanccacttctctttttctttcgagtgaaccccgaaaagaatttctactcccacagtgagacattttcattcacatcagcaaaggaaacttacagtccccaacgggaaaggcgaaagacgcgggcgtttaacaccttcggcgatcaaactaccttgcagaacacctaaaccacttttaacaggtgcctcaaggacaagcagaagaaaaacctttactccc

SEQ ID NO: 96223 - DNA, 1139 bp, Homo sapiens
cgcgccggaaatggccgaagccggcgttcgcgagcgggggcgcggacgcgggcgcgcgctcgccactttcccgaccgcgtccgaagaccgccgaggcctcccgcagctccgcggtgacacccgggtcaggggcgcggggccgggcgccggggattgtgggaggcgcgggggggcgcgccggccgccttcggagccccccaactcgcgtcctgcaaaggccgccgggccctgtcgagaagacccgaccgcagatggcggggaggatgctcccggcggcgtgggaaccgggtctgactcccgagccaccgccgcttccgcaggggcgccggccccgggaaagtcaagtcataaatccctgaatctaaaactccattctcagagaaaaggcctccaaggacgggcgccgtgcgcggcaactgcctgcagttttgaagccctttgactatttcataacaaagacaaggccgggcggcttggacgcttaggaaaatcctggggctttgcaaaaacaacaggttaatctagtcgtgtgggatgatcaccaaaacaagacaggaaagaagaacaccgtgtcaatgctgaaaagccagcccctaacacagggcttctactccagggtttcctcgccagggaaccccaaacacacaggacctggagaagccgggtagagctggctcctggccctgcgcttgggtggtcggctgccttaagaagaactgcaccccagagacaggctcgcagctgccgaccttatccactcgccctttctgctggagcccaggcccagtgctccagcaaggaggctgagaaaatgctgaagactgatgcccacgggggacagcttgggctaaggataacgtttgcaaaacaaacctttaaaaacccatagcaacctgtttcctagagcacactcttcatctctccacccccaaactagtcccgactcggatcctccttttcctatcctctttctcttgctctcccgtctcctattcacttttcctctcctttcctcttgattattataaacaaatgctttccaagtcttaccgccatcatatgtgtacatatgcaacccttactgttaccaatttgttgaagtcaagacaggaggaggcaaagtttaaaaatcagaagca

SEQ ID NO: 96224 - DNA, 1375 bp, Homo sapiens
cgcgccggaaatggccgaagccggcgttcgcgagcgggggcgcggacgcgggcgcgcgctcgccactttcccgaccgcgtccgaagaccgccgaggcctcccgcagctccgcggtgacacccgggtcaggggcgcggggccgggcgccggggattgtgggaggcgcgggggggcgcgccggccgccttcggagccccccaactcgcgtcctgcaaaggccgccgggccctgtcgagaagacccgaccgcagatggcggggaggatgctcccggcggcgtgggaaccgggtctgactcccgagccaccgccgcttccgcaggggcgccggccccgggaaagtcaagtcataaatccctgaatctaaaactccattctcagagaaaaggcctccaaggacgggcgccgtgcgcggcaactgcctgcagttttgaagccctttgactatttcataacaaagacaaggccgggcggcttggacgcttaggaaaatcctggggctttgcaaaaacaacaggttaatctagtcgtgtgggatgatcaccaaaacaagacaggaaagaagaacaccgtgtcaatgctgaaaagccagcccctgtgagccccaaagtgcacgttttccacagtcccaaggaacacgtgactgtgtgtttccacacttgagaagtcaggataagaccccttggataatggaacaggggatgggggtgggagcaagcaccctacctggtcacctgcttaacttagaaaccagcttttaaaacctgtaactgcagtatgagctacgatcaaatttgtcttaacgtattttttttaatgtttttaatacccagaacacagggcttctactccagggtttcctcgccagggaaccccaaacacacaggacctggagaagccgggtagagctggctcctggccctgcgcttgggtggtcggctgccttaagaagaactgcaccccagagacaggctcgcagctgccgaccttatccactcgccctttctgctggagcccaggcccagtgctccagcaaggaggctgagaaaatgctgaagactgatgcccacgggggacagcttgggctaaggataacgtttgcaaaacaaacctttaaaaacccatagcaacctgtttcctagagcacactcttcatctctccacccccaaactagtcccgactcggatcctccttttcctatcctctttctcttgctctcccgtctcctattcacttttcctctcctttcctcttgattattataaacaaatgctttccaagtcttaccgccatcatatgtgtacatatgcaacccttactgttaccaatttgttgaagtcaagacaggaggaggcaaagtttaaaaatcagaagca

SEQ ID NO: 96225 - DNA, 378 bp, Homo sapiens
agcaagctacaagagagttccgtccttggtgtaaattgaccgtgtaatccttgtcaagtttgagccttactggagctttactttcttattcttaaaatgcagatatcttgcctgcatcctggacagagcttttaacaaggtcatatgttgcagaatatgaaagttcatgttaaaaaaccctttaaaatgtggtatcccatttactagctggtgaacttcttgaggaacctctgtgcccatgggtatgaagtgtatgctgaatgatcacccaatgttagaggagtgggtggactggtaacctgatttaagggccattctaactcttacattctatgatttttttaattctgtctttaagtttttacatttacaatcaca

SEQ ID NO: 96226 - DNA, 397 bp, Homo sapiens
caccagggaccaaattcctgggaaacagtttttccacaggtgggagtgggatggtttggggatgaaacttttccaccttagattatcacgcattagttagaatctcataagaagcgcgcaacctagatcccttgcatttgcagttcacaatagggttcatgatcctctgagaatctaatgccacccctgatgtgacaggagtgggagctcaggcgataatgctcccttgtctgctgttcacctcctgctatgcagcccggttcctaacaggctgagaggaccagtaccattctgtggcctgggcgttggggacccctgttctagatgatccacattcttttaaatgcctatatacaaaccatactttctttatttcttttctttttttgagacagtc

SEQ ID NO: 96227 - DNA, 259 bp, Homo sapiens
gtaatacgagaaaaatcacaacagagtaataaagatataaaactttcacaattaacactcatcagtgtgataaactaagcccatgtaaaagtaaaaatctctcacagttaacaaacgtctttactttcactaagaaggaactgaaattaaagtccttagtcactttggaggtggctgcaaaagctcacaacatagttgatccttaaaataattatgaatggcaaccagtgctgcctttctgtactcaaccatgcaactg

SEQ ID NO: 96228 - DNA, 352 bp, Homo sapiens
cacaaattgcccttttaaaaagacacacaaactgaatttgtcatgtctcaaatgataaagggtcttgcacataataaaaacaaaaagtaaaacataaaccactattctaacactaaaaatactggaaattggtaattataaacaatagaagtctgttagagttaagactcatttaaataaatcataggcaacagaaccacatatttcatctgggatattaaacgaagctagagaccttctaaatcttttacaagaaactgagagatcaagcatctcatttccctctaaattttttggtgccacaattggcaacagaagagtggggtggaagaaacactgggcaataaactac

SEQ ID NO: 96229 - DNA, 177 bp, Homo sapiens
cccgagagcaggctgggatatgatcgtgtgtgtgcaacgctggtgtgctgccacgctcatcgctttttctccccttcccccttgtgggttcctcgtactaaatctgtttttagtgtctcacaaagtaggattgcactttttaatttttaaaaaatttttttttagagacaggttctc

SEQ ID NO: 96230 - DNA, 337 bp, Homo sapiens
caggttttctgcctcctgctaagccaatttatacattccaagaaaatcttccatttcatccaggtgaaacagaacctactggaatgaagctggcctcccatggaatgaagctggcctcccgtctccttgatttgaagcagcttctccacgttggttattatgtcatttttctaaatctaacattttaaaatttgtgccttttctttctcttttgcttgacttctcagaggtttttttaatggtcttttcaaagaagtggttttgggttttatttatcaagtctacttttattatggctgttttaaaattaaatacatttatttcttgtttcccttaa

SEQ ID NO: 96231 - DNA, 653 bp, Homo sapiens
tggcctccctccgcctctagctgaccacatttctggggccggtctcatttgcttacgctaaagtggacctatgaggtcaaagggcattacaggctttttggcagatgcagctgaaggacctctggaaggactgtgccaacgcatgcaccagcctgcgtggtcccccatccctgtggctggtgatcctggggtgacaccctgatccagactctgtctttatcccgtaacagaggagagggcacgtcactgccacaggcgcctttcctcccatgccacagcaagatgcagacaagccaccctccccagacacacccactgcacgctgcagcagggcccagggagttgaatgttcagtccaggcctcacccccgtggttcagtgggatgcagggggccacacggaaatgccagaggcagccttcaataagcaaaagtcaataaggcccccaaaggcctggatgcttcaagtccaagcactcggggatggcggagggaaggtgccgccctcatcacaggctgggcatggcttcccaggggggatgccagggagaggctccagatgttcggagcctcagcgtgcccaatgctactaggtcagacctggctttcacctccacagtccttaagagctggttcaagactggggtatgaatg

SEQ ID NO: 96232 - DNA, 450 bp, Homo sapiens
ccctaggtgggaggcagagcaggagggtttggacttggcagacagcccagaagctgtctcctacaaataatgtacaaatgtaagtttgttaatggttgatgagtttacgatacagtcaaagtatggtcatttaggaggcggtgaaggtatggtcatctgtggtcagccccctttatatgtacttctcctccttgccattctttggtcccaaaataggtgattgataggcagtgagaatacctgtgatgtaggatattttgaaagaagggagaggtggagggtagagtgaactggagaaagaaagtataaaaaaggaaaaaagggcagggaaattctcttaatttttcattctcctaatccttggacattttttttccttcttcttgtcacgtcacttgaacggtttggctcttaagaaaaagagtcgggaggaagcaaagggaaacactt

SEQ ID NO: 96233 - DNA, 654 bp, Homo sapiens
tttttaaagacaaggcacgcttcttaattttactcttgaagtttctaattgttgccaagacaagaaattaggtggtttgaggattgcagctttcttttcctggatggctctgatagttgttccataaagcccttccagcaatagctctgttttctggatgccatgcgtggggcaaggatggggtggcccgaggctgctgagatagaccacattctgcatattctaagttgtttatagaatttgtccctttgcaggtatttaaatagtgggtgcaaaaccatcattgcttttctagttatgttaaagagaataaaactttcctactcagaaggcccaggacctatcatcaaaatctcaaagactggcactcttatcttttaatgcttttatgggttcactaccccagctttgtattacttatacttttcatttggtccaccatgttggtttgtttgtaccacttaggagatcctaactcatgaaaggggcatttggaggggctggggctcacctctcagtaagagggctttgctctgaattcaaaagccaatcctctcctattgattttctctttggttgagagtcaaacacaccttcctcaccacagcagtgtgtggagagcagatttaatttacctgcctgcactgcggccgc

SEQ ID NO: 96234 - DNA, 333 bp, Homo sapiens
agtagcagagaaggtgatccctgggtgcattttaatttgggtgctagaagcaaggaggtgcctggcaagttggagcgggtgagggtttggttggtgcttaaatggagcccctgagggtagaaaggaaaacttagaatgttgcctttgggaaactccaaatagaccacagggagggactgtttacggagggaggtggcactggattggtagtccagagctgagatatggtggcctcaagagccctgcccaggagcttggactctggtccatggtccctagggagccagtgaaggttttaggccaggggaataatgtgatcagatttccatttaa

SEQ ID NO: 96235 - DNA, 478 bp, Homo sapiens
tagtagtaatgttatattaaactgctttggcctgcatggtaatgaactatagccactgagtgggatcttggtggcctgagagagttaatgctgccagcatcacagccttctgtccatgaagtagaaatgagcagaaacctggatagtccaaaagtcattttatatttagctttggaatttgtttttgtgccttcatttgaatatggatgagtcacaaattgacttcatacaaattagcaaactttcattggaatggattctgttgtttgctcctcttcagttcctttctgatcctcactgcatgcaaagcacaaaccatttcttaagtgtagcagtggaggcagaactgtcctttttctgcttctttctagaaaaggcttgatgatggtggggttgcaagtctacatctcccttcggagtgtaaataaatagtgaaatagtgagaaggcagatcacaaggaaagtaccaagtaggtgt

SEQ ID NO: 96236 - DNA, 312 bp, Homo sapiens
tcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtg

SEQ ID NO: 96237 - DNA, 292 bp, Homo sapiens
gtgaataagtgtcaccagatctgaggggtttatgaggggtttctgctttcacttcttcctcattctctcttgctgctgccatgtaagaagtgcctttcaccctcccccatgattatgagagaactccccagccatggggaactgttaagtccaattaaacctttttcttcccagtctcgggtatgtttttatcagcagcatgaaaacagactaatacactatgtaaatattaagtatgttaaaagtcttatctttatgaggagtcccctgggcacacattatggaggggtac

SEQ ID NO: 96238 - DNA, 803 bp, Homo sapiens
gtgatgaacaagacaaaccaaactcctgctttcttgggggttatactctcataggtggagacagatgcaacagaatcaattaaataaataagtaaatagaagatcttttcagatggaaaaaaaaaagtagtagcaataaaataaggcagagagatggagcagagttctcgacactggcagtgttgacatttggggctggataaccctgtgtggcggggggcactcctgtgcactgtaggatatgtaactgcatccctggcctctgcccattagatgacagcagtacccaccccagttgtgacaaccaaaatgtctccgacgtcagcaagtattccctgctggttcagaaccggcagcttggacttctacaaagggttacccaatcctgcactgactttttgatagcctttgttcctgaagaactcttacatagatctcagaaactgatcctccaatgtactggagaaacagttaactaatcgtgcacaggaacatctcaggacagttttcagaggctgaggctggaggatcgcttgagtccaggagttctgggctgtagtgcgctatgccgatcgggtgtccctcacactaggtcactatgcctttcagggtggccttttctacctgaaatagtctttctgggttctggtcatcactctgtctccccactcctggggtctaggaagaataacagccgtactgctcctgttcctggcgtacgcactattccttgtgagttcctcacactttgcttccatcttcgtaaatactctctttattaaatctctcaaattttcctaaaa

SEQ ID NO: 96239 - DNA, 436 bp, Homo sapiens
ataggcgtgagccactgtgcccagcctcctgtgagtctagtgaatcattgagcctcagggtggtcttagggacccccaacccaatggggaaactgacacaaacatcatgctcacactctgcctcttgtttttgccatgactaataaaattatttgtctctaatccaggaccacatgtcttctgccggcatccctaaaattgtcgcaggctaactttgtagcttgcaggtagggtaaactcccattcctcatagaattcttaccatcttcaaattattccatgttttcctcttgtatttttatagctatatgtttaaatgtagctcttctctttttattttatttttttcattttttagagtcttactctgtcgctatgttgaagagcagtggcgtaatcatagctaactgcagccttggactcctggactcaagga

SEQ ID NO: 96240 - DNA, 460 bp, Homo sapiens
tgttagcttttatctttttttcatagcttttcctgcaacctagacattgtttatatcattatcttggctgtgtcactaattagcaattgatttctgaaaatttagctcgtcatcaataaatgctgttcctaagtagtcaattagaatgaacatctcccagggatttatggggttattaagtctggaaggtagtcttggtgaaggcatacattaagaccttgtatcccaggaggattatctgtggtgacagcaacaggaggtgaacctgctcagcccagctgtggagttcagcaccaggctggtgaatccatcttcccaagacctcatgctgtcacagccaggagacttatgctctaattatgtgccccttcttttgcaacccctacagcttaatgggtttcacattctcttaaggtctaatgtcattttaaaattgactgacatgccattatctctcagg

SEQ ID NO: 96241 - DNA, 483 bp, Homo sapiens
aaaaaaaaaagataggatttctgtgtggttcacctttgtgacccagttggcacctggaagagttttctgtagttaaaatgccctcagagctgggtgcggtagctcacgcctgtaatcccagcactttgggaggccgaggcgggcgaatcacctgaggtcaggagttctagaccagcctgaccaaaatggagaaactcaatctgtactaaaaatacaaaattatccaggtgtggtggtgggtgcctgtaattccagctacttgggaggctgaggcaggagaattgcttgaacctgggaggcagaggttgcggtgagctgagatcgtgccattgcacttcagcctgggtaacaagagcaagactccatccccccgaaaaaagaaagacaaaaaaaaaattgtgtcacacaggccagatgcagtggctcatgcttataattccagcaatttgaaaggcaaggtaagaggatcgcttgagcttgagt

SEQ ID NO: 96242 - DNA, 484 bp, Homo sapiens
gcgagctgaacaggaccaagtggaagatccctttcacatggctgaaggcaggcctaggacctaggagcaaagcagttcttccagccccttcctcccaaagcccaaatcctggttccctggatctgactactctcacagtaagaaaaaagggactccagaaataactggcaagttagcaaaggggtgacatgttctagacagctggcgtgcctcacctatagccccactgctctaggcattttcaggagatgagtgagagctttgggactcctggcctggatacgcccaccagagggagaggaaaagccagaagacagagctgggagcaaccatcttaccaggctcagaactttagctccttcaattcattcaacacatatgttgtcccttcatatccatgggggattgcttccaggacctcccgtggctaacaaaatccagatgctcaagtctctgatataagatgctgccatatttgcatata

SEQ ID NO: 96243 - DNA, 336 bp, Homo sapiens
gataactgggacccccgtgatcgcatctgagcccaaagctggtggtgtatgtgccaccctcacatatgcatgcattacaaggggcatgaccagaggggtggacacagccctcagcatgctcgctccttctagaactcaacgaaaagtgcctgtactgtttggttctctcatgaagacaaatacggaagagactaatggaaagcccaaaagagaaggtgaaatgtggctcaccatctgcctttggtcttggcagcccagggcatttgggcacccccaccagcttttttttaaagatggagtctcgctctgttgcccaggctgtgtgtgcgacccggg

SEQ ID NO: 96244 - DNA, 712 bp, Homo sapiens
ggcggggcgcggcggcagcggagcgttgtcggccagtgccttccgtgaagttgctcgccgggtcgttgggccctgtcgacctgtaggcgggcgagcgagccagcggacaagactgcgggtgaggctgagctagcgagcggccggcagggggggcgcccgggctgcgagccgctgagcccagccgcgctgccgccgccggccgtcgtggggccggaatggcgcaaggccggacggcgggccgcctttgcccaggacacacgctctggcgtttgttcctttgggcgtgacgccagcttcaacgggtacgcggctttcccgacgggtgctgatctccgagtcgctgttgtcacgcggactgctgtcctccagattcaggccggtgggtctggggagcccggattggtcttggaggagcaacggctgcgcaggtgactcggtggcctcaagtgtgtacaaaactcagaacatgaacaacaatatatattaccaatcttcaaacctggtttgcctagaactggaatacagttgcctgcgacatattttagaagaactagaaaagtcaaagtaatggataacagaaaagagcctccattcttcaagtgatgatcacatgggaccattttactacagacttcatttctgtgataccatggagctcttcatggaaacattaactggaacatgtttgagctgagagttcaccttttgaaac

SEQ ID NO: 96245 - DNA, 398 bp, Homo sapiens
accgcattcaggtgatattctgctcatcttcccaagagggctccccgctccctctcaagctgggctgagctgcagtccatctgcccaggccctgtcacctgggggatggggcttgtttgcagagcaaggtatttctgtttgcctacgtttttatgggtggagacagggaagccatttgaaaaatctgcacagatgagcgtggactcactcagcatgctctggatctgagctcttcacactcaggcagttaaagagaagccactgggaatgatgagaggttaaaatgccataaggagagtaaacaagcctcaaacaggtgcagaacaggtgctgactggctctgagcccaggcaaacctgcccttctcggcgcctggtggagatcaccacctcacccca

SEQ ID NO: 96246 - DNA, 589 bp, Homo sapiens
tccttgatgacagtgtttgaacctgtcctggcctctgtcctggctgcagccccagcgagggtcccctcctaaaggccagccgccgttgtccaaggcagacaatgtggagtagccaggcctctccaggccttttcatcccattcaaaggcctgcgcggcccccaccccctacggcctcaattctttaattcttttcagaaattctcctttcccagtggtcaggggccagcatgcccctgctgggctagcaagagcagttgacatgggcagggctggaggacggaggtggttgaagcatcagaggccagaagagcagttgtctgagacaggggtggacgtgtggcagatgttacagccaccacctattgtgtgcagacaacagttagcctgagtcggctccgttacctgcattcatcagctccagaatcctcccagctgcttggaggtatgctctttatgattctgtttcatagaggaggaagatgaggctcagagagggaacatgacctgcccagagcatggaagtgagccgccaggatcccagatgctaagaggacagagactatgaactcagaaatcccactgttagg

SEQ ID NO: 96247 - DNA, 125 bp, Homo sapiens
ggctccctaccttgccgtttataagcaccgtgccattccacctccatgcacctctatggcacctcctgggtctggaagtcaattcttccaatcctagcctggaagcttctgagatttctgaccat

SEQ ID NO: 96248 - DNA, 739 bp, Homo sapiens
agcggaatgacgttcgcccttaatttctcgccccttaccccgcagcttacctccggcatctcgcaggggaggcacgcctgcgcagtcacgcccgccctcggccccagtcagcgatttgggtctcggagcaccaaggagacggtggacggaatctgaccaggctggtggctacgatggcctgaagcgtgccttttgggttctcagctcgggctcacaagtgttttctgtgctaaatacaaaaagccctgtgatgttttgctttgcgtatccacctatctgactcgtaagaaccgaggctgaatccagacccacactctgtcacgtcgggagagcctgccgcggcgagcctctgcgagcgggcatttcttgggtggggaccaaaagcccagtgctgccatagtttcggatcattcttttaagaagctggggccgggcgcggtggctggcacctgtaatcccagcactctgggaggctgaggcgggcggatcccttgagcccaggagttcgggaccagcctgggcaacatggtgaaagcccgtctctacaaaaaattaaccggtgtggtggtgtgcgcatgtagtcccagctacttgggaggctgaggcaggagaatcgcttgaacccaggaggtcgaggatgcattaagcagtgatcgcgctccagcctgggcgaccgagggtgataccttgtcttaaaaaaaaggtgggagagtggaacgaaaacttggaataagtaggg

SEQ ID NO: 96249 - DNA, 186 bp, Homo sapiens
tgtgtgatgttccccaccctgtgtccaagtgttctcactatccaattcccacctatgagtgagaatatgcggtgtttggttttctgtccttgcgatagcactaccatttttttaaggacacagtatctgcagtatcggaggaaggtccttttaggaagaatcatgtaaacaaagggtagaggagta

SEQ ID NO: 96250 - DNA, 456 bp, Homo sapiens
tgaactaagcatctgttatgcactgtttaaatgctggaggcctgaaagctttgggggactaaacacatcccctaaaagatttgaatttactttattctatggacattagggagccagtcactcttgagaggcaggttagtgttgaagtagagagctggaatggctgggggacaaacggtctccaaggagcctccgccaccatagccacatgagtcagccacttgttgcctcagaacagacccactaccatttagttgctacccaaaactgacacgtgcttgtgactaggagagggatctggagtcataactcctaaaacctgaatttgcggtaagttgtgtgatcttcggcaagtcacatcacatgaaaaggagtacccatataggtgaaaatttttaaatgagattagtactaacactaatatcaaaccacccaccccatgttcttctgaactag

SEQ ID NO: 96251 - DNA, 362 bp, Homo sapiens
  misc_feature (312)..(312): n is a, c, g, or t
gtgaagttttaacaattttaaagtgtacaattcagtggcattaagcctgttcacccatgttatgcagccatcacctctatctcggtccagaactttaaaaaatcaccctaaacagaaatgctaactaagcagtcactctccatttctctctcttctaatctgaggaaactaagcgtgaaagaatgtgagcatgcagaaaaggagaggcaggtatcagaggcagaggaaaatgggaaattggatatgaaagaaatacacacctacaagtgagttcagaaactgaaccccaccctcctgggaaacgcccattgnagtgttgtttttaacctttgtacagtatttagacccagtaaatgcagaaa

SEQ ID NO: 96252 - DNA, 395 bp, Homo sapiens
attgctaagccttgttatttcttctataaaagtgttgaattagatgactttttaagaacccttgaacctttttaagactcttcgtgaatcctttgtgactcaagaatgtttttgattacacattccagtgtacctgaaagctatacagtaaggccagtttcataaaaatcctcatcgcttttaagttagagcaattaaaaatgaaacaaaaggacttgagcattcaataggaatatgaatacaagtgagtttagttgaaataaatactaattaaaaaatgaaaacagtgctgcttaacggatggtaagttgcagtttgaatcatggttactcttaggtggatttatgattagttagcatgttccatgattgatttgtttatgtacttccttaatt

SEQ ID NO: 96253 - DNA, 426 bp, Homo sapiens
tgcagtgcagtggcataatcacagctcactgcagccttgacctcccaggcccaagcaattttccctcctcagcctcccaagtagctgtgactacaggtgcatgccaccatgcccagctaattttgtagagatggggtctcactatgttgcccaggctggtctaaaaattctgagctcaagtgatccacacacctcggactcccaaagtgttgggactacaggcatgagccactgtgctcagcagttctgtgggtttgacaaagcatatagtcactacaataatcaagatacagaatagttccatcggtcacctccaaaaaaatttccctgcaactcaccaaccacggaccaggtttttttgtccctatagttttgcctttcccagaacaccatataacttgaatcatacagtatgtagtcttctgg

SEQ ID NO: 96254 - DNA, 380 bp, Homo sapiens
gagtagacaaattcacagaaacagaaagtagacacatatacctataatctcagcacttaaggaggctgagtgggaggatcgcttgtagccaggagtttgagactagcctgggcaatagcaaaactccatgaccacacacaaaaaagtattttatttttatattttattattattattttgagacagaatctcactctgtctcccaggctggagtgcagtagtgcaatcttggctcactgcagcctccacctcccaggttcaagcgattctcatgcctcagcctccagaagagctgggattacaggcaggctgaccaccgggattacaggcaggctgaccaccatgcccagctgatttttgtattttttagtagagacagg

SEQ ID NO: 96255 - DNA, 531 bp, Homo sapiens
ggggaagaggaatgcctttgcctgccctctggtttaagctgcggggtctagggctaaggtttggttgcttttctttgaagtatctcccttaggctgttgccagctgaccgcttgccagatacttaggcgactaaatagtctagcgtgactcttcctgtattttgttacgacgttaaactcaggttacagctatccttattctgtccattccactccctaaattcgggtcttgtgcgtgaaggaaaagaaacgtaatctctccagctccctctttgcacataacaagacaagtgacttaacacgtgcgagctgtttaaaatgtttttagaacattttaaacattattctctattctgaccaccttagttatcattcccgaaattatttaatatgagaaaatagaaacgattaatagcatatgaaggccactagtagacctactaacataatgtttcatgttaattgccttgggaacaaaaattattgaaaagattaagtgtaatgttaattactttggacccaggatttcct

SEQ ID NO: 96256 - DNA, 789 bp, Homo sapiens
cctgaaaggcagccctcaggagagcttgaggagaaaaccgaccggatgccccaagatgaactgggacaagaaagaagggacttggagccagaaaacagagaggagggacaagaaaggagagtatccgacatccagtccaaagcagggatctcccgggagtcactggtgtccagcaccacagaggacattctgtttcaaaaggataaaagcaccccggtgtatcccttgaccatgacctggtcgtttggatggaacagttctcttcctgtttactatattcgagaggaaaggcagagagttcttctgtatgtttgtgctcacactgcgatcatctacaacgtgttcaggaacaatcaataccaccttcagggccacgccaatattatctcctgcctctgcgtcagtgaagacaggcggtggatcgccacagcagacaaagggccagactgcctggtgattatatgggactccttcacaggtattcctgtgcacacaatatttgacagctgccctgaagggaatggcatcatggccatggccatgacccacgacgccaagtatctggcaaccatctcagatgctgaagtccagaaggtatgcatctggaagtggactttggcagtggaaacgccagcatgcactctcgaactccccacagagtacggtgttcagaactacgttacttttaacccaacaaataataaagaattggtgagcaatagtaaaacacgggcaatatattatgcatggtatgaagagagggatacactggctcacagtgccccactt

SEQ ID NO: 96257 - DNA, 902 bp, Homo sapiens
cctgaaaggcagccctcaggagagcttgaggagaaaaccgaccggatgccccaagatgaactgggacaagaaagaagggacttggagccagaaaacagagaggagggacaagaaaggagagtatccgacatccagtccaaagcagggatctcccgggagtcactggtgtccagcaccacagaggacattctgtttcaaaaggataaaagcaccccggtgtatcccttgaccatgacctggtcgtttggatggaacagttctcttcctgtttactatattcgagaggaaaggcagagagttcttctgtatgtttgtgctcacactgcgatcatctacaacgtgttcaggaacaatcaataccaccttcagggccacgccaatattatctcctgcctctgcgtcagtgaagacaggcggtggatcgccacagcagacaaagggccagactgcctggtgattatatgggactccttcacaggtattcctgtgcacacaatatttgacagctgccctgaagggaatggcatcatggccatggccatgacccacgacgccaagtatctggcaaccatctcagatgctgaagtccagaaggtatgcatctggaagtggactttggcagtggaaacgccagcatgcactctcgaactccccacagagtacggtgttcagaactacgttacttttaacccaacaaataataaagaattggtgagcaatagtaaaacacgggcaatatattatgcatgggtaagcagaaatattttgatttgttttaaatgtgggtagaagtatgtgttcattctttgagtacaaatgtttcagtaatgtaacaatatagtatctctacttaggaagcaatgaatatatattaaaatgtttttatttaactgtagtattta

SEQ ID NO: 96258 - DNA, 3729 bp, Homo sapiens
  misc_feature (2772)..(2772): n is a, c, g, or t
ccaggctccttctctataaagtgggatctatcatgaccagcctaccttatcaatataggagagaaaatcttcatgcctgaagatatacccctgctccctggctccccacgccggctgagccctcaggcagggtccagagggggccagggccccaaacatggacagcagtgtctcaagatgccaggtccccgggccccaggtctgcagggcggttccaacagagatcctggccagccctgcggtggagagagcacccgcagcagctctgtcatcaacaactatctggatgccaatgagcctgtgtccttggaggcccgtcttagccgcatgcacttccatgacagtcagaggaaggtcgactatgtacttgcctaccactaccggaaacgcggggtgcacctggcccaaggcttccctggccactcgctggctatcgtctccaatggggagacaggcaaggagcctcatgctgggggcccaggtgacattgagctgggaccgctcgatgccctggaggaggagaggaaggagcagcgggaggaatttgagcacaatctgatggaggctggactggagcttgagaaggacttggagaataaaagccagggatccatctttgtccggatacacgccccgtggcaggtgctggccagagaggcagaattcttgaagatcaaagttcctaccaagaaagagatgtacgagatcaaagcaggaggcagcattgcaaagaagttcagcgcggctctgcagaagctgagctcgcacctgcagccccgagttccagaacacagcaacaacaagatgaaaaacctctcctacccattctccagggagaagatgtacctgtacaacatccaggaaaaggacaccttctttgataatgccacccgtagccgcattgtgcacgagatcctgaagcgcacagcctgctcccgagccaacaacacgatgggtattaactctctgatcgcaaacaatatctatgaggctgcctaccctcttcatgacggtgaatacgatagtccagaggacgatatgaatgacaggaagctgctatatcaagaatgggcgcgctatggagtgttctataagttccaacctattgacctcatcagaaagtattttggagaaaaaattggactgtattttgcctggctgggattatatacatcattcctcatcccatcttctgtaattggagtgattgtgtttctttatggatgtgcaacaattgaagaagatattcccagcagagagatgtgtgaccagcagaatgccttcaccatgtgtcccctgtgtgacaagtcctgtgattactggaacctcagctcagcctgtgggaccgcgcaggccagccacctgtttgacaaccctgccaccgtcttcttctctatcttcatggctctgtgggctaccatgttcctggaaaactggaagaggctacagatgcgactgggctacttttgggacctgactggcatagaagaggaagaagaacgtgcccaggaacattccaggcctgagtatgaaaccaaagttcgagagaaaatgctaaaggagagcaaccagtctgctgtccagaaattggaaacaaacacgacggagtgtggcgatgaggatgatgaagataaactgacctggaaggatcgtttcccaggttacctgatgaactttgcctccatcttattcatgattgccctgacattctcaatcgtctttggggtgatagtgtatcgaataacaactgcagccgctctgtctctcaataaggctacacgctccaatgtccgggtgacagtgacagcaacagcagtcatcatcaacctcgtggtcatcctcatcctggacgagatctacggcgctgtggccaagtggctcaccaaaattgaggttccgaaaacagaacagacttttgaagagcgcctgatcctcaaagctttcttgctcaagtttgtcaatgcctactcccccatcttctatgtggcctttttcaaagggaggtttgtgggcaggcctggaagctacgtctatgtattcgatggttaccgcatggaagagtgtgctccagggggctgtctcatggagctctgcattcagctcagcatcatcatgttggggaagcagttgatccagaacaacatctttgagattggagtcccgaagctaaagaaactatttcgaaagctgaaagatgagaccgaagctggagaaactgactctgcccattcgaaacatccagagcagtgggacctagactacagcttggaaccatacacaggactgactccggagtacatggaaatgatcatccagtttggttttgtcaccctcttcgtggcctcctttcccctggcacctgtgtttgccctcctcaacaacgtcattgaagtgcggctcgatgcaaagaagtttgttacagagctgagacggccggatgctgtaagaaccaaagatatcggaatctggtttgacattctctctggaattggcaagttctctgttatcagcaacgcttttgtcattgcgatcacctccgactttatcccccgcctggtgtaccagtactcctacagtcacaatgggactctgcacggctttgtcaaccacaccctctcctttttcaacgtcagccagctgaaggaggggacgcagccagaaaactcacagtttgaccaggaggttcagttctgcaggtttaaggattaccgagagccgccatgggccccgaacccttatgagttttcgaaacagtactggtttattctgtcngcccgtctggcttttgtcataatcttccagaacctcgtgatgttcctgagcgtcctcgtggactggatgattccagacatccccacggacatcagcgaccagatcaagaaagagaagagcttattagtggatttcttcctgaaagaggagcatgagaagctcaagctgatggatgagccggctctgaggagcccaggaggtggggatcgaagcaggagccgggcagccagctcagcaccttcaggccaaagccagctgggcagcatgatgtcgtcaggctctcagcacaccaatgtgtgagcagttcagcctgcagcagaggagggcacggcagcagagacacgcacatgcacgtaagcatgttcctacacccacatggcgtgctgtctgtctgcaggggcctggcttgatggggtcttgaagagggggcagtgtgtaaaaagaaagagcctgacagaatgagtgtaggaaggaagagaaatgatgctacatctcagaaacttcaagcttaagtttcttttaggtccccttttaagctgcatccttttgagggattggaaccccactggggtctctccaccccagagtctcaggcaccgcgagcattcccatgtaccctggggcaccctcttgtacttcaccatcatttctgactttgaccagctgtaagagaaatgcagtcaggagcacagcatcccctacttactatcactacaagaaaactgagtcacttgcagtggggctgccacagtctcagcagatgcaaattaagttacaaggctgaatggtgcagccgctggacctgatagtaaggtgcaaaggtccaaacctgggcttgtctccacttcacgtcacaaaaacgtttggagctaaatgcagataaccatcattttatgaaagttcagatttaaaataataaaataaatggacacattctttataaagatgaaaaaaaag

SEQ ID NO: 96259 - DNA, 2741 bp, Homo sapiens
  misc_feature (1784)..(1784): n is a, c, g, or t
gtgctcaggctcctgctagaggtggggtggatctgtagggatggcctcagggaatgtcatgtccctccctttccagggtgccatgaacatagggcagtaggagtgaggaggacagggtgccatggggactgatgttatggaagagggggacttgagctgggtcaggataggatgagggtagaagctggaggatagcacaggagagagggacaacgtgcgcaagtcgagtatggagatgacgataccttagttgggactggtgcttttgcaggattagaaattcactccaacttactcaaataacaagagatttattttaagaaagcaagagacaagctcctgggtgtaggaaatgaaatataaccaggcctcttgggaactggagctagagatgctgtgggaaacgaaggccttccctcctttcagctaccatgttcctggaaaactggaagaggctacagatgcgactgggctacttttgggacctgactggcatagaagaggaagaagaacgtgcccaggaacattccaggcctgagtatgaaaccaaagttcgagagaaaatgctaaaggagagcaaccagtctgctgtccagaaattggaaacaaacacgacggagtgtggcgatgaggatgatgaagataaactgacctggaaggatcgtttcccaggttacctgatgaactttgcctccatcttattcatgattgccctgacattctcaatcgtctttggggtgatagtgtatcgaataacaactgcagccgctctgtctctcaataaggctacacgctccaatgtccgggtgacagtgacagcaacagcagtcatcatcaacctcgtggtcatcctcatcctggacgagatctacggcgctgtggccaagtggctcaccaaaattgaggttccgaaaacagaacagacttttgaagagcgcctgatcctcaaagctttcttgctcaagtttgtcaatgcctactcccccatcttctatgtggcctttttcaaagggaggtttgtgggcaggcctggaagctacgtctatgtattcgatggttaccgcatggaagagtgtgctccagggggctgtctcatggagctctgcattcagctcagcatcatcatgttggggaagcagttgatccagaacaacatctttgagattggagtcccgaagctaaagaaactatttcgaaagctgaaagatgagaccgaagctggagaaactgactctgcccattcgaaacatccagagcagtgggacctagactacagcttggaaccatacacaggactgactccggagtacatggaaatgatcatccagtttggttttgtcaccctcttcgtggcctcctttcccctggcacctgtgtttgccctcctcaacaacgtcattgaagtgcggctcgatgcaaagaagtttgttacagagctgagacggccggatgctgtaagaaccaaagatatcggaatctggtttgacattctctctggaattggcaagttctctgttatcagcaacgcttttgtcattgcgatcacctccgactttatcccccgcctggtgtaccagtactcctacagtcacaatgggactctgcacggctttgtcaaccacaccctctcctttttcaacgtcagccagctgaaggaggggacgcagccagaaaactcacagtttgaccaggaggttcagttctgcaggtttaaggattaccgagagccgccatgggccccgaacccttatgagttttcgaaacagtactggtttattctgtcngcccgtctggcttttgtcataatcttccagaacctcgtgatgttcctgagcgtcctcgtggactggatgattccagacatccccacggacatcagcgaccagatcaagaaagagaagagcttattagtggatttcttcctgaaagaggagcatgagaagctcaagctgatggatgagccggctctgaggagcccaggaggtggggatcgaagcaggagccgggcagccagctcagcaccttcaggccaaagccagctgggcagcatgatgtcgtcaggctctcagcacaccaatgtgtgagcagttcagcctgcagcagaggagggcacggcagcagagacacgcacatgcacgtaagcatgttcctacacccacatggcgtgctgtctgtctgcaggggcctggcttgatggggtcttgaagagggggcagtgtgtaaaaagaaagagcctgacagaatgagtgtaggaaggaagagaaatgatgctacatctcagaaacttcaagcttaagtttcttttaggtccccttttaagctgcatccttttgagggattggaaccccactggggtctctccaccccagagtctcaggcaccgcgagcattcccatgtaccctggggcaccctcttgtacttcaccatcatttctgactttgaccagctgtaagagaaatgcagtcaggagcacagcatcccctacttactatcactacaagaaaactgagtcacttgcagtggggctgccacagtctcagcagatgcaaattaagttacaaggctgaatggtgcagccgctggacctgatagtaaggtgcaaaggtccaaacctgggcttgtctccacttcacgtcacaaaaacgtttggagctaaatgcagataaccatcattttatgaaagttcagatttaaaataataaaataaatggacacattctttataaagatgaaaaaaaag

SEQ ID NO: 96260 - DNA, 2381 bp, Homo sapiens
  misc_feature (1424)..(1424): n is a, c, g, or t
actttacagagattattctatcagctacatgcaggatgggttggaaggctgaaagtctggagtcagctaccatgttcctggaaaactggaagaggctacagatgcgactgggctacttttgggacctgactggcatagaagaggaagaagaacgtgcccaggaacattccaggcctgagtatgaaaccaaagttcgagagaaaatgctaaaggagagcaaccagtctgctgtccagaaattggaaacaaacacgacggagtgtggcgatgaggatgatgaagataaactgacctggaaggatcgtttcccaggttacctgatgaactttgcctccatcttattcatgattgccctgacattctcaatcgtctttggggtgatagtgtatcgaataacaactgcagccgctctgtctctcaataaggctacacgctccaatgtccgggtgacagtgacagcaacagcagtcatcatcaacctcgtggtcatcctcatcctggacgagatctacggcgctgtggccaagtggctcaccaaaattgaggttccgaaaacagaacagacttttgaagagcgcctgatcctcaaagctttcttgctcaagtttgtcaatgcctactcccccatcttctatgtggcctttttcaaagggaggtttgtgggcaggcctggaagctacgtctatgtattcgatggttaccgcatggaagagtgtgctccagggggctgtctcatggagctctgcattcagctcagcatcatcatgttggggaagcagttgatccagaacaacatctttgagattggagtcccgaagctaaagaaactatttcgaaagctgaaagatgagaccgaagctggagaaactgactctgcccattcgaaacatccagagcagtgggacctagactacagcttggaaccatacacaggactgactccggagtacatggaaatgatcatccagtttggttttgtcaccctcttcgtggcctcctttcccctggcacctgtgtttgccctcctcaacaacgtcattgaagtgcggctcgatgcaaagaagtttgttacagagctgagacggccggatgctgtaagaaccaaagatatcggaatctggtttgacattctctctggaattggcaagttctctgttatcagcaacgcttttgtcattgcgatcacctccgactttatcccccgcctggtgtaccagtactcctacagtcacaatgggactctgcacggctttgtcaaccacaccctctcctttttcaacgtcagccagctgaaggaggggacgcagccagaaaactcacagtttgaccaggaggttcagttctgcaggtttaaggattaccgagagccgccatgggccccgaacccttatgagttttcgaaacagtactggtttattctgtcngcccgtctggcttttgtcataatcttccagaacctcgtgatgttcctgagcgtcctcgtggactggatgattccagacatccccacggacatcagcgaccagatcaagaaagagaagagcttattagtggatttcttcctgaaagaggagcatgagaagctcaagctgatggatgagccggctctgaggagcccaggaggtggggatcgaagcaggagccgggcagccagctcagcaccttcaggccaaagccagctgggcagcatgatgtcgtcaggctctcagcacaccaatgtgtgagcagttcagcctgcagcagaggagggcacggcagcagagacacgcacatgcacgtaagcatgttcctacacccacatggcgtgctgtctgtctgcaggggcctggcttgatggggtcttgaagagggggcagtgtgtaaaaagaaagagcctgacagaatgagtgtaggaaggaagagaaatgatgctacatctcagaaacttcaagcttaagtttcttttaggtccccttttaagctgcatccttttgagggattggaaccccactggggtctctccaccccagagtctcaggcaccgcgagcattcccatgtaccctggggcaccctcttgtacttcaccatcatttctgactttgaccagctgtaagagaaatgcagtcaggagcacagcatcccctacttactatcactacaagaaaactgagtcacttgcagtggggctgccacagtctcagcagatgcaaattaagttacaaggctgaatggtgcagccgctggacctgatagtaaggtgcaaaggtccaaacctgggcttgtctccacttcacgtcacaaaaacgtttggagctaaatgcagataaccatcattttatgaaagttcagatttaaaataataaaataaatggacacattctttataaagatgaaaaaaaag

SEQ ID NO: 96261 - DNA, 500 bp, Homo sapiens
ggctcctgctagaggtggggtggatctgtagggatggcctcagggaatgtcatgtccctccctttccagggtgccatgaacatagggcagtaggagtgaggaggacagggtgccatggggactgatgttatggaagagggggacttgagctgggtcaggataggatgagggtagaagctggaggatagcacaggagagagggacaacgtgcgcaagtcgagtatggagatgacggtgaggggatgacccagctgtaatgtgggcatgggatatatgttgtcaaatggcaggatgagcgattcagatagatagttcgggctcgacatacatagtcctggaatccagagagaagaacttagactgtaaggagccattgaacatgtaggcaggtagtgttggcacccttcctctgcccactccttcaatgcccaaatgccattgtccttcaaaaatcagctcggatgcctcctctggcaggtagcacttctcttcgcaggccc

SEQ ID NO: 96262 - DNA, 1103 bp, Homo sapiens
ggaagagtgtgtgacttggtgaagcagctcccaagcacccaagatgcccaggagcctctggaagcagcagttggtccccagtgtcttcccctgaacccctaggaacatgtagggttcaagggctcagtcccagtctcagaggggaaaaggcatgtgagcgtgcaactggcagccagaacctcgtgatgttcctgagcgtcctcgtggactggatgattccagacatccccacggacatcagcgaccagatcaagaaagagaagagcttattagtggatttcttcctgaaagaggagcatgagaagctcaagctgatggatgagccggctctgaggagcccaggaggtggggatcgaagcaggagccgggcagccagctcagcaccttcaggccaaagccagctgggcagcatgatgtcgtcaggctctcagcacaccaatgtgtgagcagttcagcctgcagcagaggagggcacggcagcagagacacgcacatgcacgtaagcatgttcctacacccacatggcgtgctgtctgtctgcaggggcctggcttgatggggtcttgaagagggggcagtgtgtaaaaagaaagagcctgacagaatgagtgtaggaaggaagagaaatgatgctacatctcagaaacttcaagcttaagtttcttttaggtccccttttaagctgcatccttttgagggattggaaccccactggggtctctccaccccagagtctcaggcaccgcgagcattcccatgtaccctggggcaccctcttgtacttcaccatcatttctgactttgaccagctgtaagagaaatgcagtcaggagcacagcatcccctacttactatcactacaagaaaactgagtcacttgcagtggggctgccacagtctcagcagatgcaaattaagttacaaggctgaatggtgcagccgctggacctgatagtaaggtgcaaaggtccaaacctgggcttgtctccacttcacgtcacaaaaacgtttggagctaaatgcagataaccatcattttatgaaagttcagatttaaaataataaaataaatggacacattctttataaagatgaaaaaaaag

SEQ ID NO: 96263 - DNA, 194 bp, Homo sapiens
ctccaatgtccgggtgacagtgacagcaacagcagtcatcatcaacctcgtggtcatcctcatcctggacgagatctacggcgctgtggccaagtggctcaccaaaattggtactgtgtcaccgagacttctggctgtcctaggccctctttaagtcaatgcgtgcaaggcttttggtgataaaataaaaaaaa

SEQ ID NO: 96264 - DNA, 702 bp, Homo sapiens
aggtctgtctacaggctccacatccagatcctaactaaaatttagaagtctttagatgtctgtggatattatcatctggaaaactgggactctaatagtttctgagtctagtattttccccatatagctactcagttttttctagtatatatgtcaaataaaattttgaaaaaattaccccttcccacaatctttgcaaattaatcctcaaatgaaaaggatttaatttagctattccatgataaataaaaaatatgcaattttattgaataaacttaaagtaattaataaattcaatgtactgtcagaagttttctgttttgttttgtttttaaaaatgtccattaaaatgctacctatgtgggttaaaaagcctataatacaatttctaacttcaggaatatgtgacaacatgtagaaagggtatattgggctgtgcaatttaaattttcatcacctacaggttatggcataagactgatatgaaaatgaatgagaattaggttatatgtagagtcttttgtcttttgttctattactataaaatatttcatttaaaaagtagggaaaaaattactaaggtggtgaatttgcctgatataccaataagcacagttgttttggaagttgcttggtaccactgactttttgcttctttaaataagtatttctttccttagcaaacacttctctttatgagaa

SEQ ID NO: 96265 - DNA, 358 bp, Homo sapiens
gctgcctgaggatcctgtgccgacattttacagggatactttggagaagtcattgttaggtactttcatcattgtggaagcagagtgcgctgacgcagacctagacagtggagcagctgggctgtgtggtgtagacagacggtggagcagctgggctgtgtggtgtagacagctggagcagctgggctgtgtggtgtagacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggctgtgtggtgtagacagtggag

SEQ ID NO: 96266 - DNA, 747 bp, Homo sapiens
gggagctagggcttcaacctatggcttttgggggatacagttcagtccatagcagtggggaaaggatgtgactcagtctagagagactcaaggagggaatgcttagataggagcatggagggcgtgcctggtgaagggaacagtatggcacagcttcagaggcaagggtgagccagcagcaaggggctggctatggccggtacaaaaagcatgtgctcgtgggaaataggcaccaaagaaggcccagagaggtttaacaacttcctcagaatcacacagcttccaaatggttgggttgggtttacatttaggcggtcttgctccagagccagtgctcctaacctttgcaagccacgaacctcaagaaagtggagaaggaaacgctgggaaatctggaagtcagacatgcctagtttatctcccgggagctgacttcatttctaaacgtataggggtttcttagaggagcttcagaatactaatcatcgctagtgagggcacttggacactttgcttcacctcagccagcacctcttttcccagctgtaaaatggtatgataataagcacccctaggaatctcaaggatgttacgagggaaaaatatgcaataatatacaaagcactttgagcttctctgaagacagacgcatataaatggaaggtggtattataaggtggggtaatcactggttacctcccccccttttttatttaattaggagaaaaccagtaattaggaagcatg

SEQ ID NO: 96267 - DNA, 323 bp, Homo sapiens
gtaaattggtaaaagaaattgttcgcgaaactctagtaaagtcaaaactttgtatatgctgtgtgacccaactgagtataatcctatcagaaatgtgttcatatgttcatcaaaaacataaactggaatgtgatatatacacacaatggaatattattctgccttaaaaaggaagaaaattctgacatatgttacatggatgaaacttgagcacattatgctcaatgaaacaaagcaatcacacacacaaaaataagtattgtatggttgcatttacataaggtaactagagtagtcagattcatggagatagtagaatggtg

SEQ ID NO: 96268 - DNA, 544 bp, Homo sapiens
agtgaagcctctttagttcttactttttgtgctcattaagatcttagccttcttgaattatggaactccttgagaatctgatgattgttacggacctgctccagagaaatgcacacacatagtattttgcctacaatttgagagtctcttgaattttaaagccgttgcaatttaaatgcatcaggaagacttgacagcagagagtttcttgataaaaatgcagtattcctttattgctgcttgtttggttggtttaaaaatatgcgatatttcttgtcctaccctagcatttctggtgccagtatcaccaatttaaacaatctccctggtaattctaaagttcactaagatttgagaagttctgccctaaagactcagcttatcttcatagtctatctcatcttctgctcccagccacttaactcctgctacaggggttcaaactctggagtcctggttgttatctaaagggaacaactgccttcctgtagggctaaagtgaagccccttcatggagaagcactagagtctgacagtgggccca

SEQ ID NO: 96269 - DNA, 728 bp, Homo sapiens
agcgggctgagcccgggtccgagtgacgcgtcctgttggccgcggcggtttgctcagctcctggtcccgggccgcgccaactccgcgcagtgcagctgaggcgccgcccggctctgcaattccgggtgttcccgggcgtccccgcccccgccttcccctcagcaggcgcctgggcgccccccaactcctgtccagcctccttcggaccaacgacccgccccggcctccctgcatcccagagactactcgcggcgccttctctctctaattcttctttaccccctcagctcacctcccgaggagcgtccaacgggtcttgggggctcgcagaactgagccgcgaagcgcgggggaaaggcggcgagcgcttcccgcggcggcggggaggaagacgaagacttgtgcgctctcaaagttaatgtgaaaacatcttccaaacttctgggctgcagcccgaaacgcggggtagccggaaggctcccgtagctgccgtgccctcccccccggggtctgggaagggctcctaggcgcctcagagcacccggggtcggcccgcgggggaggccgcatagacgcgcccccaccctgacgaacggggaaggggcaggcgcctgcgaccccaactaaatccttcggcgcctcggtctgatgtatacacctgccacaggctctaagtgcctaagaagtgtaaaccaattccatcttcatgctgacgggacccgagtgaa

SEQ ID NO: 96270 - DNA, 305 bp, Homo sapiens
agtgttcctcccacctcagcctcctgagtggcacaagtgttatcctagacatgtcaaatctttgtgacagacatggtttcaaggcagatttataagtatttagaaaaacgttacaattttataccattaccaatatgaattctagaaggattagagatttaaattctcatcaaaagaaaccataaaaatactaagagacagtgttggtgaatagaagtaggaggagggttgaaagtccttttaaagcattacaccaaaggtgataatcaccaaagaaaaattgtgataggtttgatcacataaat

SEQ ID NO: 96271 - DNA, 750 bp, Homo sapiens
aatttctacccttttctaatataaatttttagaaattttgtttctcagatgtgaggcaaataggttgatctatttgtttattctttgacagagagactgactagagttagacagctttttaataccccttccagtcaaaaagtaacattgttatattagtatttagtagttttaaagtctgatgacataagaacagtaacaatttgttaatattcaaaagattgaaattgaaaaaaaggggtcctgcattctgctctcctagaatttttttttgtgttgaaatcttcttttccatattgtcattattgcttctttatcccatgacattaattttctggtgaggtgaccctgaatttagtcattttcgtcagtaattttagatttaagtaacttatcatgcttgttttaaagtctctctcagctcacccatgaagaaacaaattttttttcatttttttcttcaaaaatcagcaagtattgctgaatctaacaagtatcagcattcaggtttaaccgtgttatttgattgaaataaatcaaaccatggaaataatgggcactgtgtctgctcaagagtaaaattacccaatgaatgattatgtcaactggatgtcttttatatcaattgatgactttttaaaaaatctgtattttaaataaaatatggagagaacagtattggtccctacaacattccaatagctttgtcatgacagccatgtcatatgaaataacttactctgaatggct

SEQ ID NO: 96272 - DNA, 317 bp, Homo sapiens
gtgttgccactaaaacctgatttaccaaccataacctatttggggccatgctctgagcccacagtctttctgtaaccttaggatgtgtatgggcttctgtaccccactggggcttgggtcttcattctgaaggctcccgcgaatacacgttaaataaatgtgtgtgcctttttgcctgctcatcaatttgcctcatggcagtgattttcagcaaaccttcagagggccaagcggaagctctgccttggcccctacaggaggttcaggtagtggggacttcccagccttctccagatgttctcccactaccctgtcat

SEQ ID NO: 96273 - DNA, 587 bp, Homo sapiens
gtcctactgactaaatatttttttttaatcaagagacttaggtacgcataagcttcctgctaaattctgtagacaccttctatttatgggttacattatctggttgttggaattattgtgatctaacatttttcatgtatggaaactgttctatgtactgttgatctctgtagaatttgatcttttccagaatgtatttgaaggctgacctttcagtaaaagaaatgcaagcttttcagccatgttaatttatcactgcatcttctttgtaatatatatggcagttatgttaaaagtaaacatgtgtttttccttattctctgtgctcaggccatttatcatttagggacaaaaagttttatatagatcaaaagataaaaacttgggcctaaggcttagtcattgtaaggcagtgattccgactctttttatacttccttagggcattttaattaaaatccatcatgagatatgaaattatcaaactttgtataaccttttattttagaagaaagttttatatatatcttattaataaggagatactgataaatctagtaagtgctgttcccgctggggtcctctga

SEQ ID NO: 96274 - DNA, 681 bp, Homo sapiens
gtcctactgactaaatatttttttttaatcaagagacttaggtacgcataagcttcctgctaaattctgtagacaccttctatttatgggttacattatctggttgttggaattattgtgatctaacatttttcatgtatggaaactgttctatgtactgttgatctctgtagaatttgatcttttccagaatgtatttgaaggctgacctttcagtaaaagaaatgcaagcttttcagccatgttaatttatcactgcatcttctttgtaatatatatggcagttatgttaaaagtaaacatgtgtttttccttattctctgtgctcaggccatttatcatttagggacaaaaagttttatatagatcaaaagataaaaacttgggcctaaggcttagtcattgtaaggcagtgattccgactctttttatacttccttagggcattttaattaaaatccatcatgagatatgaaattatcaaactttgtataaccttttattttagaagaaagttttatatatatcttattaataaggagatactgataaatctagtaagtgaagagaaaccccctaaaatttgaagagatcactgctatagaggagcaacacagtctgtatctatggtctttggaacttggtagatgtccagtgaagttatgctgaatgaatcagcat

SEQ ID NO: 96275 - DNA, 727 bp, Homo sapiens
aaagtgcaggaattacaggctcgagccaacaggctgggacggctgcatcctgttttgacctgatcctgtttccatcagtggggtcgtgaccctgtgactggaaaataacttctctggcctcctacctcatcttcatttccatattaatagttatatccaagtagttagtgtcctgggtacaaatagttatctacagcactaactcattatatccacaatagatacgactatagtgttgagaagaatattgtttcaacttcctggattgatcaacttttcttcagcagagaatttagtgttgaaaagaacgtgactggcaacttcctgccttcaactagctattctggctatttctggttatttctaggtgggtcaactcttcaaggagaactgtaaaccactgctcaacaaaataaaagaggacacaaacaaatggaagaacattccatgctcatggataggaagaatcaatattgtgaaaatggccatactgcccaaggtaatttatagattcaatgccatccccatcaagctaccaatgactttcttcacagaattggaaaaaactactttaaagttcatatggaaccaaaaaagagcccgcattgccaagacaatcctaagccaaaagaacaaagctggaggcatcacgttacctgacttcaagctataccacaaggctacagtaaccaaaacagcatggtactggtaccaaaacagagatata

SEQ ID NO: 96276 - DNA, 745 bp, Homo sapiens
  misc_feature (442)..(442): n is a, c, g, or t
  misc_feature (647)..(647): n is a, c, g, or t
  misc_feature (650)..(650): n is a, c, g, or t
  misc_feature (659)..(659): n is a, c, g, or t
taggtttaagtcttaacttcatctggaactgattctgtggtatggtgtgaggtcaggacgttctgactcctgacatagctgaactttctcccagcaaaaatggtctctatccacaaacagccacttaactccattctttccagccagtgggctcctctacttagcgccacaagggaaaaagtccaagtcaccaatagctctcccctagggctgccctcctctctctggtctctcctcctctcgcatcagttcttcatagagcaactacagcagtagttttttcaaatgtgctgtcactctgtttataattgtcaacgactacctactgaaaatggaattaagtcctgactccttaccataatatacaatatcccatgcttctccagcctatttctgtaacactcttctctcatccactaaacctcagccacaccggccgccntttcaccctgtaggacaagcccaagttcatttctccctcaggccctttgcacttgctatttcctctgccggaaaagctctcgccatccaaactatggcttcgacgactggctgcctctcatcatttgggtaatgtcttctaagacaggccttcccagaccctgacgccatcccatctaaagtagccccacctcgacgggcgcggntanttcacgccntgtaatcccagcactttgagaggccgaggcgggtggatcacctgaagtcaggagttcagccattgcactctggcctggggaataag

SEQ ID NO: 96277 - DNA, 692 bp, Homo sapiens
acagaaaataccgagtccggtcccaggtatggagcagagctcgggaactcacataaaatactgagtccagtcccgggtatggagcagagctcgagaattcacagaaacttccgagtccagtcccaggtatgaagcagagctccggaactcacagaaaattccgagtccggtcccaggtgtggagcagagctcgggaactcacagaaaatgctgagtccggtcccaggtatggagcagagctcgggaactcacagaaaattccgagtccggtcccaggtgtggagcagagctcgggaactcacagaaaattccgagtccggtcccaggtgtggagcagagctcgggaactcacagaaaatgctgagtccggtcccaggtatggagcagagctcgggaactcacagaaaattccgagtccggtcccaggtatggagcagagctcgggaactcacagaaaatgccgagtcccgtcccaggtatggagcaaggctcaggaacttatagagcttctgcttccctttcccttcccagctacaggcacccttttcccccagcacacacaggttggaaaagagtttaagaacagaatgcctagttgttagtaattcatcacgacacctgacttaattaccaaagattattttaatggccgtgcatactactctcctagaacttctgtccttcctcccccc

SEQ ID NO: 96278 - DNA, 329 bp, Homo sapiens
caccttggcctcccaaagtgctggaattacaggcatgagccactgcacctggcctcttcccctcttacaaagacaccagtcatattggattagggcccatttaatccagtatgacctcatcttaacctgattgcatctgcagggaccctatttccaaataagatcacattcacaggtcccaggggttgggaccttaacatatctgcttgagggacgcagtttagcccacaacagttaccattccgtcgtgggcttattttctgctgggtggcagctactttatctgtcacagttttgaggaggacacttgtcattctgtgtgcctggta

SEQ ID NO: 96279 - DNA, 741 bp, Homo sapiens
gcaaggacagggatacagaacaatagaaagataactgattggttaacatcaggtgacttcaggttactctttgctgtaaggctaaaaacagagagaacttcattaacataccagctgaagattgtaattggcctgttagggaaattaggcttgctcgctcgctctctctcaaacaaggtctcactctgaagcccaggctgacatcagctcactgtagccttgacctcctgggctcaagcgatactcccacgtcagcctccctagtagctgggactataggagctcggcaccacgcctggctaatttttgtgtatattttttgcagagacagggtttcgccatgttgctcaggctggtctagaactcctggactccagtaatccacctccctcagcttcccaaagtgctgggattacaggcatgagccaccgtgcctggctaggctatctctcttgatttctcaagtcagataacaactcagtttcagtttagcgagcatgggtgactccatcttgatttttggtcttgtctgttgggacctagtgctggagtttagtacaaagcaatggcctcctatgatttttgtttagcagagcagggagtgaatactaggtgaggatcactgatggtcatcttggaggtggctagtacaaggagtggaaatactttcatattttgagcacttattctgtaccaggcactgggtacagcagtttttatgtattatttcctttttttttt

SEQ ID NO: 96280 - DNA, 403 bp, Homo sapiens
atttaggtccttaatcgacctggagttgatttttgtatacggtgagacataatgattcagtttcattcttctgcatatgatagtccaattttcccagcacccataattgaaaaattacatgccctgtaatctcaacactttgggaggccaaagtgggaggatcacctgaagccaagagtttgcaaccagcctgagcaacagtgatacactgtctttaaaaataaaaataaaaaattaggctaataaaaaattagcctaagccaggctcacatgtttttaagcattttttttagcaataaataatttttaaattaaagtatatacagtttttagccataatgccattgcacacttagtagactacagtatattgtaaacataactttatatgcactgcgaaact

SEQ ID NO: 96281 - DNA, 704 bp, Homo sapiens
attagagttagtaggataggttagcaaagttgctaaagttaaactgagcaaaaataatatggtagccccctgccttcatcattgggtggtacattccaagatttatcctggttgtcatgtgtggcagggattccttcttctttctggctgaataatatttctttgtataccacattttctttattcattcatctgttactggatatcccttcaattggcaatgtacatgcacaactccagagaagaaacatgcacaagagaggatttgagaggcctgtggagtttctgtctgggctgattggtgggggttttctcctgtaaaagactagttcatgaagaccaggaaaggtggttttttttactaatatgcatgtaacaatatagagacttaagggaaatgaagaaacaggtaaattatggcccaaaggaacagatacatctccaaaaactaacactaataaagagatatataatttacctaaattatatataaataaaatagcatctttatggcagataaattaaaatatcttccataaagatgctcaacaaggtcaacaggataccaaggtcagcataaataaactgaggattttaacagaaattctatgaaaatttaccaaacagaattttggatctgaagaatgcaataactgaattgaaacattcactagaagatttcagcagcagactagattaggtta

SEQ ID NO: 96282 - DNA, 987 bp, Homo sapiens
tttttttagacagggtctcgctctcattctgttgccctggatggaatgtagttatgcaatctcagcccactacaacctccacctcctgggttcaagcgatcctcctgcttcagccagccaagtagctgggaccacaggcgtgtgccaccacactcagctaattttgtaattatttgtagagatggggtttcactatgttgcccaggttggtcttgaactgctggctcaagccatcctcccgccttggcctcccaaagtgctgggattacaggcatgagccaccacacccagcctcttgagaatttcccacgccttttaaaataactgaagtactctgtagtatcattaactgggtatgataatcgttgtacaaagggttttccaaataccttatgagctttgtagttatagcatcagatcctacgatcttgttttccctgtagtatcaagggaaaattagagtttaaaagatccatttctggtcatagtgagagtgagaaaaataaccaaaccttacccacatctccttcatctaacaggttttgtttctaggaggacaattgcaaatagccactttactactccccttcctctagtttagtttccctccatttcatctttctcattgttaacatagtaagctctatttttaaaatatttttttaaatagagatgagggcctcactgtgttgcccaggctggtctcaaactcctgggcttaagtgatcgtcctgccttggcatccctgggtgctggggttacagttgtgagccactgagccaagcctaaaaaatctttgacattgcaccatagttaggcaagatgtttgcattggaggaggttaagtgaaatgtgcagaggacctccctgtgcatttctttgcaacttcctatgaatctataattattttaaaataaaaaggattttaaaaatcagataatattttgcctttgcttcagaatttccattctccattatctatggcac

SEQ ID NO: 96283 - DNA, 840 bp, Homo sapiens
taaagacagagtctcactctgtcacccaggctggcatgcagtggcacgatcttagctcactgcaacctccgactcctgggttcaagccattcttgtgcctcagtctcctgagtagctcggattacaggcattcaccaccccacctggctaatttttgtatttttagtagagacgggctttaccatgttggccaggctggtctcaaactcctgacctgaggtgatccgccccactccgcctcccaaagagctgggattatagggcatgagccactggacctggccaggggaaaataaatttttaaaaaggtcaacttagaccaataaaaaacaggtttttactaaggatctaagtttttaaattattttaaatagttcgatttacagaaaaagaagctatcaatggagaaaagtgacttgtgactcattacctacagcaacctttctatgatttccactggacccctgcactacatgacaagtatacaaattaaggatgatgtaaattagggatgtatttttttctaaattaatatactcatggtcaatgaactaatcataacatgtaagttttgataacatcaaatactatatcctttctgtacataaacttttaaaaatttagttctgtaatatcaatttttcattagaaaaataattttttaaattttaagtgagatttctgatttatttaataatagagttccacaaaagtaaacttactgtgaaacacagattattaaaaagaaaatgtagtagccatatatcccagagtagaaggctaatggaaacagaatcaaatgaccatgtgttatagcataatttctcagataatgattcc

SEQ ID NO: 96284 - DNA, 837 bp, Homo sapiens
cacgttgtcagcaggggctggcttcagactgaggctgaacacatacaggagcccagaccaggtggccttggcccttgtaggcgatggtgagaatactgatttgtattaagaggaatgaaagatttggagaggaagcaattctgattttcaccatcaaatgacaagaactgatcttctgcctttaagtagttataattaggtcattgcaaaattaacaaaattaataagcttatatctgggagacctcttaagacagcagtgtccagctgggtaatggcacggattatgcccacacagcctggccactctgttgggggagcagcccccgctggagcagcctagggagaggatgcaggccttccccatcagctcagcagcttatggctcagtgggtttagatgctggtagtaagctcctcaccctcttgcccaatgtctacaaagggttgttttgttcatgatgtccagaggtctagttgctcatgacaggtggataagtccagtgactccactggggcctgaggcagaattgttgcggcacctcctcgtttctcccgttccctcccctatcccaggcaggtcctggctaaagacgtccttggccagctgggtgtcaggggtaggatcttgcccctcaactcctggccacagggggactttctccttatctacagcccaggccaatagtctctttctctgtccttaagggatttagggaatagccggtcctctctcaccctcgaatggatcacatgttattgatctcatgtgtcaccacccagggtaggtttctgtggcctgcatccaactccaggcaggcgctgctcctcgtctccca

SEQ ID NO: 96285 - DNA, 269 bp, Homo sapiens
cagatataatttttacatatccaggagacatcttaaaattaacttgccctagtattcaagactatgcgtgttggtgtaaggatagagatatacagatgaatggaacagggtaagtgtccagaagtagactcacctgtgtgtggccagttgatgtttgataaaagtgccaaggtcattcagtggagaaaagatagccatttcaataaatggtacttgaaccattgaatatctgcctgcataggaaaaaaatctcaactgttacatgacac

SEQ ID NO: 96286 - DNA, 668 bp, Homo sapiens
aagttacagccaacaacttcctgaaggaatgaatgttggataagaagataagacagcaagagtcaagaatgactccaaggtttctggcctgagcaactggaaagctgccaagaactgagatgaggaaggctatgtggacagagtaggtatgagagagcaggtttgggagggaaaagcaagaattccattttggacatgttgagtgtgagatgtttaagagccattcaacataggcaactggatataaaaataaggagttacggagagagatctgggctgaaaaaattcatttgagagaaaaatattcaaagccagattcccaagtgcctgatcatacctcccagtctcaggaagatatttgcttaccccttagaccaagaatcttaagatcttccccagctatgaagcctatcttggaatgggaaaccatgaaatttgtcttttaaaagaaagggaagaaatagccttacagcccctgttcctccaagtgcacatttagccttaaaatcctgggagtcgggagacaccgtggagtccttacatccacagtgtctgctggtcgtggtcagaaggcagtaatgcaagagtccttttgtgaagagtgtttctatgtagagatgtttatatttaagtagttcttttataaataaaagcatttctaatggcaa

SEQ ID NO: 96287 - DNA, 386 bp, Homo sapiens
gaaaccctctgaaattcagcatctatttttcttaacaattaataattattattcctttttatacaatcactcctttttatacaaatcttaagattttaaaaattttaaaacttaagcctactacttaaaagaagtgttaattgtgagtacatacatatatgtgagacgttttattttggaaatgagaaattcaatttcaaatattcaacaaatactaataaaaagaaaacaactgagtaaatcttattttagttataattgtgaaccaaccggtagttacaatggtctttaaatattgaaacatactattttcaggaaatttacaaaggaaaacaggcttttgaaaaccatattgattgtagacctttacttattatgaaagacaa

SEQ ID NO: 96288 - DNA, 259 bp, Homo sapiens
cctgactttcccgacctcacgccactcggagattttctaatctgtggctttgccacaaagctccctcctgcctcttccctgacccggtttcccccgtggtccctgggcccacctgcgctagagcacgccacagctaccctgacatccagggctccttctctgaatgcactcactcacagttggtagaaaaagcctctggcactttctcttctctgttttctttcagcacatcacacactccctgatggtggaggcttta

SEQ ID NO: 96289 - DNA, 346 bp, Homo sapiens
ccgtattgattttccaggggttctttgtatacagtaatttgcaggagttgtttgttacaaactttataaatatcttctcctagtctctcttaactctgtgctatgatactatttaataacctgggggttttgtgttagtttattatatattgaacatgttccatgtctttaaatatttatttgtttttactacataattttaatggtaataagctggtatttgagaaattgtttcacaaacaaacattaatactgccccctccagcctcatctctcatttccccatctgtgctccagccatccccaggtctcagttgtcttatttgtctgagaacctcagcctggg

SEQ ID NO: 96290 - DNA, 669 bp, Homo sapiens
attagagcttaagcaatgaacaactgtggatagtgttttagatcatacaggagatcccataaaatagatctggagaagaggattgtgtggaaaactgtacctaatgcattctccgggcagttattgaacttttttatagtatgcagaaaaatacagcagaagagagaggaaaaaaattaatgaccctgctgttggaaataaaaataagatccagaccagtgacattctgacatcttaaaaacctgtcagtgatatttttagctgctttaggatccttacaataaggcccatgagtaataggattgtgagggtttttttctttatacataattttacagatattctttaatgggtgtgtattacatttagaatcattattaaagagttatttttaatccatgggagttttgacacagcacatgagaatttctaattatagactcatagaaatacatacctcttaaaaccctatcttcttgttttacagatcaataaattaagtttcagagaagttaagtgattgccatagaacacaatgctagtgactgaattttgttaactaacatgctttcatttgcattgttggttttctcagtaacaaaattacaagcaatactgctttatttcagaagtgaaagaaaatctattggaagtgtggagcaagagaaa

SEQ ID NO: 96291 - DNA, 264 bp, Homo sapiens
attcagcagccttttatttttaccattcccaggtcttgtaggtgacaggtacaggtctttccatcataaatataagcaggcattttctctgggatcttaggcagggacatcttggggtacttcacttaaggattttctgaaggaaaaaggtttaaccaactggaacccatgagtacttccttgagctcctgacctgtctgggcaggacccccgtgttctactccaacttcatcgatcattcagcaggttatccatgatagttgt

SEQ ID NO: 96292 - DNA, 879 bp, Homo sapiens
  misc_feature (5)..(5): n is a, c, g, or t
cgtangctgcagctggcttctcttaaacttctttcttcgcacaaagcaggccctcaataaatgcaatccttagtaaacttttgttttattctgctacttttgggaagaaagaagaaaaaaaaaaggaagaaaggaagcaagggagggtaagaagcatgaaagaaagctagctaactgcattactataaaatggcgacagatatttttaaaaacatattttaaagattttattttataaaagtaataaaaaatgtaaattgtctagtaaaaaacttaacaaaaaaacaaaccacaagacacatgtaaaaacaaggaactaaaggaacgtaagagaagggctaagtagataattaatacaccatgtttcatgtagggagatttaatattgtaaagatgtcaatctctcaaaattgatttacaaactcgatgtaactccagtcaaactccaataggttttcttcataaaacttgacaagccgactttcaaatgtatgcagaaatgcaaaacagcagaaacaaagtaaaacactaaaagaaaaggagaaataatttggccttcacataatagaacttactataaagttacagtaattcagaatgtgtttcttgtgtatagatagataaactgaccaacggagcaaaacaaagacccataaacaactatataagtatcaattatacatatatagatggcatgtcagattaatgggaaaagaagagtctattcgatgaagaaaaacattggttatcatatgcaaacaaaatcacgtaacatccttgtttcaaaccaccccaaaacattagttcctgaatagttaagaacttaaatatcaaaatcaaaattcaaaacttttaatagaacataatatattaatcttt

SEQ ID NO: 96293 - DNA, 359 bp, Homo sapiens
gggaaatatcacatctgatggagtcgcctgggagctggttgctgtgccgtgtgtgcggtgacaaggtgggaggtgagacgcatgggctagaatcccacccacgctcctggaggccatgtgagcaggggcctccctcatcggctccatttcctcaactgatcagtgagaacagtggctccccggaaaggtagaagcaggagaaagcctcagcctcgaatcccgagatgagctggagagccgctgagagcagccgggctcccctgcatgcctgcggttcttctctgctggtcactggggactggagcaggctaggcagggcaagagcagagcctctgggagcaaatgcacaacatcacagg

SEQ ID NO: 96294 - DNA, 532 bp, Homo sapiens
atcctacgtgaggtggctgacactggtgagagctgaatttcagggcaggctgcgatgggtatgcctaagggtttctgacatcctttccgttagggaggaggcagcctcgtttttgcagcccgagtcgtgggagctgcccgtgtccatggtcatgagaatatgaacttcgagaacatctgacctgctgccacctggccagtgtcctgcctttgaggagtccaggatttacaagcctgctgttctcaaccttgtttggcactaacacacccgagaccatcagtaacggtgggtctgcaaggcacagatcttcaccagggatccttggggagaaaccaagcaaactatttcctgacactagacaggcgtatccctccctttgagaaaattcactttctaaaaccataaacaacagctggttgactcttttgttaaaaattttccttttttttcctttgtgtacacatttaattttattgtaacagacaactcgtgcacttttaatgtttaaaactgagcatcatctttcctttcc

SEQ ID NO: 96295 - DNA, 654 bp, Homo sapiens
agcggaggatcaagagtcaggcaggggcagcagcccacgttcagctggaattctgtggcttaacccaggggttttctatgtgtcatgagagataacacaacactctcaccaacgaagttgaataaattatatttaggactcacaagctgatcatgattcttggctatgcaaacctgaggctgatgcatcctccagcagctgaccacggacatgtgcagcatcacagtgacagatggcatttcaaccacttggtttacaccttcctccactgtcaccaccattctgacagaaatgagttccatttgctccattttacataagggcaaaaggcagcattgactcaccaagtttacacagttagggaaaagagcaaccaggtcaggatcagatacaacaaagaagtgattgcagatgttaaatggaacatagctctggtcgtttgataaatattcagtaatttcttcagtttgttaagaaaaattatccaaaatttacaattacagaggaagcaaaattttacctgtaccctatttttttttattctggggctaagaattaaattgacttaagacagacataagacagatcaacagcagaagaacaaatttacttaatacaagttttacatggcaggagagactacataaggaaatg

SEQ ID NO: 96296 - DNA, 484 bp, Homo sapiens
ttggtagagatggagcctcaccacgttgccacgtcgcccaggctgatctcaaacgcctggcttcaagtgttccttccaccttgatttcccaaggtactgggattatacccatgagccacagtgcttggcctgaatgtagctcttaatccatctggatttacccctgtgtgttctggcagagattggcaaactgctttatcaaaccaattagtatacaactaatctacattttccaacccctcttgaagttaggtttgggtcatgtgacttaggaattgcttaatccttaagtggaatgtggatgaaaactatctgagccatttccaggtgtggcccataaaatctcatatctcccactcattttttatgtcttagatggatgcctacctttttaagatgaaggagtaattatcacaattatcagcctaaataacgccatttggacttaagtgatcatcaaataaacatccgttttgttaaacca

SEQ ID NO: 96297 - DNA, 336 bp, Homo sapiens
cttgttgcccaggctggagtacaatggcacgatctcggctcactgcaacctccgcctcctctgttcaagcaattctcctgcctcagcctcccgagtagctgcgattacaggcacccaccaccatgccccactaatttttttgtatttttagtagagacggggtttcaccatgttggccaggctggtctcgaactcttgacctcgggtgatctacctgcctcagtctcccaaagtgctgagattacaggcatgagccatggcaccccgccccacaggtagatatttacataaaactcagcatccagaccctaaggtcgagcccaccctcaagtcttt

SEQ ID NO: 96298 - DNA, 347 bp, Homo sapiens
ccaactcaagatcctctgatgatcaattttataaaaataaacaagaagttcaaaggataaatttgagagatagccaagtattctctccagcttcattggttgtactactgaaaacagagcacctctattcttacattaaagaacttcaggccgggcacagtggctcacacctgtaatcccagcactttgggaggccaaggtgggtggatcatctgaggtcaggtgttcaagaccagcctggccaacacggtgaaacgctgtctctactaaaaatgcaaaaattagcctggtgcacatctgtaatcccagctacttgggaggctgaggcagcagaatcgcttgaaccc

SEQ ID NO: 96299 - DNA, 253 bp, Homo sapiens
ctctgtaccccagcgccactatgcctcatacggttgttgtgaagattaaatgaaaaaatggttacaaagcacttagtatggcttgtgttttacagcctcatgttaaaatgagaaaaggtgattagctgagatgttagacacggactgtcccccctattaagatgccttctgctgattaagtccctccctcattcctcccaagctcagggcaggggctttgcaggaagaggttaatccagcaagtgtggtttgc

SEQ ID NO: 96300 - DNA, 527 bp, Homo sapiens
cttgcttttttttttgtgatagtgcagaaggtcctgagtgccttgtggttctttagagtcatggtcataatcatccataatcattgattattgattaatggtgtctgaagctgattctattttgacttaaggagacccttttatggacaaaatatcacttaataccttattaactttaactgtttccttcaaaatcaggagtcccagcaactgatgactagataaaccaaatgtagtatatattcatacaatgggatattatttggccacagaaaggaatgaagtgctgatgcatgctacaacacggtgaatctagcaaactacgctatgtcaaagaagccagtcacaaaagattacatattacatgattccatttatgtgaaatgtccataacaggcaaaactatatagagggaaagtagattagtggttgcctagggctagagaccctgtgaggattggagtggttgatagctgaagggttcaaggtttctcactgaagcgatgaaaatgttctaaaattggtgg

SEQ ID NO: 96301 - DNA, 1536 bp, Homo sapiens
ctccggccgtggcggtcgcagcgccggcagctcgggcctcagcccctgcctctgtggtgactccgccgcgcttcgacgtcgcccctgtccccgtcccgtcgcgggaagatctacgatggagatctgaaaggacagcgagagagcatgtccaaaggcactgaaggagcaggaagcaacaggagttgttaaaggagggaagaacgacagaagatggtggaaagcggagcaggagagaacgatgaaagtgcgcaagacagaacgagaggggagagcgagactgggaaaagagcgctgacactgaacacgaactgggcgcaagaggcaccacgtgaaaacgacgcaacacaacgtgcactgaacacacacagactaaatgcagcgagagaaccaagcctcgcacaccaacatatcgagggggcaccggacacgatacagcaggggaacactaacgtcacggacgcagtaacaccggcggagacaaacaaacacacagcaccagtgcacagctgacacaaagcgacaaactagcaggacacagacagtactcacattgaagaagcccaataacatgggtacacaccagagacacggcatacacatacagattaacaagtcagacagggggagatatctggagggcaagtggagacacaccggaacacgcacacccgaaataaacagaaagacatccaacagagcaggaccacggagcaggcaaatgtccaacggagggcgtcgctcgacgaccagaggacaaccagacagacgcctccaacgaatgagccggcggcagcagaaacgcaggagtacaggaaacgaaagcaaaagtggaacaagggcgtgtcggcagagaccaacagcaaaggaggtccccccgctcatgagtcagcacacaacacagtaggacatgacatccacgcgtgagcaacaccacacatacggcacaaacaggccatcacagccggggtcgcacacaggcagcagccggccaacagaaacaaagtgagcagcacatcgcatcatccgacacagccgggctaacaaccgaaccgcgaagcaccagcatcccacgcccagagagggagcatggactacacgcacaaaggagcgcacgcacacaccaacaagcgaaggaccaactagacaaccagcaccacgggtgccacacccaccaccacgtgggagaccacaagaccccagaaagcgctggaaaaccgagcgagaccaacagacgcacagcaaggacacaaacaaggcagcacaacaccagagcagcaggaaacgccagaagaccacagaacaacagcggagccacacacacgaccacaagagtacgacactcaccaacaacggccacacaacgactaaccaccgaacgtcacgcgcgcacaccacccggacgcagagacacactcaaatacacaccaagccgcacagaccacacgagaggcacacgacggaacaggccaggccacacagacacagcacaacaccaccacagctaacgcgaacacacacaccacgagcagccacaca

SEQ ID NO: 96302 - DNA, 730 bp, Homo sapiens
gcccagggatgcccgctagagactcagcgccctgggtgtttactgggggcaggtcctgtcagcgccctctgccaggcaggtacctaaatccccgactcccagcagcagagcgggtgctcacgtcaaccacgttcttcctacaaatggcctaggtgcagggaccgacctgaccactagagaaagtgtcactgtggcaagggaacttcaccagccaagggccaaccttgccagccggtggcctcaggcctgctggttactctcttttgcaaaggggtcttggttcttgtgagtgggaccattgggtcaaagggcagggaggtttctgtggttctcattcggtcctgcttctgccctccagacagatggatcagctgccaggggggccccagccatcccagcacagtaagcggtcaaggtgcacttggggcagccagcagggcagaggggaggggagcttgacccaggctctgatgggcagagggaacccgtgcagggtgtgggggcagtatgcaggcaggcgcggaggggagagccaagcagccaggcctgccaggcagagttggggtgactggagaagggccgtgtctgcctgtggccagaggccacccaggacctggacagatgcacccaccattgtccctgcagtgaggctgtggaagggcttggtgtggtgggatgaggccagaccctggaaactggaggttaagggagctgtaggggggcaggtgtg

SEQ ID NO: 96303 - DNA, 894 bp, Homo sapiens
cggatcgcgtgggtagaaggtcacaccgcagcggtcagtttccctttgtttagattcaatctgggcttcccagctcccccgcgcttctgtacccgggatctgagagtcaacacagaccttgaaatccccgcaccgctccctccaccccgtgtaaattcaggcgtctccgtgagagtccggcgctcgcttccctgtgtgttaaaatcgctcggcacgggtcctgtccccgctcgttctgccttgggccagacacaggagtgttgccatgttgtccaaactggtctcgaaattctggagtcaagcagtctgcctgcctcgttctccaaacgtgctgggattacaggcatgagccacttacgcctgggccaagtatttcggtatttatcaaaatcttacagttagttacacagttatgtcgtaggccatcacattcggtcaccacacactcactgactcatccagagcaatttctagtcctgcaagcgccattcatggattgacttataaacagtcatgctatgtgatgaagaagcccagaagaggaaagcaaaggagtcagggatggctcttcctcagggacgcttgacattcatggacgtggccatcgaattctctcaggaggagtggaaatccctggaccctggacagagggctttatacagggacgtgatgttggagaactacaggaacctggtctttctgggaatctgtcttcctgacctaagtattatttccatgttgaagcaaaggagagagcccttgattctgcaaagtcaagttaaaatagtaaaaaatacagatggaagggaatgtgtcagaagcgtgaacacagggaggagctgtgtattgggaagcaatgcagaaaacaagcctattaaaaatcaacttggatta

SEQ ID NO: 96304 - DNA, 402 bp, Homo sapiens
gaaaccttgttgactcagaaatgaaaagctctattatgctctctggatttgaaatgcgtcctttcttcagatgtaccgcccccttcataatacatcattgggtggcaccggataaccagttctctgttttctcccctgtgcttacaagtcagtagttcttggaagagatctcagtgtctacatattgcatattccctaagcattcagaaggagccagtctgtgggtgaacttgtgagatattattcttgatccatttgcgatatcccctctcttacctaaacacagggtttgggttttggaaatgccccagcacatcttgtttctttctttttattaacaggaatctgtcttcctgacctaagtattatttccatgttgaagcaaaggagagagcccttgat

SEQ ID NO: 96305 - DNA, 853 bp, Homo sapiens
aaccttgggaaggacgaaatgaggcccgcaaactgtgtctggggacctgtggggtggtcttcatgaaacgcccgccatggaaggctttcagctccaagaaaggcaccggcactcacacttggggggctgatgattgccactgtccaggaggctaaaggaagaaaggcaaccaccatctcttatgaacaggacatacatttccaagacaatgggtccagaccagaagtgcaggctgtgcccccagaacacatggaagttgcatacaaacgcagaattagaccacatttaaaacgcggtggaacttggctgatttgctccctcttggccgtccatttgaagtgtgcagtgaggaccccaagtcctgatctcatcattcaagagatgttaaaatgcctgcggtgaatctgactttaatttaccacgactgctaaaacagaggctttggaaacgaaagcagtagcaagtctcccatgtgaggccagagctctcgaggggcatttagcagcagcagattttacgtgtatgaatccaaaaaaattaatgtgtcttaaatatttctagcaaccttccaggttcccagttcatggctcagcaggagaaaggcaaggggctcgttcattcattcattcactataaaaggattaaaatagacctcggtttttctggcttcaacccttgcctcctttttcctttttcttttttcacccctgccccaccccctacttttttttgttacctccccttccgtgaaccctgactaacagacaacccacatgcttataaaaacagctcttgaaagaacagttctgacagttactggaatgagattgctccagtgctcccaagcaggagg

SEQ ID NO: 96306 - DNA, 536 bp, Homo sapiens
ggtctaaactgaagcgcactcgactcagctgctgcagactgtggccatgaaggaggatgggcctaacgttggctggtattctaatattttcacaagacatgtaaagcttttttaaaaaaatacatgtggccgttaaatcgatcaatttttaaattttggtaacattcaggtttttaaaaaacagtctgtttagctgtcaaaaagaaaaaaacatgagttcatctagaaacctccaactccagtccagtctaactctccttgtttcttctttctcctgtagtgaaaaaccttgctcttgttgtctacaatatgtttacttatctgttccatcctagtatacaagtaaaattgtatttgcataactttagtatatttcctctaaatatttagtacttacaaagaggaaatattggagccgtaagtaatatttagagccataagtctaggcctggtgtggtagctcgtgccagtaatcccaacacttccggaggctgaggcaagaggatcacttgaaatgggagttcgagaccagcctg

SEQ ID NO: 96307 - DNA, 712 bp, Homo sapiens
  misc_feature (453)..(453): n is a, c, g, or t
gaatggctctgtgtgccttatggatgtggccaagcgtgaaatcatctgtgcctttgcccctccgggagcctttcctctggaggtcccctggaagccagtgtttgctgtgtctccagaccatccatgtttcctgctccgaggagactattcacatgaaactgcgtccaccgacgatgctggaatccaatattctgttttctattttaattttgaggcctgcccactcctggaaaatatctcaaaaaattgtaccattcctcaaagggacttggataacatggccttcccccaagcactgccactggagaagagatgtgagcgtttcctccagaagagctatcggaagctggagaagaacccagagaaggaggaggagcactgggcccggcttcagaggtactccttgtcgctccagagcgagaacttcaagaagtgaggctgccaccgccctgngatctctgaaaaggaggtttcagccacgaggcagctgctcccaggacactgaggccaagagaaatgtaacagagccacagctccacaggcctgcactctgagtctggggcctctgcagagccagcaaggggaaaagtataatctgggggaccttcaaccactaagcctcttgtcagagccctcaagcaggcagatgtgtcacccaataaacagtgatattgtctccagaaaaaaaaaaatcaggcctgttggccttaga

SEQ ID NO: 96308 - DNA, 296 bp, Homo sapiens
tccacacattctatcttaggccaagttagtcttggtctagttgttttaggtcattgcatttagccagagtgtgagtgagcactgtagtcacctaatcgacagttttgggtagaagttcctaacatgatggttgcccacatcaccttaccccctttgaatcaatgactgtattctcagctttttccaaataggaattctgagatttggctttaattggccttgcccacttgtgttctggtaattagcaattgtaaacttaagttatattggttaaagaaacccattgcaggccaggc

SEQ ID NO: 96309 - DNA, 198 bp, Homo sapiens
tgctctctcatcttagagttccaaatggagaattgatcccttctagccccttagattttcactggggaccctgccacttggctcagagtctcctctgcatctcaactctgcagggaaggcatgtcaatatccgtctggtcagcccacccaatgccctctgagttctttgacctcctccgcgccagtgacctctactct

SEQ ID NO: 96310 - DNA, 311 bp, Homo sapiens
aatacatgacctgatgtgtttgtcaaaacctgtagagctttacaacataaagaacaaaccttcatgtatgcaaattaaaaacatcatttaggaggtcaggggattgagtctagaaaagaaatggccatttctaggactggggaagaaaatatgcaatatgaacctgagcagcctagcaacttgtagtgtcaaaaacaaagaagtgctcaaatttttttttttaaaaaaatgacaaacacattgatgtatgttaaaagaatgcaagagtcaactgaaagaactcttagtagccaaagctggaacaatttgag

SEQ ID NO: 96311 - DNA, 452 bp, Homo sapiens
acaaacaaactggttgccactcacttcacgacccaccgatgaatctcacttgaaagttcttgaaaaacaccaccgtgacttatctacgctaggaaggagaggaacgatctgcctaagatcacatagccaggccaagcagaaactcaagtccaaagccaaagggaaactcagtgagaggtggggggtcggggggagtgtcccactccaggcaagtgagactcagctgtagcaacccaatcacctgacacattcatctcgtggtgtttacatcatctgatcccgccagccttggcaaagtgaagggtcacgcggcccctccccctaaaaaaggagagagcctcagaggctcagggaggctaagtgacttgcctaggtacagggtttcccgggaacatccctgccgatgtgcaggggcaagagcacaagaacgaaagaggagcccaccttcctca

SEQ ID NO: 96312 - DNA, 115 bp, Homo sapiens
acggcggcggctccgcacgatccccaggcagctgtccgcccccgggcggggctggccgcacgccgcaatcctaccggctgctgcggctccagcgggggcggcgggtggcttccag

SEQ ID NO: 96313 - DNA, 399 bp, Homo sapiens
cgtgtatgtccccaagtctatatgttgaagccctgacccccaatgtgatggtatttggagaaggctcctttggtaggtaattagatttatgtaattaggtttagatgaggtcacaagtgtggggtccccatgatgagattagtgaccttataaaaagagaccggagtatcctataacactgtagttaaatatgaacagaattaacaataatacatagatttaaatagctagaatgaagatattgaatggtctcaacccaaagaaatgatcaatgtttgagatgatgggtatgccaattaccctgatctgatcactgtccatcatgtgtattgcaacatcactatgtaccccataaacatgtacaattattatgtgtcaattttttaaaactaaaaagtt

SEQ ID NO: 96314 - DNA, 381 bp, Homo sapiens
gcggtggttcttttccccacgtgttcagtcactgtcttccctagcagggaaacctttcacatgcacctttctcacggtgcttcagggcagtctttcctgcgatttgacatccctatacaagcctcaagagactgcatgcagggctaggcttttagctatgtccattcctttaaatctgcccctccttggactcccctattccctgagacacaacattattgaaattaggccagttactagccctacagtggcctctaagtgttcaagtgaaaggaagagtcacacatctctcactttccatcaaaagctagaaatgcttaagcttaatgaggagggtatgtcaaaagctgagacaggctgaaagctaagcctcttgcacca

SEQ ID NO: 96315 - DNA, 432 bp, Homo sapiens
gcctcataaaaaatataaaatttcccttttccttgccgatttcttttaaacatctgtgtaaatatgtagtttagttcaactttgtatactactctgttacttatttcatttacttaaagatacttatttcatttacttaaagatacacatggctgggcgcggtggctcacgcctgtaatcccagcactttgggaggctgaggcgggcggatcacgaggtcaggagatcgagaccatcctggctaacacggtgaaaccctgtctctactaaaaatacaaaaaaattagctgggcgtggtggtgggcgcctgtagtcccagctactcgggaggctgaggcgggagaatggtgtgaacctgggaggcagagcttgcagtgagctgagatggcgccactgcactccagcctgggcgacagagcaagactccgtctc

SEQ ID NO: 96316 - DNA, 554 bp, Homo sapiens
tcaggcatttatggcataaactcaaatgttctcttctttcgatttcctggaatggtgaacatggagtgtcttaacttgtgtattgagcatggtttaggagtctgttgtcaattttacagtcttttgacctctatatatttggcatgctgagcttcttgccattgatctaaagtaccaggcccattcatacacattgtatactttccacaccttgctgagaattctcttccctttccttttcatctgaaaaattcccactcagttttcaagtaccaattcacatgtctccagcagtgtgaagctttacacttccttttggccggataagttgctcattctgtcctccttgctcacatggcactttgtcagcttctctaaattgtactagccaaacactgtcataatccatttacacataagtctctcccaaaaggtcaatttctgagggtcagggaccatttccagctgtatttctcctccttccctggctcattccctatttctcctcacttccgcttctccaagattgtatcccaataaaatgttagctcata

SEQ ID NO: 96317 - DNA, 768 bp, Homo sapiens
ggtggaaagctaaggcctttgaagacctgggaccccgtagtttcgggagagggtgaggggtgaatggtgctgaggtgcgaggagagggaaggacagtaaagagcaggtgggcaggagggtctccgactccagagacctgagcttttggggcgcgggtgggagcgcgggggaaccctcaagacggctttcttttggcgactgagggtttttctgccacaggaagctgggccgggctgctgtgcctgggaggagggaaggaggaatgagaaagcggtgacggtccctgccccccctcgccaggtgactgtcccacccatttagttgaatgtagcggccagagaggcactcgcggcagcccgtacgggtgggacctctcggtgtccttcgggaaacaggaggagcaagttcgactccagcgagggaaaacggagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgttattatctggaagtcattgttaatctgtggtggaaagtaatggctaactagacaatctgggcagaacacg

SEQ ID NO: 96318 - DNA, 266 bp, Homo sapiens
ttgacctcatatgtgtgcatgttacgcagttaagaatgatacaagaggaaatagcattaacagccagattttatagtataaaacaataggactcataggatttttaagaaggaattgatcagtaggggctgaagtagtaagggaagatgtcatggaaaaaatgagattcgatttgaccttgtataaaatttggatgtgtggtagggataaaggagaacccaggtggaaaacagaaatgtttttagggaactgtgagcatggcattt

SEQ ID NO: 96319 - DNA, 725 bp, Homo sapiens
caaaaaacctactgatagcatcattagtatattaaagatgacagactgaacactttctcccaaagactgggaacaaggcaagaatgtctctccctactgtgattcaacatatcattggaacttctagacagagcggtaagtcaagaaaggcaacaaaagtcatacagattggaaaggaagaaataaaactgtccctattttcaataacacaattatctacaatgaaaatcccaaggaatctataaataatgattaccagaaaaaaatgaatgaattcagcaaaatagcaggatttgtgatcagcacacacacacagaatcaacgcatttctgtataagaacagcaaaaatttagaaatcaaaatttaaaacacataccatttataattgtttcaaagaaaattagattcttctgcataaatctaacaaaacatgtacagaatctgtatactgaaaacatatgggatttgtatatgtaaacatgcagatgaaagaaagaaaagatgatataaccaaatggaaagacataccatgttcgtggatcggaaaactcaatatggtaaagatgtcatttctccccgagttgatctttaggcttaatgcagttcctatcagaatccaagcaaggagttttgtctttgattttgtctctctagacatacataagcttattacaagatgtatccagaaaggcaaacgacctagaatagcttaaaacaatttaaa

SEQ ID NO: 96320 - DNA, 205 bp, Homo sapiens
gacagacctcctaatggatcagctgtgtgtgcaagaggagaggagtcggggcagcacccaggtgtagctgcagcaaagagatgaggcagccttgggggggcccacacaagtggcaggtagcacaggcctcagtagctcactgtagactgagctgtgaggtgaccatgggacagccaggtacaggagatgtggaaggagcacgggc

SEQ ID NO: 96321 - DNA, 213 bp, Homo sapiens
ctggacttttgttctattccaatgacttgttattctcttcatgtgccaattctataatgttttaattagtcaagctttgtctatgttgtaatttctggcatggcttgttcttctctgctttatcaaaattctcttggctattgtttaaaaactaagctgaaattaacataaaatagacatgtgcaggtttgttataaaattaacaaatgaaaa

SEQ ID NO: 96322 - DNA, 317 bp, Homo sapiens
ggaaaaggccttgaaggcatttcatagctccacttcacagcactaattttgtgtacaatcataaagaaagaggtgtaattggctcacggttctgcaggctgtaaaggaagcatagtggcttctgcttccgggaggactcaggaagcctcccaatcataccagaaggccaaggggcaaggaaatgcttcatgtggcagcagtagaagcaagactgagagaggaaagaggagcccgccctgttatacaaccagatctcatgagaactcagtatcacaaggtcagcatcaagaagatggtgcttaaccactggtgaagga

SEQ ID NO: 96323 - DNA, 774 bp, Homo sapiens
tgcagttccttatttggtagcttttgacaggactagcctttcttgcaactaagcatcttgacatacattattcattaagccctggagctcgggagagaaagatgcagacccttagatctttagatattcctttatcacgtggattttctttattcagaatagttgctgaattttgtgccattctggagtcttacaaatggcatgtattcgatgggaagacggctggatgggatttaatgcgaggctttcttatgtatacttaattaccaaaaatctttaaaaactcatactctgcgtggcttgtggaggttgttaaagtgtcgagattttgaagctaaatacattttagagctgtctatatatatacatatatatatatatatacatataatcaatcaaaaatgcctgaagcaaactatttactgtcagtgtcttggggctacataaagtttaaacacggatgcttaatcgggagctcacccatctctctgaacatgagtcggtctggaaatcaagtgtcacgagtttatatcaaacacattcttagatacagcaacatgacgctggcacaacttccttcctccaactcagcaaggcaccacggacgacaccacgcccaacgaccaactgtcctcacgaatcagggggagtccaacaaacttcgcatgccacagactctcactctgacctacataccacgtcatcccaaggtcgggcagtcaaccacctcgacaccacgacagatgtcctcggcccggaaccaacacgacgcga

SEQ ID NO: 96324 - DNA, 931 bp, Homo sapiens
ttcatagatgaggaacccgagcatgaggagagtcagcaagccgtggagctaactcagatcttgaccgctgctttggaggaaagttgtgaaatatcctgctgggctagaggaattgtaggctggagtctacatagagtaagagaagaaggccaatcaccgacctggaattcctagcacccctttgacccggccttcaggaagccatgcagcaagttgtgtccctgactcctggagaaagaaacagccgcataatgtggatttgctgtgctgcggtccatgccttccttggccttctctggcctgacaagaatgggagaagcatcaggacgctgtagaatgctggaaggtctgagacacggacctggatggacacatttgtccaaaacctgaattccttcttaccaccccagtacacagtcagatcctccctcagggcggttgtagctgcagcccactccaggcctgttcagttggtgcttctggttccttccattcccaggccatcatgacatgggagtgggaggtgccctttgcagatagccaactgccgattccatgttttttcttcactgtcctgttttgtccccagttctcagaggcctgtttttcttatgtagctttttaactcaagtctgcattttactaaaagactatgaaacctacttataattttattttaccccatcactttttatgattcaataggaataatcctattttgttccctcttttcagaggcctatatttcttacatacatttttaactcaagtctgaattttactaagagactatgaagtccacttataattttattttatcccatcactttttataactcaataggaattatccttttaaaggaaccccagggattctctgacacctgtcactagagtagagataaaacatgtttaatggctatgggaccag

SEQ ID NO: 96325 - DNA, 453 bp, Homo sapiens
ctcaaggatactaagaaaaaggagaaagatgaagggaaaagtagattaagaaagaggaaaaataaatgtttgaatgcaaagtgtaatagaaatacatttgcaactagaatttgaggtttaaattataacattaaattggttgtcatgatggtatataacagcgtcttttgaaaacatttattttttattgttgttatattgtcacctcagctgagaaagtcttggaattggaaatgggctctgaaatacatttggtgttcaaaatgtatttccatcattggtagctacgattctggttaacctctctgcttcttgattttctcatctaaagttggggccactactatgtctactgcaaaagtctttgggagggttaattgggtaatgcagataaagggcttagaactgtgcttgacaccatatttgccttccttaagtgtaactattattata

SEQ ID NO: 96326 - DNA, 475 bp, Homo sapiens
tagaaagaatgtaccccaacataataaaataaatatatggcaaacccatcgccaaaatcatactgaataaagaaaagttgaaatgtcatcctctaaaatctggagcaagacaagaatggccactttcatcacttttattcaaaatagtactggaagtcctagccagagcaattaggcaagagaatgaaataaagagcatacagcctggataggaggatgccaaatggtctctgcttgcagatgacatgatcttgtatatagaaaaccctaaaaggaccaagaaaaaactcttataactgataaaggaattcagtaaaggcacatgatacaaaatcgacatacaaaaatcagtagcattcctacacatcagcaacaaattagtaaaggaagaaattgagaagtcaatcacatgtaaaatagccaccaaaaaaaagaataaatttaaccaaagaggtgaaagatctctaccaaaaaa

SEQ ID NO: 96327 - DNA, 854 bp, Homo sapiens
gataattaataatattaaataatttagtaagaataaataaaaagtggccgcatcacggttatttaatatagttatggagttccaattaaagttctaagtggatccctatatggtttattacaaaggagatcacataatagcagctaaataaaatgcaggtcagatcttctattctttcatttaaaaaaacaatgtttattagaatagttggcaagatggccgaataggaacagctctggtctgcagctcccagtgagatcaatgcagaaagcagatgatttcttcatttccaactgtggtacctggctcttctcactgagactggttagacagtaggtgcagccaacagaggacgagtcaaagcagggtggggtgttgcctcacctgggaagtgcaaggggtcagggaattccctcccctagccagagaaagccatgaagactgtgccgtgaggaatggtgcattctggcccagatactaggcttttctcatggtgttcgcaacccgcagaccaggagattccctccggtgcctacaccaccagggccctgggtttcaagcacaaaactgggtggccgtttgggcagacacagagctagatgaaggagttttttttcataccccactggcacctggaagcaagacagaaccctttattcctttggaaagggtgctgaagccagggagccaaagtggtctagctcagcggatcccacgccgacagatcccagcaagctaagatccactgcattgaaattgtcgctgtcagcacaggagtctgaagtcgacctggaatactggagtttggttgggggagggacgtctgccattactgaggcctgagtaggtggttt

SEQ ID NO: 96328 - DNA, 490 bp, Homo sapiens
catgacatttcacccctaaatacttcaacatgtatctcttaagtacaagaatattctaagtaatcaaatcaatttaatattgaataccatgttatctaatgtataaaccatattctaattttcccaactgtccaaaaaatgctctttatagcttttatctgctaatctaagatccagccaagatcactacttagtttagtttaaagggaagagacatggagaaatctttagccttgtgtaggagggtacgccctgaacactaacgctttttcatttggaaaaggtgcacgtctagagataagttacatcactcaggacaggacagaggttcttccctaagatccctttcttgtctcaataaactgtgctttacagggacagaagataggaacaggaagaaaatactccatcaaaaactcagcacctccaggctaactagtcttttatggctggctggacctctaaaacatggtatcatgtagtcacagtg

SEQ ID NO: 96329 - DNA, 175 bp, Homo sapiens
tgctggtattacaggcatgagccaccacgcccggccatgactgtcattgtgtgttgaggttgtcattgcacagaactggtgattttcatgggactgtgtgttaccctgacgctggtgaccattcaggcgtatgttggatgcttccacctctgcaggcggctgcctgtgctggtaa

SEQ ID NO: 96330 - DNA, 176 bp, Homo sapiens
acaatccctagcactaggtttttattttaaaaactatttaccaattcaatatataattttttaaagtttcatctcaattttatttccttgaggtgatactttcatatgattattagccaattcagccattcttattacttcctcaaactgatccctactcaccattactaccagtt

SEQ ID NO: 96331 - DNA, 265 bp, Homo sapiens
tgagattgcgtcactgtacttcagcctgggcaacaggcggagactccatctcaaaaaaaaacaaaacaaaaaaccagcacattggtctctggtaagccgggtagagatttttcaagaaggaaaaaatggctaacagtgtacaatttaaagtgattaagtgaaataatgatacaaaagctactgctggactttgctattgagacaaccttaacaagatacatatttatgtagtgattagggtagaagccaaattccaatagaagag

SEQ ID NO: 96332 - DNA, 428 bp, Homo sapiens
attcctagttctaggtaagtcgtttggctttctgtaaaggggtaggaacctttttattccttaaaggtatgactatctatttgccaattaattccatgttccaaggatcccctcatggagaaaatgttgcactgagttaaataaggaaataactggacgaatacttgagattattcccttcataagaataattactaattgtgaattgatggtttgaataccatgctaaaatgattgaacctcttttctcttgtgaagtgattgtgaagttacttgtacctttatgtttttaaaatttgatgataatagcaataaaagctttagtgcttttatgatctctttatttggtttgtagttatggcacatcagaaactcgcatcaaaatagaatcaagattattgtaaaagggacctcaaacgtagatttct

SEQ ID NO: 96333 - DNA, 491 bp, Homo sapiens
attcggcacagggcacaatgtgagaaatgcatgagccaattggaaattatttaaagaaccatggatcattagccccaaggtgtgtctagtccagaatttcccagttagccgtcactgcatccactataccagaacctccaggggaccttataaatgcatatttccaggcctcatctgctgagtcagaatctctggggtgaggccagagacttgctttatcccccatattttacaaggctgttgtgagtttcccgcataaggagaagatctggggtttggcttgagtttttgagtcaagagactgcacctggtagccttctctccatcaacccaaaagatgcagggagctgcagccaggtccctgagcaaatgggagaaatgggatgtaagacccatccttaaatactcgaagaaactgcccttcgaaagtggatttggcttctgcatgtccctggggcagaatgaggaccagtgggtgcaatttgtgaaag

SEQ ID NO: 96334 - DNA, 659 bp, Homo sapiens
gcagaacataaagcagaaatcccactgttgaaataataaatagaatctcattgaagataacttataaaataacactcttacaaacaatatagatgtatctcctctaaatagactatttatctgtgtgtgtgtgtgtgtgtgtgtgtgtgtgtgtagaatgtacaagaacatacgtatgtgtacacagtacaaatcaaaataaactgtatttggggcagtagaagtgttctcctcctttgtattaaaaaattttaaacatgcctcaactgccaaataacattttctaatttgtgatatatacctatttatctcatcttcatcaaaactgaaacccccaacataaaacttttgttaaaaaacaacagggccaggcgtggtggctcatgcctgtaatcccagcactttgggaggccgaggcaggcagatcacctgaggtcaggagttcgagaccagcctgaccaacatggcaaaactccatctctactaaaaatacaaaaattagccaggtgtggtggcgtgcatctctaattccagctactcgggaggctgaggcaggagaatcacttgaacccaggaggcagaggttgcagtgagctgagatcatgccactgcactccagcctgggagacagagcaagactcggtctcaaaacattagaa

SEQ ID NO: 96335 - DNA, 468 bp, Homo sapiens
gctcagaagtggacgtgctgggcatgtggaggcgctggccgtggtcgtcgtacgtcagagactgtgactgggagacaccatccctagatacaccctaaaggagaaacttgcagtaccaatttgtttattacaaataatctcacaaattcaagaaaattggagagatcagcctgtattagtaaaaataattacaagaaatctttaaagatgcaacataagctggttttgaaccaagttatctgcaggtaggaggattgctatacttttttttaagtgacacagtgatacacagatatgtaaattgttggctgccataagtttttaaagagtgaaattacttctaaaaaggcacattttgaataaataccagaatcataaagtattcattttttaaattatcctttttttcaagtctgcaatatcaagtttcacaccctggccatcatgaccacactgaaaacactcacc

SEQ ID NO: 96336 - DNA, 450 bp, Homo sapiens
catctaatttcctttcccatagtgccatattcactaagccactctctgattttaatatggtttcccctgtagacttttgtataaagaatagaaagagaatgctggattcctctaaacaattatatttcttgcaatttaacacataaacccaagtaccagtctattgcactggattacagaaaggctagaaattcccacctgaaatttaaaattaggatcactgtttcagttaacatgattttgatgtggtccaagattagaggtagagaaggatgagctgaatattcttagaaattccatccagtttatcaatttgcattaaaatggctgaaaccaaatgtctcacaggaccagcaaaggaagcagggactcccatttttgccagactccgccttgccttattttttgtttgtttgttgtttgagatagagtctccctctgtcacccagg

SEQ ID NO: 96337 - DNA, 569 bp, Homo sapiens
ctctttcaagacaagtaataatatctgccaaagaatggggaaaaaagatgcagaaaaagaatacaattagcatactaccaagaaagcaaaaagcgaagggagaggagaaactaaaaaattacatgcggactcacacttatttctaaagctgtgctaatatctttttgcttgcgtctaaggcaccaattttaaactgttactgggggaaaaaaaaagagagagagacagagagaaagaaaaaagcaggcctaaatcttaaagtaaaacttttagcatagaagataagaattggtgagaattccattcccggttatttaccctataggctaaagagctgcctctgcctctaaggatcagggcattctgtgtttgatggcagaacctaagtcagaatccagcacaatccctgacaagtgagaacctcagggtaagttgtcctgaccttgagattgcttctctacctcttcaattaaaaaatatatataagggccgggcacggtggctcatgtctgtaatcccagcactttggaagactgaggcgtgtggataacctgaggtcaggagttcga

SEQ ID NO: 96338 - DNA, 328 bp, Homo sapiens
gggaattacctaccaaaaagaacatgagacatcgacatctcacataggaacatgataggtaactctcagcctacaacagcctggactttccaagcacaggacagagtcatgactaagaccatcagatacatagaaatggcaatgaagtctccttgttcatccagagacccagagggctctgcacgagataggcatcaatgcagccaaaaaccggccctcctgcaggctgggcaccctggccctcccagcattcctgctccccatgacctgactaggaattagctcctaggattttgctctcctgcatgaacacccacgtggtttcgac

SEQ ID NO: 96339 - DNA, 162 bp, Homo sapiens
atccgcccacctcggcctcccaaagtgctgggattacaggcatgagccactgcgcccggccttgtaaattctatattatttctaaattttatattttggcttttttttcattgagttggggtctcgcgctgttgcccaggttggtgtacagtggtgcgatca

SEQ ID NO: 96340 - DNA, 985 bp, Homo sapiens
ggcgcgcgcggaatcagttgagtctcttcggttcccggctctttctcctgcggtgggtatttgtccggctgctgggcgacctttcccgcgaaggaggttgtgccttcattcggtcgcgccccgggctggggaggcacctccctggtgcgcaggaaccgcaggggcgggtaggagcctggctctgcctgagctccggagggagcagagctggcaccgcgcaagggcccctgcctcccgggagactgggatttctggcctcctcacctcgggaccgctgactgtggagtgtcaaagacggaacagggtttagtgatcttgtccaaccccctccccgcttttcacagactggggaaatggacgcctggagaacggaaatccagttatcaaaattgactccagaagagagaacctaacagaacaataacaatggaagaaattgggaatattatcaaaaagctatcattctgttaaactccaggcttggatggtgttacaggtttaaaaaaaaaaaaaggaaaaagtccttcatgaaaaaagaagaacttaagcaacatgatggattcagaagctcatggaaagagaccaccaatactaacatcttcgaaacaagatatgtcacctcatattacagatttagtgaaactgaagcattacttgtgtggctgctgtgcagccttcaacaacgtcgcaatcacatttcccattcagaaggtcctctttccacaacagctgtatggcatcaaaacgggggatgcaatacttcagttgagaacggatggatttcgaaacttgtatcggggaatctttccccgattgatgcagaagacaactacacttgcacttacgttgggcctggtatgaggatttatcctaccttctccacaagcatgtcagtgctccagagtttgcaacctgtggcgtggcagcagtgcttgcagggacaacggaagcaattttcacttcagacattgcttcaagaccacaa

SEQ ID NO: 96341 - DNA, 693 bp, Homo sapiens
ggcgcgcgcggaatcagttgagtctcttcggttcccggctctttctcctgcgactggggaaatggacgcctggagaacggaaatccagttatcaaaattgactccagaagagagaacctaacagaacaataacaatggaagaaattgggaatattatcaaaaagctatcattctgttaaactccaggcttggatggtgttacaggtttaaaaaaaaaaaaaggaaaaagtccttcatgaaaaaagaagaacttaagcaacatgatggattcagaagctcatggaaagagaccaccaatactaacatcttcgaaacaagatatgtcacctcatattacagatttagtgaaactgaagcattacttgtgtggctgctgtgcagccttcaacaacgtcgcaatcacatttcccattcagaaggtcctctttccacaacagctgtatggcatcaaaacgggggatgcaatacttcagttgagaacggatggatttcgaaacttgtatcggggaatctttccccgattgatgcagaagacaactacacttgcacttacgttgggcctggtatgaggatttatcctaccttctccacaagcatgtcagtgctccagagtttgcaacctgtggcgtggcagcagtgcttgcagggacaacggaagcaattttcacttcagacattgcttcaagaccacaa

SEQ ID NO: 96342 - DNA, 916 bp, Homo sapiens
ggcaattggtacaggtctggagatttatggatttcaggtcgctgcccctgggcttggtgtgagtgcacctccctggtgcgcaggaaccgcaggggcgggtaggagcctggctctgcctgagctccggagggagcagagctggcaccgcgcaagggcccctgcctcccgggagactgggatttctggcctcctcacctcgggaccgctgactgtggagtgtcaaagacggaacagggtttagtgatcttgtccaaccccctccccgcttttcacagactggggaaatggacgcctggagaacggaaatccagttatcaaaattgactccagaagagagaacctaacagaacaataacaatggaagaaattgggaatattatcaaaaagctatcattctgttaaactccaggcttggatggtgttacaggtttaaaaaaaaaaaaaggaaaaagtccttcatgaaaaaagaagaacttaagcaacatgatggattcagaagctcatggaaagagaccaccaatactaacatcttcgaaacaagatatgtcacctcatattacagatttagtgaaactgaagcattacttgtgtggctgctgtgcagccttcaacaacgtcgcaatcacatttcccattcagaaggtcctctttccacaacagctgtatggcatcaaaacgggggatgcaatacttcagttgagaacggatggatttcgaaacttgtatcggggaatctttccccgattgatgcagaagacaactacacttgcacttacgttgggcctggtatgaggatttatcctaccttctccacaagcatgtcagtgctccagagtttgcaacctgtggcgtggcagcagtgcttgcagggacaacggaagcaattttcacttcagacattgcttcaagaccacaa

SEQ ID NO: 96343 - DNA, 401 bp, Homo sapiens
tcccccgacccagatccccaagtagggtaaccctgctctgccaagtaaaagtacccgggactttggggcaaaaagcacccgggttgtggtcctagctctgccagttactacgtaagctttaaaaagccacttaatgtctctaggtctcagtttcctcatccataaatggggccatgtacaagtttaaagagcatggctacagacacatactcaagaaattgatcacagagtccatgcagcaaggcagacagaacagagctgaatgaaaggctgtatcctggtggttaagcaggagggctctggagccagatcacctgggctggagtccaggttttactaggtgaccctgggcaagcaacttaacttgtctgagctctagtttcctcatctataaaatgggg

SEQ ID NO: 96344 - DNA, 459 bp, Homo sapiens
tcgcactctgactcgtggaaatagactgcctggaaatagactgccagatctgtcatttcctaattgtgtgacctaggacaggttacttatttctctcaacttcagctgccttgtttataaaatgaagataacagtacctagagagttaattaattaatgtaaagagcttacaacactgccaggtacacccaagtaccttaaaccaaaagttaaaacatgcttgaatttaaattccagctccacctctgagtaattgtattatcttgctattatttttataagcttgccaagtgtcaaatatgatcaagactggctgcaggttcagattctaccaattgttatttaatccatcctactcaaccactgttgaggtccaattatcttcgtttcacagatgaggaaactgaggcagagagagctgaagatttgaaggctttttcccatatacttcccctgagg

SEQ ID NO: 96345 - DNA, 446 bp, Homo sapiens
accgaaatgttctctctgtggaagtcataaatggtttcctttctggggaaaccagagtatagtatggccaattaagaaagaaaagggactaactattgagactgtgtgtgatatgctgttactttgtacacatcaaattgtttattccacataatgatcttgtgaagtagggacttactaaagtccaggttatttaccttcccttcaactttacagctagcaaataacagaactccattttaaactgaagactcatcccaaagccatgccccactcaatataccatacttaccatactgctagtaagattaaatggctcaaagtgcataaatatactttttgatgtaagaaattatttctgttttggaatcatggggcatgaagtttctaccaaagcaaaaaggttgcataagtgtttattgacagcaaatattctaatttctttc

SEQ ID NO: 96346 - DNA, 686 bp, Homo sapiens
atttacagtctgtcagattggattgtctgaggttttccgctattgaaggagaggcaaacgaagtatatagcccattcttgtaacttctatctcttccctacaacgtttgggattttggactcagaattctccttccaggcttccagtgttcagtttttgaatcagtatggcttcaactataacaagtttctcaaaaacggaatcccatatatgaatgaagaacaggagaagaaaattagacacgatatcctgactgggaactggagagttcgcagctctccggataaagaccaaatcaaggtggtgattgacgaagtgacgcggtggctggagctggccaaggaaggcgactggatgactcttcctgggatcactggcttccaggcctttgaggtccaactggtgctgaggcaggccctccccaacatctggacggtgctgaaagatgaggggcccttagtgggacataatatgatgatggacctgctgcacctccatgagaagttcttcagacccctcccagaaagctacgatcaatttaagcagaatatccacagcctatttcctgttctcattgataccaagagtgtaacaaaggatatctggaaggagatgaatttcccgagggtgtcgaatctttcggaagtctatgaagtcctgaacaggtgaggacggcgattcctgga

SEQ ID NO: 96347 - DNA, 1483 bp, Homo sapiens
  misc_feature (1465)..(1465): n is a, c, g, or t
  misc_feature (1475)..(1475): n is a, c, g, or t
agttcctcttggaaaagatatagcaaccattggggaatgaccttttcatttcagaagtggatgaggaaggtggtgtgagcatcaggtatattctggaccatttcaagtgctggtgagaagaaaggaactctttgcctgaactgggcttggttttccaagtgctgctttggaaatgaagacccagagatgcagagcttatggtagttcataaatcttcatgttctattatctttcatctgccaataaagttcattttcaataatgtccaccattgctgtgcccagaataaccacaggcaaacaccaaaacaatacgcataagttagacaagattaaatcttgtctgatatctgcacaaacagatatgcaccatgttggaaacatgtgttttcctagtcccatccaggcttcccacaagaaagccatgatgtgggtctaaaccatatgttttgagtaaaggagaatagaagaaggggagtgtccgcaaaatggaaagagatgaagatgttccaaggaagtatgctgaaacagaacagtgaatgttttgcccaaaactacaaaaataaaagaaaaaaagaaaattgcaatacatggctactaagtctttgatcataagtcgaatttatagacctggaatttgccatcctagtctttcctttttagtaagacttctgtcctctggcagtgcatatggtaggtctctaatgtttcttcatctccaggaagatgcagatccttatttttgctgggaaatccttctaaatagaaatgtaacatttttataaaaacagattaatgtgtttttcacttagtaaatgttttcaagagctgaattgagaaggaaagagactggagtggttaatggtgatttgatttctggcattctgagttttctgctacaattagctgcattacttggtgccaaagagcagtggggaattgttgagttgctgtatcctttaaaaaaaaacaaaaaacttgttattttgaaagaacttaaggctcacaagatgttacaaaaatagtagagtggccttaccctagatccagttttccccatttataacatttcacttagtccattttcggaaccagaaaattaacattggcataatgctattaactaaactacagaccttttttcaatttcgccagtttttccacacatattcatttagttgctggatacttttaattcttgctgatttgtaaactggccttgcttggatacaacaggaaagatactatctggataaagttctacagttttagagagactattaacacattaatgtgttcctttgtcatgagcaataccctgcctacactgcttctaaattttctgatttgtttggctgtttggcatctgaaacaatccaagacaaacttagaaagattaggcaacacaaaacacagtaagacctgttccatagcttggttgccctaggaaaacccggttgccgggntattcctagnatggcttc

SEQ ID NO: 96348 - DNA, 144 bp, Homo sapiens
tgctgggattacaggtacaaattgctacacccggcctgtatacttttaaattctttagtgtagggcctctgtcttgagtgcttatcagcttttcgctggtgaagtgggttggccaggataaaaagtatcatcaagatgccattt

SEQ ID NO: 96349 - DNA, 220 bp, Homo sapiens
cattaactgtgtgagctccaactccagtcaaaaccatatactgtgtgagctccgcctcctgtccaagcattactgtgtgagctccgcctcctgtccaagcattactgtgtgagctccgcctcccgtcagagcattaccgtgtgagctccgcctcccgtcagagcattaccgtgtgagctccgcctcccgtcacagcattaccgtgtgagctccgcctccc

SEQ ID NO: 96350 - DNA, 766 bp, Homo sapiens
aagtgcttttctggttttgcttttgtttgtggtggttggcattgctgtggtttaatttttcttttaaaaagcagcttccctctctgcctcaggaactcgcaggcctctgaagcatcgcctgcaaagattgaaggctctccctcagctgggtgggagtccggactgaaagcctggaggaaccctttgcaagctgtactcccttataagacacatacttttcacctggtgactctcttttcctgatttcgaagcatttcttcaggacctacatatgcccgagaggcaagcagtcacctctgcgttgtcaaccaccccacaattagagcacgtggtcactgacccaaggaaggaatgagaattcactaggtgctctgcttccattcccaccccgtttatctcgatgacggatttcaccaatcccacagagcacgttttacaaatgagacagccgtggctcatagcgtctgtattcgaatttgcctctttctgaacaaatcaataaaacacgctctttcccaccacccgacgatctggcttctggaggtgagcgccagttccctgccaagcttcccgttcctcggctttggctcacgagaaggttacattcttccgtcccgtcccactgagctggaaacttacaactcgaggagacagcacctctgttccagaagcgggcttagaccaagaacgcctcccctcatcccacctgctaactccaccatctgctgccgccaggaagcccgagccgctcggcacgaagaggaga

SEQ ID NO: 96351 - DNA, 698 bp, Homo sapiens
ttaatcgtaggagctgtaagagtttgttgaactctttgtgctctcggcaaaattctgttgtctctgtaccttatggagagggaaaatggcacagtcaatgcagacagccccagcttcaagttctggctccgcttcttactgtgtgagcttggcaaactctctgcttgctccgtgcctcactttcctcccctgtgaagagggaactgctgaaggatttcaggagctaatgtattggagagtaattggcatgcagtaagcacacaatatatggggctactattagtagtagtatctcatttaatcgttccaacaatcctgtgaaataggcaccttcattcccattttacagatgagaagttggaggattagaacaatgaggagtggttggctgggtaactttgggtgagtcacttcccctttctgggcttcttttctcatcagttgttgatcatacagccttagaaccagaaggcctcttgaagaagaggctaatccaaactctctcatttgacagatggataaactgaggcccagaaaagggggaaatcttggctagggccactggttagattgggcagagccagggcatgaactctgcatccaggctccagctaaagcccttttctaccagccatcagcccagagacatgccctcccaacgtaaaagccagcactgttgcctcttcccctccaaaccg

SEQ ID NO: 96352 - DNA, 318 bp, Homo sapiens
tggctctctctcttgcttcctctctcaccatgtgatgcacctttttccccttcaccttttgccatgattttaagcttcctgaggccctcaccagagcagatcatggctccattcttcttgtagtctgtagaattattagccaaaataaacctattttccttataagttacccaggctcaggtattcctttacagcaatgcaaaatgaaataatacatatccaaatgaaataaattgttttaccaataagacacatgcacttgtgtgtttatcgcagcactgttcacaatagcagagatatggaatcaacctaggtgcc

SEQ ID NO: 96353 - DNA, 705 bp, Homo sapiens
agcgggggaacgcggggcgcgaggccgcctgacaggaacgcggggcgcgaggccgcctgactgacaggaacgcggggcgcgaggccgcctgactgacaggaacgcggggcgcgaggccgcctgactgacaggaacgcggggcgcgaggccgcctgactgacaggaacgcggggcgcgaggccgcctgacaggaactcggggcgcgaggccgcctgacaggagcgcggggcggcgccctcccggcctccctcagcccggcgccctggccagcgggtgccgctcgcagacgggggagcccagagcccacgcgccaaggccgccaggcctttcctccctcgcgttccctcaggcgcgtcctccacccgtttcccccaggcagggggaagccccgagaagccgccgcgccgggctgagatcgggccccaggctctccgcggagccgtctccaacccctgcaggccgacctgggcagccaggcggggagcgcgcagccacagcccgcgtttccgggctccgtgtccttctggaggccgctccttggccatgggccctcggtcctcgccctgagcagcgcgccggggtataagggacgccctcagaggcctccaccccagactccaccgcgctctgccaaccgggacaaggtgttttgctgaataaataaattaatacataataaaggctgcgtccaaccagatgaggaca

SEQ ID NO: 96354 - DNA, 708 bp, Homo sapiens
acagtctactctttccccactgaactgtgtgtcttcatggggagtttgactttgcttctctctctggtgccttctggagcctggaggctctcaacttccatttcaactgcctgacctgggccagccatatctccatgacccatctcccacctggacccattgctagggtgggcggatcccagaggccaggctgttggatttctgcatgactggcctttttctctttgcagtttaattgtcgggacatcagactaacagtgacaataacacatctctgcaaaatataggccacagagcgctggtggaggtagaggtgggggcaggtgtatgtgtcttgttggagggtttcaaaaatggaagacatttccctaaagtttgatcgtcaatgaccttgtcttctagtgatcttcctttaagtttcttgtgtgcatatctgatttctccaactaaactaattaatttatttgataacgcatactacttggttagcattgtgataaatttttaaaggtatttactttttatgtttaattctagcaacaaatccctgatttgttggtagaatcggtacagttaacatccccattttaagatgagtaaactgaggcctgtgggtgggaaaggccgacttcaaaatgaggcagaacgcttcaccactatattgcttcttgcattaaaccttttcctgctctgagtgagcggggtgga

SEQ ID NO: 96355 - DNA, 380 bp, Homo sapiens
actagtcgagtttacaaataaaatattcagattagttaatattctaataacagtagtaatggatttttccatgttaatcattttttccactttatggcattgtgagtctgtctttgttgttgttcccatagtgaaatatctctttactttgtgtaagtgatctttacatatttgcaaagaaaattccctccttttaagtttaatgtaaattgcctgcccatcaaatcagcattgttcaatagtttttaaggtgctctctctgtcctttgataacaaagggaattcagttctggacaaaaactcaagataatgagcttggcaacataaagcatcttccttttatgaaatccactcacaaaataatgtggtatgaaatttaa

SEQ ID NO: 96356 - DNA, 564 bp, Homo sapiens
tggagctcctgctcaccgcttcctccacgcgtgttgtcagctctcgtgggagcaagggcttcccttgcccatgtgtccctttatttttatatgcacagcgtgtggctcctgctctgtgtgcacctgtgggccgtgttttcttgtctcttcacccgtctcatggctccttgttgtctctgggctttgtggcagatccctccgagggactgcagattctgtttgggtttttgttctggtggtcagttaccctggctggattcagactccagctctgtctgcctcccttgtgagagcagcagccgacatctctgagcagctgtgtccagcctttcggcatctgttgtgctcagtggagacttccctgcagggtggagctcaggccttccagggatcagcgtcactgggacccaagttttcagactcggcctgctgtggcccctccttccctaggtctcatccctggctgggcagcagcacaggtggcccaaacttcatcctctggcttcctgagccagcagcactgtgccctgtgctgtgcctgtgccctgctcacgggggcagtgc

SEQ ID NO: 96357 - DNA, 282 bp, Homo sapiens
tcctcattcagatcagataccataacactttcttatcagaccttaatgaatagaaatgcaatttcttataacttaaattctgaaagaattacgtgacatgagacagaagaaggaaaaatgtattgaacaaaaaaagcctgatacatcctcataaagttattggtcaatattccaaaaaatagagaaataatcattaatatatgccttttttttctggatataaatagacttcacttcaggctgtcatcttcactgtgttctttttttttttttttgagatgg

SEQ ID NO: 96358 - DNA, 245 bp, Homo sapiens
aatgcggtattttctcttggattacaagccccaggatgcaaaggcagagagaagcccctcccccttccctgtagctgagccactgcttccgccaggcctagaagcaggcagaatccccaagctcagctgagtccagaacaagagcttctgcctttgatttttttttttttttttaatcgggtctcactcaggctcaggctggagtgcagtggtgagataacggctcactgcagccttgacctccc

SEQ ID NO: 96359 - DNA, 381 bp, Homo sapiens
agatcaatgcatgcgtgaggggccccttcccagcaggctctggtggctacaaactggttcacgtgtggaagatcataccactttacctttggtttttctttgaaaagcaaacaatgaaagacagctgaaaacaagaattctaccagtgggcaggcaagaattctcgttgggaaaagggatgtttgtggctgttccccacattgggcttgaaagagcttggctgcagtgtggttattattaaaatgtccacagaatagaagatgctcatgaggctgcagtggaaagggaatgcttgtacactgttggccagagtgtaaatcagttcatggaaaaattaatgtagaaaaccgtttggagatttctgaaacaatttaaaacaga

SEQ ID NO: 96360 - DNA, 510 bp, Homo sapiens
ccaggggagtcagagacacaggagagaaccagggcagagtggcattctggaagtcaagagaattcaacagggtaacaggactcaatgccacagaggataagtgaggattttttaaatgtccactgaatttgacaagtaggaggtcactgatgacactgcagaagtggcgtcgttagaatgtggggacagatgccagattatagtgggtaatgggaggaggaaatgcaggccttgagaaagaatatgtttttaagaactttggcactcgaggggaggattgttctgtgacagcagccagcagggaagcaggacccagagagaacgggtggttttttttctcctactacctcttatatttctaacaatatcctaatttttcaggtctttgaaaaacaccttacagatactttttaaagttttcatttgctagtgataaataaaatgtgcttgtatgtgtaatttgtatagaagattttcttatacttactctatgtccagctgacataaaag

SEQ ID NO: 96361 - DNA, 335 bp, Homo sapiens
cttctcctaatagaagcttttggctgaaacaagaaacgtttttgaaagaagcatattgtcattatccttttgtgaaattttaatagccagatttgtattcttattcatatgtaacaaaaaccttgctagcacagtggtgataacagaggtacctgcaagtaaaactgagggttttttttttgaagtaaaagaaagaaaaagcagctttgaagcaggtacttacacaaatactaccttgatttaccacatatctgtaatggatggcctgggagtagtgactgcagcctgaaaagtaatttagggcatggggtattaactgatgaccttatccataa

SEQ ID NO: 96362 - DNA, 297 bp, Homo sapiens
tctttttctccttctctcttactgtttgtttatccctatgttgcctttttctaaagaaaggcctctgtctgcattgaataatagaagacattacaatggattagagtgcaagagaagggttatttgtgacgttcattagatgtgatccatgttttatctgtgcaacagaatattaatgaactgtggtacatttagaatcctctctgcagaatctccagccactgcatgcaatgtgtttacctagttgagctgtgtgtttgcttagctgtttttttttttaacccattaactcatctg

SEQ ID NO: 96363 - DNA, 285 bp, Homo sapiens
caaagcctgacttctggctcctcttgggaatcagaagctctgcctccctggcccacacgccatacttttagaagccccactgccccagagccctatttgtccatgaattcctgactcattgtctggagcctgcttgagggaggctgggcagggtgtgagccaccaggattaaaggttgtttgtagcctctgcctccaaatagttacctgcaaaaggggacaagtgaagccacaaagattctactttaaaaaaagaaaaagaagctcattaaagttcccttaggtg

SEQ ID NO: 96364 - DNA, 440 bp, Homo sapiens
ctaatgactatttcagactacaggtcatgtttgaaaggctgtaggaggtttctttctattccctaaagagaggaaagctgaagaactgggatggataggttattactgactgatgtgtacatatttggatcataacttttttggtcaatactaaaaggagttgttaaatagattatctgctggaaagcaactaaaataaattaatagaaattcggctgagtgtggtggcttacgcctgtaatcccaacactttgggaggccaaggcaggcgaatcaccttgattccaaggcaggaggtcaggagttcgagaccagcctggccaacatggcaaaaccccctctctactaaaaatacaaaaattagccgggcatggtggcgggcgcctgtaatcccagctactcaggaggctgaggcaggataattgcttgaacccaggagg

SEQ ID NO: 96365 - DNA, 392 bp, Homo sapiens
agcaccatattacatctcagtagttgttacagattttcaaaagttagagattgtttccagctgtgatgatcaggaagctttgacagagagggtgcagattaattcggtttctcaggatacaaagggttctaataagttgagagaaggaagacaaggttctaatttggaaaggaaagacacaagttggtgtgtaaagacaaagagaagaggagcacatgcattctgaaaaattgaatatactggtatgtctagagcagaagggccatctgaaagtagtttgaaaataaatttgaagagccaatagcttaagagtatagaaggatttgcatgctttctgatggtttagaatctgctcttgaatagactagatttacttgaaagctttttgggga

SEQ ID NO: 96366 - DNA, 240 bp, Homo sapiens
gactgcaggtggagctgtttcaacacacatcatagctctcagggcttcagtaaccaccctaacagggacagaaatcacccacagaacctgatagcagcatcaggccaaaagcatttcataagaagctatgaatgggagaaacagcccagggaatgaaagggactccacccatcaatagctgtcgtcctggaaaggcctccccaggtgcatctctctgccctggttgcactcccacccccc

SEQ ID NO: 96367 - DNA, 103 bp, Homo sapiens
atctgacttcctactctgggtcacggtctggactagattcttctaagatcctttccagagccaagattctacaatttgatgccatctttttttttttttgaaa

SEQ ID NO: 96368 - DNA, 693 bp, Homo sapiens
taaattaatgtattaatgtatattattgactcagccaatgtctaattacccttaaatttttttctgggggagaaaacccatccttcttcttttttttttgaggctttgaattttctatttgtgaatctgtccttttatttgaatataattttttaaattgcatttattttgttttatgatcaagtgaaatttatggaaaaatatactaattaaatcatcctttgttagctttaaatcaaatagattattgtacataataaagtttatagtttatgataaatgtattcttttaaaactatgggatgatccagttcttctctagttgtctggaggacttttgtgtttcaggctattgagtgaatgaattagctaatgaatactttggtttaacttagcaaaggagacacaaaataatctaacatggcactatagcatttattgctaattttagaaggaaaatgattttgatttctgtcatttatatatacaatattttatgaatgggatagtacaaaataatcatttgtaaggtccaggatgtgtttctgttttcagaaaaaaaggaccatttactccatctatttgatggtatacttgttccttacagtaatctcattttttggatctaaacattttctttgacctaccacagtgttgtcagaaaatggttctgcagtggcttatacctgtaag

SEQ ID NO: 96369 - DNA, 639 bp, Homo sapiens
agcgggcatcctcatttaatagagcttgaaattactataatctgtaaagtacagcgagaagaagaagtttcacctgcctgcacatctgtcgttgactctccatctgacttggagggactctgagggaccaacctgagcctgagaagaggcaagattccccttcaaggacacactgggaacttacggacctctttctccatggtgcagagcgcagaggctacctgagaatatccagagactacagaggtcatcaagttgacgcatcaatgtttacatgtgaacaaacagacgcataatagctcttgagcttgccattgggaagtgaaaatcaactgcttgaataaatgtaaggactcaggtagacatcaccttgtgactcaacagcagccaataagatggaaataaaggccatgaagttatcggatggcatctacaaggaatacttagatgaggaggtgactctggtagcaattgttcttttgtctttctcaccttccttcttgtcctgtctgggatgctgaagtgatggctggtatacagatgccctgttgtgatgttgagataaacatgagaataaaagtcagcgattacagatggcagagaagagagagaaagataggatgtaggtggatattgacg

SEQ ID NO: 96370 - DNA, 415 bp, Homo sapiens
cgtgcccagccctacgtttgttttttttaagatatgattaaacaataataaaaaatcatttacagcatcattaaaaacttctgatttaatcaatcaggttttagacctgggtctggagtaaagtgtacgttagatccaatcgtagacaaaataaactgcctagacaaaaaaccagaagtttttactgatgctgggattgcaggtgtgagccaccatgcccagctactttccataattagattctaacttctcatagcaaccttgacaaatcccggtctcaaacattacaaatgacggaaattgagaccatagacgctttgaacgttccttatgtaatactactacctactacttgggaccgtaaacctatattatatccctaaacactcgagagtgtcatccatgaggtaaggcg

SEQ ID NO: 96371 - DNA, 444 bp, Homo sapiens
cgtgcccagccctacgtttgttttttttaagatatgattaaacaataataaaaaatcatttacagcatcattaaaaacttctgatttaatcaatcaggttttagacctgggtctggagtaaagtgtacgttagatccaatcgtagacaaaataaactgcctagacaaaaaaccagaagtcataaattgctctaccagaagtttttttgttttttgtttttgttgttgcttgtttgtttgtttttgagacacagtctcactctgtcgcccaggctggagtgcaatggcgtgatctcggctcgctgcaacctccgcctcccgggttcaaacgattatcctgcctcagactccagagtagctggaattataggtgcctgccaccatgcccagataatttttgtatttttagtagagccagggtttcatcatgttggccagactagcc

SEQ ID NO: 96372 - DNA, 122 bp, Homo sapiens
tacctaaaccaagatccctttgtgttcctctatttctagcctcgtccttgtttccttggactgtcattgtttatggggatacctcctccactcacctgaatcctgcaagcaagtgggcggcc

SEQ ID NO: 96373 - DNA, 357 bp, Homo sapiens
tgtctgtttaccagtgtaccctgagcacatgaacgaggcctggcatctaatgtgtgtgttctgaataaacaactatgttttaaaaacccttaacaaaacagagtaagtggaaacttcctcataccaaatcctgcagcagatgtatatgtaaatgctaaattaattgcatataagatctattaacactaccagtgtctgacataaaaaggcagtgcaggtgacaccaaagggaaagaacaatgtgagggtcaaactgttcccacctgcatctgacacaatcatttacttaaaaacagactcaattagcaactaaaacacaagagtacaaccagactgctgaatttgaaatcatgttac

SEQ ID NO: 96374 - DNA, 1404 bp, Homo sapiens
  misc_feature (1287)..(1287): n is a, c, g, or t
gagccaccacgcccagccactttttgttctttttaagcattttattcactgatgcctcccaagcgcttgccatagtgcctggcacatactaggtgctcagtcagtatttgttgaaggaatgaatgcggtaggggttatttgacctgtttcacaggtggcgatattgacacagagcagttgggtgtcttgcccataggcatgcaccattgttgaaaacagcttttgctcttcacacacagatcttttttttcttttaacagattttttttttacaggtataaaatggaagtcattagacctaagtgatgggattgtagagtgtaatataacacactataaataccccgtgtctggtatacaatgtcaacattcagtaagtgactgtgtttgttgtggttggagcttcttttctgcatgtgccctcattttgggtagggttgccacacagataaggaaacttgaaaatttgtgagccatggaaaccttttaaaaacatgtttaattaatgcagtgtttctatctttgctatactatccatcaagcaatacaagtagtcaaattggtgataggagttcacatctatcctgagcaagtcgacaagtgggttatgactggcaagatttgattaaatgatatttgcattttccctgtttacaatcgtagagcattgcactggaaggggcctcagggaagcatggttcgtttcttttccttatacctccttagcttacaggtgaggaaagtgaggcctggagagatgcagggggcaggcttgatgtggaactctggacttgcatgtcacattctcttagacatcagctcaccctgccaaatccaggtgcctggacgggcttgtatgaacttttgtggtggagccacaattattcctactatgatgttagtagcagattgtatcaataatccaccaagagccaatacatcaaaatcaggactgtttaaacattgttttttacccatcataaaatgttcttagccaggcaccatggcacacccgggaagtcccagccacttgggaggctgaggcaggaggatcgcttgaacctgggagtttgaaatcagcctgggcaacattgtgagactccatctctaaataagtaaatgaatgaatgaatgaatgttcttattcattgtacataataagaaggaatatgaagaaaaaacaagttatcctaaattaagattataaatagtcctaaggattaaaaattattttttcatcagaattttaattatttcactgcaccacgcccagccactttttgttcnttttaagcattttattcactgatgcctcccaagcgcttgccatagtgcctggcacatactaggtgctcagtcagtattgttgaaggaatgaatgcgtaaagcttgggatcctctaga

SEQ ID NO: 96375 - DNA, 593 bp, Homo sapiens
  misc_feature (476)..(476): n is a, c, g, or t
gctcggtacccaagcttttaccgcagcctccaataacaactacagtctggccaagtgtggtggctcacgcctgtaatcccagcaccttgagaggccgaggcgggtagatcacgaggtcagaagttcgagagcagcctggccaacacggtgaaaccccgtccctactaaaaatacaaaaattagctgcgcattgtagcacgtgcctatagtcccagccacttgggaggctgaggcaggaggatcgcttgaacctgggagtttgaaatcagcctgggcaacattgtgagactccatctctaaataagtaaatgaatgaatgaatgaatgttcttattcattgtacataataagaaggaatatgaagaaaaaacaagttatcctaaattaagattataaatagtcctaaggattaaaaattattttttcatcagaattttaattatttcactgcaccacgcccagccactttttgttcnttttaagcattttattcactgatgcctcccaagcgcttgccatagtgcctggcacatactaggtgctcagtcagtattgttgaaggaatgaatgcgtaaagcttgggatcctctaga

SEQ ID NO: 96376 - DNA, 171 bp, Homo sapiens
attgtgttatctgtttctccctatcatctcctctgctactaacagcagacaccttttgtatctcattaattgctgtatccacagaacctggaacagtggtggcacaaagtaagtgctcaggaactatctgttgaatgagtaagtacatactgtggtatatgaagcacatag

SEQ ID NO: 96377 - DNA, 449 bp, Homo sapiens
atttcttagcccagggtccaaccccattccctctttaaaaaagaaagaataggccgggagcagtggctcatgcctgcaatcccagcactttgggaggccaaggcaggtggatcacaaggtcaggagtttgagaccagcgtggccaatatggtgaaaccctgtctctactaaaaatacaaaattagctaggcgtggtggcaggcgcctgaggctgaggcaggagaatcctgctagtctgaattacaataaggaaattaaatgaaggatttatctttaatagagccaggcattgctatcaacataacatgtttggttttcccctttaaatagaaaacaccaagcagggcctttccagacaaggtagtctggaacccaggaggcggaggttgcagtgagccgagatcccaccattgcactccagcctgggtggcagagtgagactccgtctc

SEQ ID NO: 96378 - DNA, 526 bp, Homo sapiens
ttgggtgctgttaaaagaattcaggtttatgtatagacaaaggtatggttgggaattggaatttatgtttaaaagggaaccagagcataaaagtttgaaaactttgaagcctaacaatgtgacacaaaataagaacccacttcctaaggagaaattcaagccagctgcagaaatttgcatgagtaacaagaaacaaatgttagtcaccaaaactgtggggataatgtctctagggtatgtcagaggtcttcacagcagcccctcccaacacaagtctggagacctagaagaaaaaaaatggtttcatggaccaggcccagggccttgctgatttttgcagtcttgggaattggtgccctgcatcccagccatagttaaaaggggccaatatacagctcaggcaatggtttcagaggtacaagccccaaactttggcaatttccacatggcgttgagcctatgggtgcacataagtgaagaattgaggtttgggaacctgcacctagatttctaaaggatgtatgaa

SEQ ID NO: 96379 - DNA, 408 bp, Homo sapiens
actccctttattccttcattccttctttttttcattcagtatttatatgctaggcctttttccaggcgctggggatacagtagtgaacaaaataagcgaagatccttgcctttataaagtgtataatttaggaggggaaaacagataataagtacaggttaagcattcctaatctgaaaatccaaaatgctccaaaatccaaaacttcctgagtgctgatgtgatgtcacaagttactctgaacatgttattttttcactgtgcccggccctcttttccctgttttgaagggaaaactttccacatttcacctttcagtaccacggtggctataggtttttttaattgagttttttgattgatttataactcacatatagtacaatgaacaaatcttaagcatacagt

SEQ ID NO: 96380 - DNA, 455 bp, Homo sapiens
tacccccagaggcctgcagagatttagtactaactccctgagtagctcaatgagccattttccttctggtttcttgctctaaaggaaaccactgcaggcctcggctccctttcccattaaaagccaccggggccatagttttcaattagctctgtcagcccatcaccctgcagccgcccaagttcaatacgtcctcccttcccccagcttctggtctccaccaagcacttcacacctccctattgtaaacctgtccagagcaattaccctgcctgcacttggacagcctcaatactgcacttctgtctaatttatagctgcaaagctccgtcggcaaaggcagacctgcctcggaacagaggaaatgcagagaaaacggtcaggctcttccataaatgcatatgcacagccaatttccttaggttacaggagagcaaattctcccattctcctag

SEQ ID NO: 96381 - DNA, 607 bp, Homo sapiens
gtcacgcccacaaggactgtcacgcccacaaggactgtcacgcccacaaggactgcttgcacggaggtccttctttcctctgtacgccaacccataggcccacctccatgccacactgctaaaatatcacagagaagatgcagtacagtaagtccacacttaacattgtcaatcagttcttggagcctgtgacttaaaacaaaatgacatataccaaaaccagtatttttttttctcaatgttataacaaaactacattgaaagaaatgacgttatttgaggacctggtgtatgttgttttgcttaaagttgtagtttccaagagcctactggaggtcattaagatattacggtatagctaaatacttctgagcatttaataattccatttagctgccatatttccaggacattcaacagccatgagcactggcatgtggacctcacctagtgtaccccttaccctagtgagcagagattccattcttgggaaaaagggcagtctgtctctcagaggcttattcctcccaatcctaaggtccagggaaggaggcagagccatcacaaactcaggactggcagatgtttgagctacagggtgggtact

SEQ ID NO: 96382 - DNA, 750 bp, Homo sapiens
aatttaatgatagattcagggatttgggtctgccatatacgaacaagatcagaacccaaatagatgaaaagcagtttagtatgattagaagaatacagactgtagagacagatggaggtggtttgcatactgagtcctcacttactagctgtgtgaccttgggtaaatagctgaacctctctgagcttcagttttattcatctttgaaatggggataatattcctactttatgggttgtgagaattaaatgaatttaaatgaaatagagaaagcatgtggcatatttcaggacacagagtgaacactgaatacacagcacctctcattaaactcactatgggataggactgacaaaataaataccaaccctgtctctcaattcactcacccaccaaacaaagggaaatggagtgtgctgatgacattgctgagaatttaatctgccaaaatggccaaaaggacagccctttcagggacattaaatcaactacatcattgctgggttttctatcgaaaacagtctctttaaagtttggttttcatgtatctgaataaaccctggcctaaacgggtacttcctatattcaatgaatataggttaaatgaatatctgtatgaatatgggaaatgcaactaattacgtggatatttccaaatttgtttggaaatgcttgaaaacaagcagcagagatctgagaaacaccagctcactgtgggtttttgtctttttctccccgtgcccaccccca

SEQ ID NO: 96383 - DNA, 238 bp, Homo sapiens
ggcgggggcgtggagggcgcggggagggtcgccgcgacgcggagtctctgggatggagggagaggccggccggtcgctcgcgggcttctccccattgaggtgtggagagcgggaccctccccggcggcgcagcccgggcctggggacgccgcgaagtgccggcgcccgccgccttctccacgccggctgtggtcgtcgcgcggcccctcggctggccggggccatgcacccgagcgcc

SEQ ID NO: 96384 - DNA, 625 bp, Homo sapiens
agccgcgatcgtgccaccgcagcgagaccctgtctccaaaaaaagagacagaaaaaggggagggttaaggaatcatttcagactcgaagagaatatggcctctcaaattaaaatgggcagtttccgccgaactttcaaagccgcttggtttggagagggagcaggacggccgtgcttcccaagggtctcccggcgtcgcggcccagcccggcgttacctgcagttcggcccgcagccgcttgttctccgtgtccagcttggcctcgcggcggcccatggacaacaactcctggttcttgctgacgcgaaagatctcgtactccttcctgagccgctcgtactcggccgccgcgtactccagctctggcaccgacgagccagtggacttgaagctggcccccagcagcccgcccgcgcccaccccgcggggcagcgacccgggcccggcccctgctgccgcccccgcgcctcggcggaacgagttgcgcagcaggcgggccttgggcttcacctccaccgggatctcgcaggcctcgccgccgcccgccccgtacgtgtcctcgatcacttccccgcccgcggggctcacgagcgacgaggcggtccccatggcgtccgttgccgc

SEQ ID NO: 96385 - DNA, 388 bp, Homo sapiens
acggaggagcgcggggagggcgaggggaggaggaggcgcccgcctggttccctgcaaagcggccttatttatctgggcacagcctcagcctccccggtgggaggcttggggcggccgatcctctcccaccggggagctcctttccgtgcgtccccatgacgggaggtcgcccggcggacagcgtggcatgagccaggagcccgggccgagagcgtgccaggaagatgtcgagcccgggcatcgacggcgaccccaagcctccatgcttgcctcgaaacggtctggtgaagctgccgggccagcccaacggcctgggtgcggccagcatcaccaagggcacgccagccaccaagaaccgcccctgccagccaccacccccacccaccct

SEQ ID NO: 96386 - DNA, 497 bp, Homo sapiens
acggaggagcgcggggagggcgaggggaggaggaggcgcccgcctggttccctgcaaagcggccttatttatctgggcacagcctcagcctccccggtgggaggcttggggcggccgatcctctcccaccggggagctcctttccgtgcgctgccgagggggcccggccaggacgggacgcggggcgcagggcgcggccgggccctgccggccagtccagcaccccggcggcccccgcgcgccgacgcccatgccgggctccccatgacgggaggtcgcccggcggacagcgtggcatgagccaggagcccgggccgagagcgtgccaggaagatgtcgagcccgggcatcgacggcgaccccaagcctccatgcttgcctcgaaacggtctggtgaagctgccgggccagcccaacggcctgggtgcggccagcatcaccaagggcacgccagccaccaagaaccgcccctgccagccaccacccccacccaccct

SEQ ID NO: 96387 - DNA, 389 bp, Homo sapiens
ggcaagggcagggccagagcaaggtaagggtcagggccaaggctagggtagggacagggcaagaaatatggcaggaccaggggcaatgccaaggccaaggctgagtcagggctgagtcagggcagggcagggcagggcatggtatggccagtgcaggacaggacaagagccggtccacagagagagcagggctgatgccaagaatgagccaggctagtgccaaggctgaggcagtgtcagagcatgtccagggcagggccggggccagggccagaaccgagccagggcacagccaaggcagggtagggcggggaaatagcgtggccgggtcagtactgggacagggcagagcagggcaaggcgatggtaggggcagggcagagacaggc

SEQ ID NO: 96388 - DNA, 810 bp, Homo sapiens
agggatccatggaaagagcattcccagaagcggggccaggcagtgcgcacagtgaggagagcaggtgtgtgtgaggttgaaacaaaacgttcaaagccccctcggaagcccatccacaggtgtgtgactgtgaaccgcatcgtaatctcctagaaagcaagaacatcaggcttacattttccacttgcctctcacggctcagagctctgcagtatatacattgaggaaactgggccctgagacattaacttgcccaaaagatcacagtgggcaacattctagagcacagtggaagccgacagcaatgtcagtgaagatggaaaacagaacgtggagagagatgtagcttactagagccctgtggcttcaatccccaccaggaatgtcgtttaagaggaaggtgatctagcacaaattcacatttgcttgaggaagaatacaaatagaagcagcctcggggagcgggcggggctggggaatccctggcctccctcctttccttctggctgatcttctgcagaagacctcacaaaagggagctgaggggccaggaagcctgtggatgccctgaagaagaatgagtagatctgaaagggcagtagaacagaaccagaatccagtgcaaaggccctggggcaggagttcgcaggagaagcggggagaaggaaccagcctatgatccaggaatgcagtgaacaagatttgggaagttgacagagaatatgaggcctcctctccaaacagaaactccaggacgcttggttgagtcactgacacatgcacagtgctgagcatagtaccagacaccag

SEQ ID NO: 96389 - DNA, 728 bp, Homo sapiens
agggatccatggaaagagcattcccagaagcggggccaggcagtgcgcacagtgaggagagcaggtgtgtgtgaggttgaaacaaaacgttcaaagccccctcggaagcccatccacaggtgtgtgactgtgaaccgcatcgtaatctcctagaaagcaagaacatcaggcttacattttccacttgcctctcacggctcagagctctgcagtatatacacaatgtcagtgaagatggaaaacagaacgtggagagagatgtagcttactagagccctgtggcttcaatccccaccaggaatgtcgtttaagaggaaggtgatctagcacaaattcacatttgcttgaggaagaatacaaatagaagcagcctcggggagcgggcggggctggggaatccctggcctccctcctttccttctggctgatcttctgcagaagacctcacaaaagggagctgaggggccaggaagcctgtggatgccctgaagaagaatgagtagatctgaaagggcagtagaacagaaccagaatccagtgcaaaggccctggggcaggagttcgcaggagaagcggggagaaggaaccagcctatgatccaggaatgcagtgaacaagatttgggaagttgacagagaatatgaggcctcctctccaaacagaaactccaggacgcttggttgagtcactgacacatgcacagtgctgagcatagtaccagacaccag

SEQ ID NO: 96390 - DNA, 996 bp, Homo sapiens
agggatccatggaaagagcattcccagaagcggggccaggcagtgcgcacagtgaggagagcaggtgtgtgtgaggttgaaacaaaacgttcaaagccccctcggaagcccatccacaggtgtgtgactgtgaaccgcatcgtaatctcctagaaagcaagaacatcaggcttacattttccacttgcctctcacggctcagagctctgcagtatatacacaatgtcagtgaagatggaaaacagaacgtggagagagatgtagcttactagagccctgtggcttcaatccccaccaggaatgtcgtttaagaggaaggtgatctagcacaaattcacatttgcttgaggaagaatacaaatgacatatcacacaccaaccgtgtgcaaagcactctacctaaagatcagcgctaacagaggaataagcagaggcctccaggagcaaagagtgaaaagtctcccaaggattcaagtacgggggaagtgggtggagctttcaccgtagaatctttcctggagaaaaagcaaagagtgggacaacaatgaaggcattaaaaataactgtcaagttgaagaaaaaatctgaagtttatcaatacatgatctcctcaaaaacgaaaggaataaaacaagtatctgcaatttgctgagaacttaatatgtgtcagttgcctgcaaaactcatcattctttagactttcaaatacatctgtgaggacggtattgttgtttccacttacacatgagaaggcaagagacaagcccacggtcacccagctggaaaactaagctccatgagaagaggggacttgcccatgtggctcagggctctatgcccagtgccctagacagtgcctgactgtgtgtgcggaatgaatgaataaccttggtgatccacccaatggcactggcgctcagtgacctcatctgaaatggaataaggattttatgaaaatgcatgtttgttgaataacacaaaggagaatattatcta

SEQ ID NO: 96391 - DNA, 194 bp, Homo sapiens
ttgaggaaactgggccctgagacattaacttgcccaaaagatcacagtgggcaacattctagagcacagtggaagccgacaggtaaataagtagatgggtagagtgcaacagacaggcagacagattgagacaaaaatgggaaaactgggaaatatggaaaagaacagggaatggatgaaaagtagtcctaagc

SEQ ID NO: 96392 - DNA, 554 bp, Homo sapiens
  misc_feature (530)..(530): n is a, c, g, or t
aattcgatgtgggaccagagctatatatacagcaggaagctgcgggaattgcgattcaaactttcaggcctgctgtctccctgggaattctgttctcactgcctccatataaagaaatacacgtgcaggaggcagcccagagcaccctcctctccctcccaaaaacccacacagtgatcctggccaggccccctgggcccaggaggagccgtgtccccattaggcatctctgagctgtgctttcacattggggtcccccccaccagggctggtggaacacaaaggggggtggccaaggcagagaaagagcccgacaggccaggagccggcttttctccctgctttcttcctcccttgcttctttgttaagctccctttcagctgaaccggcagagcctgggtgttccgagctgacaataattgctgcgtctagacagtgtctggtatgaggcctccctctccgcgcctcaccggcctccccgaggctcctattcccagccccgctggcccctgctctgcgccctctgagnccacagtcgaagggatcctctaga

SEQ ID NO: 96393 - DNA, 863 bp, Homo sapiens
aattcgatgtgggaccagagctatatatacagcaggaagctgcgggaattgcgattcaaactttcaggcctgctgtctccctgggaattctgttctcactgcctccatataaagaaatacacgtgcaggaggcagcccagagcaccctcctctccctcccaaaaacccacacagtgatcctggccaggccccctgggcccaggaggagccgtgtccccattaggcatctctgagctgtgctttcacattggggtcccccccaccagggctggtggaacacaaaggggggtggccaaggcagagaaagagcccgacaggccaggagccggcttttctccctgctttcttcctcccttgcttctttgttaagctccctttcagctgaaccggcagagcctgggtgttccgagctgacaataattgctgcgtctagacagtgtctggtatgaggcctccctctccgcgcctcaccggcctccccgaggctcctattcccagccccgctggcccctgctctgcgccctctgtttcccacacccctgcccctatctggctgcccagggtgccctgtcctgcctccctgctgctctaggcctccctcgaattttcaatccttgcatctcttcctccctccccagccgcaccccaggcgctggccccattccctcccacggcctgaaattcagggaacaaaggtggttttgcatctggctgtggctgggagaccttcgaaggagactgagccaggcaaaccctcccctcctggctcttggccccctaggagccagagactcacattgctggcttctgagctgagctgggaagttctgggattgatgcttgagacacccttaaggctcctt

SEQ ID NO: 96394 - DNA, 745 bp, Homo sapiens
aatttagtgaagtcatgatacagatggagaaatagtccccctgaggtcttgcgcacagattttaagatgattctcacttacaagaacactgagtggttaccaactgcccaacagatacgtcaactgcaagatgttctatcaagcaattcactacttcctcccttctcaatcttcaggctctgcatatggaaatgaacatttcattatgaccctatgacctacaaagctccctctctgtcactccttatcatctttcctagggaggcaatcaaaatgaaatgattttaagattctagcactcccaactctaagatgaaaatgatgcagcaatcatgaactcctgtgttatctgtcactatctcataagtcacatgatttgaagagaagatcattcggagcagtggaaaaatgaaatcaaacatagctgctacctcagattgaagagatgtcctctccgattctttaaagtatttcctattctcctacccacctcctctgttgtttgcaagactcaaaaagataaatttatagtgaaataagaatcctccaacttacatattagagcttctgcaattaaagaaaaacagaaatcaggctgggcgcagtggctcacgcctgtaatcccagcactctgggaggccaaggtgggtggatcacctgaggtcaggagcttgagaccagcctggccaacatggcaaaaccccatctttactaaaaatacaaaaatcagctgggtgtggtggtg

SEQ ID NO: 96395 - DNA, 298 bp, Homo sapiens
tatagtcgtctccatggtgaggcactcttgggtgcccataccatagcttctgtgccagtggactgtgcttgaccagtggagagctcagcaatgtggcccctacaggcatgcatcagcctgcacattgcctctccatactgcagctcttctttatatggaaacttcctatatcactttgctggtgtgtgtctacacaggtgggttttgctgtacttgccctaccagcacacgggagtgcagccacacaccccaacacatgtcaactgctattgacgatggaactatggtgggcacagag

SEQ ID NO: 96396 - DNA, 379 bp, Homo sapiens
ctgcgtagaggctgctttgtgtctctttgggctaattcaataagcccatattgcggggctgtggcccagagtttggaggaatgtgaataattcagaggcgacttagatgcagcctttggagggcttacgggttaatgggagacacacacattcagtaatctcaactttcggtggcccagctcagaacaacgccaggtggaggtggtctggagaaatccggagaccgcctggattgagttctactgcgattggaagggagattccacagcccacatactttggactttaattaagtaaccatggcctgtgattcaatgttgattctgatttcaagacatctctgcctcgagacagtggaaaaccacatgccttgctccaa

SEQ ID NO: 96397 - DNA, 126 bp, Homo sapiens
ggaggcatcacactacctgatttcaaattatactataaggccatagtcaccacaaccacgtgcttctaacttttaaatgagcacaaatgactgctttgcttctcctacctcttcttccttctgcct

SEQ ID NO: 96398 - DNA, 512 bp, Homo sapiens
gctccttctaaaagatgtgaattgaaaggcaacacaagccattagtggaccgttttcagttttcattatcaataaaatggaagatcagcattttcatgctgtgtgaaggcttcaaggatgtgcattgttgctgttattatctttaggccaggctgctgcctgcccctactaatgcagatggaatgatgagcccatcaaaataaaaataaaacaatgaaacggtcagtcatagagtgggtggctgacctggactgtcgtatgaccccttgaaaatgtccctttgaatttagtgaaggctggatggtaaagaccacagatcatgacagaacataaattcgcctcataataagattagaagacaggcaaaatcgatgtcctgctgttacattagaggcagactctaatctggcattttcctcggaaatgatcatttcccttgcaacgggggaatcatggatgcaactagcttaaatccgacaggctctgttttgccatgtagttatttttcatct

SEQ ID NO: 96399 - DNA, 1188 bp, Homo sapiens
aggtccatcctcataaatgtgcaaactgcagaatttgcacagtcagctttggggacacagttgcaaattgcattgcattctactcagggctctggcttagagacaaaaagagctcaaactcaaacagtccaagcatagcacagatccaatagcagcccaagaagggtcctcaacccttatccttctttctggagtgctacaggcagacccagtattgtagatacatagagcaacaaaaagggatttccaggaagcaccatcctgctcagttcaaggttggatagaggtttccagaggctccttagtggttttcagggatggtctctctggtcacatccaccctccttgggaacgtttgctgccttccgggccttccacagacagggttattgattcacattagggggctgtcacgaaacacctggcagtgagcaagagaaaatgatgcaatcttgggtgtgattccaactgaatcctcctttagacagagcgagtgagtttgtggaaagataagagaccttccaagagtttcctaaaccaggacagttttgtgctttgtgccttgattcattctctgtatatgatgtcacagaagagccaggtctgttccccaggttgatgctaaagtttgtgtttctcttacgtcccctcagtgagggaggacgctggggagcatgggtagctgcggagagttggctgagatttatattcccttttcaacttctgttctctgaacacagctatagaattgaaatgaggagaagaaagaataaccaaaacagagttataattcgtattattatattgctgatacatatgtcaatatttatagagtactgtgtgccaggaactggaagaaatatggtctgaaggacgcctcatttaatccacgtgacagcttccgaggtgtttttaccgctatttccctgcagccttgaggggtcagttggcttctctgagccgcacaggtggcaaatcccagaacatctggtgcctgagccagtgcttgtcaataacaccctgcataaggaattcacaggcacacctttccattttccagtgtgatttttttgttttttgtctttgcatattaagttaaatgttattacaaaagagtcaaaactttaaaaaatttaaaagtagataatggaaaaaatgtgacagaaggttaagattaatttattatta

SEQ ID NO: 96400 - DNA, 210 bp, Homo sapiens
acttgggcatgtattttctttggggaggattggcgggatcattggtgtctggttgcctcactccacctccctgcctaagccagcctctagtcatcagtcaggaagtcagcaaccttgagaaattcagcctttgaagctgtgccccccgttccctgctttctgacagaaagtcactcagtgataaagtcaagcaaagctagatgatgcttg

SEQ ID NO: 96401 - DNA, 246 bp, Homo sapiens
agagggacaggagggcctgagggctgcttcatacagggtgaggatggaggggttctgaggagggaccatgttgggaggctccacggaggacagtctggaaggactgaaggacagccaatgtggccaaagagtagtgagtgtgagagagggggagccaggtgaggttggtggggaggcggtagggacgccacgctcctgctgccctgactgtggggcacagggtggcagtcaggcctgtgggtcacc

SEQ ID NO: 96402 - DNA, 316 bp, Homo sapiens
gcagacctcaaaacagaatgccaaagtgatcttaaaattcaaaaatgagtttactttctttgttaaagttctcttttgatgcatatcccccattcatggaatggaagcattatcttgggtgcagcattacacgtagagttaaaatgtggaaacaacccaaacatcctgatatggtttggctctgtgtcaccacccaaatctcatcttgaattgtactctcataattcccatgtgttgtgggaggaacccagtgggagataatttgaatcatgggggcagtttccctcatactgttctcatggtagtgaataactct

SEQ ID NO: 96403 - DNA, 425 bp, Homo sapiens
taccacctcagccaagtgatcaaggtgaacgtcagaagtactccatacagacatcagatagctgagacactgggaaggacacatggcttttatggtattcttcccaataatgtgtaaccttaaacaattaaaagtaatggcaaaacaattaaaagtaatgacaaaaaccgcattcatttttgcaccaacccaatagtcatgagaaaacattaggtaggcctcaattgagggtcattctctaaaatcactgacctgagccagacatggtggtatgtgcctgtagtcctggctctgcaggaatctgaagtgggaagatcacttgagcccaggagttcaaggctgcagtgaactatggtcaccattacactttagcctgtgtgacagagcgagacccatctcaaaaaaataaacagtgtttatttaaa

SEQ ID NO: 96404 - DNA, 465 bp, Homo sapiens
catgtgtttatccccagctatgtatgcttcactgctcttctttgtgttatggctacagtttcctcactgttctcttcatgccatgtaatttcacttggactttctaggctctgatgagaagtttggaatttttaatgtatattgtttttaactggcgtgtttgagattatagcttatcaatgcaacattcagatcatgtaattgaggtaagactaattcactgtccacatgtaagaggattaagtgagcaccgtttttctctttgtaaaagaaaaattgtatgagaatctaacacaaagtgtgttaaatgtaacataccttaatatatattaaagcataaatataagttggttgcagattgtaagcaccatatgaagaaacacatcagaagtttgaaatctcttaaaatatatctttgaaataaaatttttaagacttaatggtagatgaagaattttacatata

SEQ ID NO: 96405 - DNA, 616 bp, Homo sapiens
agcggagtgggttcgaaagttcctgtgtgcagaacagaaggctggggtgagggtgggagtcgggtgctaaatatttctactaggctcctgcaaggctagtgatgcagcgggccccccgaccggcgctcgcccgggttctgcgcctaagagttggccgtgagcgacccgcgccgccgggagcctgggtctaggctctcccgacaaggattccaaggcgagaacactggtgcctctgcctgggccagggagggactgaaatcagagcaggggaggcgtttcccccatgggctgtcacccttaaggggccgggagccgaggtgggcgagctcgagagcagagttggagaggtggctgctgtgagttgcatcgggcgttgaggtatctgatgtctgcaccgtttatctaccagacgacgaggcgatttatgcaacagtatcctgtttcagcactgccaaggctatgcgagaacgcggccaggacagcctggcaggactcgtgctgtatgtaggactcttcgggcaccccgggatgctgcacagggccaagtacagccgctttcggaacgagtcgatcacgtccttggacgaaggtagctccggaggctcggtcgggaaca

SEQ ID NO: 96406 - DNA, 791 bp, Homo sapiens
attagtttactaatctgtctctttcttaatctatagtagattctgttaaaaatggttattatcaaaggacagctctcctgtgttttttgacccttgttaaaaatcaaattttgacaaattttacttaaagatcttttattagggattcatgaattgggcagcatcccatctaaagacttcaaaagccactccaatgagctgaacaaaggaggtacttataagtagaaaaaggccaaggaaagcagaaagaaggagcaaaaaacagattggtagttacaaagttactttccttacaggattcaaacaaaggagacttctttaccatgccagctcaggtaaactgggcctctactgattgctgtgaatctctggatttttggaatattggctcattttagagtttgattaattacattaatgagtgactccattctggtttggtctggccagttgagcctagtccaagtactcagtccaaaacaatggcctcccataatttttatgtgacatcctctttatttgaattgaatatgtatacattaagtatctatttttaacctatcccatgaacaaatggtcttattcctgttttaagatcagaagcttttatccaccctgtgtataaaccacagcagatttaatttaattccagattaatttcccctggatacctgtagatatctgggccatcatgtgtctttaatgaaaggtattagtaaaaactaatttttaaagtttgttttagtcatttgagtaataacaataacaaaataataataatagaataaata

SEQ ID NO: 96407 - DNA, 664 bp, Homo sapiens
acaggatattgcagtcaagttaaacaagaaggttcagatagggtcttactctaaatgtcttatattgaagtatgtaaaccatattgtggagaaagagtgcttatcaatttaagattcactttctatccttccttctctcaagatgaaatcttttagtaggtcacaactagtggatctcagtcagttaattttacctcagcaagtagttggctgtagttcatatatacattaatgtaaacatcaatattgcctataggggtttcttgatttttggaagcttcactttcttccttatattttattgctccctccccaggtctgccatatcatatttctgttctgtcactctcacggtttcttggtaaatgtccaaatatcttgcctgtttttaaaaattgtgtcttaaaattaaaacttttgttgtgacatggctgtagattcacatggagtaagaaatattaaagagattccagtataccctttacctacccagttcccctcagtggtagcatcttaggaatacaatatagaacaatatcataaccaggatatagacattgatacaaccaagatacagaacacttccataaacacaaagatccctctgtttgcccttttatagccacccttacttctctcccattaaccccttcctcaagccctg

SEQ ID NO: 96408 - DNA, 140 bp, Homo sapiens
ggtgatgctagagtggcaggctggctgaccccattaattgtggaaagagatggcgaggcccccagaacagcagggatcaggatggagggagggaacaggtctgagaagtctgtggaaggctgcgagggtggaggatccct

SEQ ID NO: 96409 - DNA, 493 bp, Homo sapiens
tgactttagagggtccccccaaagagtgggactccatttttaaaaaaaaaaaaaaaaaaaaaaacccactggaaatccattatattccagtattcagccaccatatcctgcttctagtctaacactgtatgtatgatagttcatgtgtatttgacttacatgtttgaccatttgaccatgtttaacaaatctcttgctacactgcaatgtctattctccccgtttgtgttcactcaaagccaaagaaatggtggtggggaagaagcaagcactttggaatccagacagacctgagtttgaatcctgactcagctactatttatttgctatcactttgctcaaattatttgaccttttgagcccccgtctatagtttagttttaagatcgtatgtaaagctcttggagtcaaaggaactcaaatgttaatttcatcatatgtatacaccataatgccttatttaaataaacaatccagtcagtcgttactacca

SEQ ID NO: 96410 - DNA, 417 bp, Homo sapiens
ggtttagcaccatttatttgtgatctcagctgttgtagtagttgctgctgtcagcctgttctcaaaggtaacatgctccttacatgtttgaccatttgaccatgtttaacaaatctcttgctacactgcaatgtctattctccccgtttgtgttcactcaaagccaaagaaatggtggtggggaagaagcaagcactttggaatccagacagacctgagtttgaatcctgactcagctactatttatttgctatcactttgctcaaattatttgaccttttgagcccccgtctatagtttagttttaagatcgtatgtaaagctcttggagtcaaaggaactcaaatgttaatttcatcatatgtatacaccataatgccttatttaaataaacaatccagtcagtcgttactacca

SEQ ID NO: 96411 - DNA, 929 bp, Homo sapiens
ggatgtctttccttttttaaaactgaaatcatgttttagttttctctctttttagaatttaattcttgggaatctttcaagtctaacacacatgataaataatgcatatatatgtaactatatgcaacattcccttcattataaatcttgactgttttaaaaaatggtttgaatacagaatatttgcatcagttttttcctttaatttgaaatactagagtagctgttcttattgcttcctttaaaaactacgattgaagtacacaaacagtatcaaatgttctactttgggcaaaactagactttactgtatcagaaaactggaaatccaggccgggtgtggtgtcacgcctgtaattccagctactagggaggctgaggcaggagaatcacttgaacctgggaggcggaggtcgcagtgagctgagatcgcacctctgcactccagcccaggcaacagagtgggactccatttttaaaaaaaaaaaaaaaaaaaaaaacccactggaaatccattatattccagtattcagccaccatatcctgcttctagtctaacactgtatgtatgatagttcatgtgtatttgacttacatgtttgaccatttgaccatgtttaacaaatctcttgctacactgcaatgtctattctccccgtttgtgttcactcaaagccaaagaaatggtggtggggaagaagcaagcactttggaatccagacagacctgagtttgaatcctgactcagctactatttatttgctatcactttgctcaaattatttgaccttttgagcccccgtctatagtttagttttaagatcgtatgtaaagctcttggagtcaaaggaactcaaatgttaatttcatcatatgtatacaccataatgccttatttaaataaacaatccagtcagtcgttactacca

SEQ ID NO: 96412 - DNA, 647 bp, Homo sapiens
tgctcatagctgattccagaggataaaccacagtaccgacagtacggacagatcccacaattatcgttttaatcaaaagctagaaatagttaagcttaatgagaaaggcacatggaatgccaaagaagcgcgacatctaagccttttattacaccagtcagccaaattttgaatgcaaaggaaaaattcttgaaggaagttaaaagtgctactcccatggacacacaaatggtaaaaaagcaaaacagccttattgctgacatggagaaagttttaacggtctagacagatcaagccaaccactacattccctaaagccaaagctttaatccagagcaaagccccaactgccttcaattctatgaaggctgaagaagtgaggaaagctgcagtagaatagtttgaagctagcagaggttggttcatgaggtttaaggaaagaagccatttccagcacatattaagtacaaagtaaagcaggaaatgcagcaagttattcagaagatttaactaagacaactgatgaaggtggctgcactaaacaacagattttcaacatagacaaaacagccttctattggaggaagatgccatctaggatttttagagctaaagagaagaagtcgatgctgtattcaaaatttcaa

SEQ ID NO: 96413 - DNA, 456 bp, Homo sapiens
gttttgacctagccattgagggaggcagtgggcacagagagaaaagagcaggaaggccttcgttagtgaggggaggctcaggcagagacgcatgtgccagtcgctggattggcgtgtgaggaaaaagaagggaagagaattgaggctggtgagataggaagtgagggaggagctggggttaggacccaatattatataacagtattgcctaggctggagtgtagtggcatgatcatagctcactgaagccttgaacttctgggctcaggcgatccttctgccttggcctcccgagtggctgggactgcgggcacgtgccaccacacctggtgagtttttttgtagagacagggtctcactgtgtttcccaggctggtctcaaactctcggcctcaggtcatccttctgccttgccttcccaaagcattggaattacagacatgaaccacggcacct

SEQ ID NO: 96414 - DNA, 299 bp, Homo sapiens
ctggcacctgtatatgttattcatgaacctagagactgacccacttagaactgtgagggccctcacgtgacatccaagggcctgacgatagatgtgcctcgccctcagctaccacctccagacactgttggagtctaggcattggctggccatacctgcagctgctgacacacacacacacacacacacacacctttcaggggctcaataatggacctaccttgcctgccactggcacctgtgggcacttcccaggggcccagggactggctcgtccaccctgcctctaccactattgt

SEQ ID NO: 96415 - DNA, 311 bp, Homo sapiens
aaaattccactgaggcaatgagaatagaaggggagagaatagatgtcaacaaattttcgaaagatgagagtggtaacagacttagtaaaagaagtgattttttaaaagtgccttcagaggtgatctaattagaagacaatgggtttctcttagcaaaaagccctttttcaggttgtatggaaggtgggagtgaggattgtggctaaaaatcaagattctgaagacaagtatctatgcagcttagtgttgattccattctcacaactctgccatacaaagataagctatgactgtttccattcatcttccca

SEQ ID NO: 96416 - DNA, 466 bp, Homo sapiens
tgaggttgggagttcaagaccagcctgaccaacatggagaaaccccatctctagtaaaaatacaaaattggccgggtgtggtagcgggcgcctgtagtcccaggctgaggcaggagaattgcttgaacccaggaggtggaggctgtggtaagccaaaatcataccattgcactccagcctgggcaacaagagcgaaactccgtctcaaaaaaaaaaaagaggacctagaatagtttgaaaaggatgaccaaaatttgagaacttatgctactcaattgcaagacttactatgaagctacagtaatcaagacagtgtaggctttggggtaaagacaagacatgtagatcaatgaaacagaatatagttcagaaataaacccaaacacatgtggcttaaatctttacttgattttaaaaaaatatatttgtctaatgtatacttcttttaaaagtaaacgccatctga

SEQ ID NO: 96417 - DNA, 419 bp, Homo sapiens
ataggcacattttacaaattaaaaaactgtattggcaatgccacattttagttgtttggagaaattggttattttatgtaagtacattttcccagtaaatgaaataaaatttttattaaaatgttactttgtttctcctcccttttattattaccttttctcttttagttattcagtcccattattatggctgtgtttccataaagtaatgtccttagaggccttgatgtgtttcatcattcacccctgggtcctctctattccattctctcatctcaattagttttggagtaacttagttgtaggaattgccagagcaaacccagcaacaaaggttgttaaatcaggatgtctaattatgtacatcagtggctctcaaacttcagtctgcctcagaattacttggaggcctagttaaa

SEQ ID NO: 96418 - DNA, 409 bp, Homo sapiens
gtagaagattggaattggtactataaattagacttctagaaactagagaaaattcagcctctaaaatatttgtgtcttttcaaatatttagatacattattttactgaaccccttagacatggtattctgatacttgatttaatctaatcagatgaattccttcttgccttctcaaaaagagtgatgatgttgccattttaataataaatatagtgaaatgtaagatgagacaatgtcagggagttatgaacaaatatgcctctttctctaaatagcccagtttttagtggtatctatttttgtgtagccatgcactgaaaatatcacttgagtgatataatttcattgagtgagtgcttttctgtatttttaaaacccaaagctcttttaggggtgtgggatagatag

SEQ ID NO: 96419 - DNA, 361 bp, Homo sapiens
ctatgctcagagtagagaggggttttgtgctgaccctaatccggtctctcaccagttgcataatcttgggtaagtaatttaacctttctgaagcttcagtctccccatctgaaaaatgaggataataagagtcttccaggctgagtgcagtggctcatgcctgtaatctcagcactttggaaggccaaggtgggcagatcacttgagatcaggagtccacgaccagcctggccaacatggcgaaaccctgtctctactaaaattacaaaaattaaccaggtatggtggctggcgcctgtaatcccagctactccggaggctgaggcaggagaatcgcttcaacctgggaggtggaggttgc

SEQ ID NO: 96420 - DNA, 433 bp, Homo sapiens
acctcaacctctgtcccaggcaggcagtaggagttaaaatttcctgctggaagtttggtcttcctttgtacttccttactggtgcataaaggtttaatgatgtttatgtattatataatttatctctgtataatcaccctttgttctgcataatgctctttgctttaaattatccttttaataccgcccctctttcctttgattagaattccagtgttatatctttggcccaccacttattttcaacctttgtcattttgtgtcaggtgtacttcatacaaactcttgtattttatttcttaagagaacaatactatttttatttgaatagggtaatttttgcctttgcatttcctgtttcatgttatactttgacttgtcagccaatttttataaatacacatacagatttatttgcttcctttaaaaatca

SEQ ID NO: 96421 - DNA, 177 bp, Homo sapiens
tgctgagattacaggcatgggccaccgcacccggcctataataagttttgagagctgttggtgcaactgcccttaacttatttttcttcagcagtttctgggctattcttggcctttgttcttccatatatatttcggaatcagcttgccaagatccataaaaaaacacttctgaga

SEQ ID NO: 96422 - DNA, 729 bp, Homo sapiens
ttgcttaagatttccttggctactgggaagtgaggagcccctttgcccagctgctgcccgtctgggaagacaggagggcctctgcccagctgctgctccatctaggaagtgaggagcgcctctgcccacccccggcatcatctaggaagtgagaagcacctctgcccggtggccaacatctgggaagttggagcacctctgcctggccactgcactgtctgggaagtgaggagcgcctctgcccagcgccgcactgtctgggaagtgaggagttcctctgcctggcctccacactgtctgggaagtgaggagttcctctgccctgccgaggccctgtctgggaagtgaggagcgcatatgcccggccgcccccctcgtctgggaagtgaggagcccctctgccctgccgcccaactgactggaaagacaggagtgcctctgtctggccgccaccctgtctgggaagagaggagtgcctctgcctggctgcccaccttctgggaagtgaggagcacctctgccctgctgcccaattgactgggaagagaggagcacctctgcccagctgcccaccttctgggaagcaaccctccaagtgtgaagtgacagccttgtgtgtgatctttctgccctccccaagtttgcattttttgacactaaagtttactttttaattaaaaaaaaattcctttgctattagggctttttagttccatacgaattttaaaa

SEQ ID NO: 96423 - DNA, 420 bp, Homo sapiens
tgttaacaggataaaagaaattatagatatgagctctttgaactctctgatagaaaagtattccataaatccaaggtattattactactaaggtggtaaaaacagttcacaatcactgaaagaaatggctagaatttaattaaaatacgcctgacatcctactactaaaaaggagatttagccaaacaagaaaactggtgttggtaatctctgcgaagaaacaaaaaattttgcttggataacagatgttttatgatagtcacgaaggaaaaagaaaacccaaacctatgaaaatgaaaaaaaatactcatactattaaaaaaaatactaacaatgatggaaaaatcaaactactacaaactattttagatccctatttagcaagccaagggaccacacctacagaaaaattttcagagt

SEQ ID NO: 96424 - DNA, 189 bp, Homo sapiens
ttagctaccaaccagtgacctgacatagattttcttatgctgctgttttcagtaacatcacttccctgtaatcatttaaaaatatgaattaaaaagaaggataataatagtaatggatgctgatcttttttcatacatgatgaactctggtcttgaggattttttacatttttcgcgactctatattat

SEQ ID NO: 96425 - DNA, 648 bp, Homo sapiens
atggggagatccgtctaaagtctgagctgtaggctgggagttgggtactgagcggtcgtgtcagaacgtctgtgagagggagaggccgaaggggctctatggagtggaggattaggggtggggagactatcgggggttggatcaggcacctctgctgaccaagcagcttctggtgacacagcttcacttggaaagactgtcccctcatatgatcccacccaatccagatttgtgcttcctctcctgaatgaacaaggaaaagtacttcctttgtccattcttcctgttttatgtgaatggagttaacactgtcaggaatttgaaagtaaacatggttcctgccctcaggaagctcacagtctgcaggaagacatggaacaaaacaaacatttaccatgcagtgtgataatagcccagcacagagacacctaacaggcctgggaggtgtatggaaaggctttctgaagaaataatctataagagttagctcttgaggaggaaggggaaagtgatccaggcagagggaaagcctttgaagtagaaagaacatgcagctttctggtaacaaagtgatccaaggtgagtagagagaaactaaagaggaaagtggaagctttcaaatctcttcaactgcagactttttcctga

SEQ ID NO: 96426 - DNA, 401 bp, Homo sapiens
ttcagtgtgcccttgggcagcttactttctgctgctgggcaaactgatatttgcccatacataacagcattggaaaacagaaagtcctgaatgtcataggagagttatgggtttcaagaactttccaagagctagcaaggaagtttgagactagacccaactgaaagcaaatgtcctatttgaaaaggggaaagtgttaccatgtgtcatggcatggtgaaaaggacaagaccttgaacaaggagagcagccacaatttcaaggctgacaccaaggcagcagtgcgaggtcaggcagaccctcttaaacccaatgaacttcagctgtccctactgtaaaactgtccaggagtatgctaactttcaaagttctataatattaggagtcttatgatatctgct

SEQ ID NO: 96427 - DNA, 395 bp, Homo sapiens
ccagcactttgggaggccaatgcaggaggatcacttgaggttggaagtttgagatcagcctggccaacatggtgaaaccccatctctaataaaaacacaaaaattagccaggcgtggtagtgtatacctctaatctcagctacttgggaggctgaggcaggagaatcgcttgaacctgggaggcggagattgcagtgagccgagatcgcgccactgcactccagcctgggtgacagagtgagactccacctcaaaatagaaaaaaatttaaaaaaagagaggtgtagttgataggcctgtcaaccctggtcttccccaggagggtgggcagcggaaggaactgaagacagatctcaggtttctgactttcatcagcctccgatttctcaaagagc

SEQ ID NO: 96428 - DNA, 572 bp, Homo sapiens
cgggcgactaagaggatcccgtcgacggtactcaacataataaatgccatgtattaaaaacccacagctaacttcacatttaatgatgaaacgtcatagcttttcctataacatcatgaacaagaaaaggatgcctacttttgtcaattgcattccacagaacactgcaagtcctatccagagtaattagacaagagaagcataaaggaggcatcctaattggtaatgaaaaagtaaaattatctctgtctgctgatgatagtatctaatttgtagaaaacattaactatcccacaaaaaactattagaactattaaaacaattcatcaaagttgcagcatgcaaagtcaatatggagaaatcagttgctagtgtaaaaaatagaaaaggaaattttggaaacaatccaatttaacagcatcaaaagaataaactacttaggaatcagcttaaccaagcaggtggaagacttgtagagtgaaaacttcaaacaccctttaaagaaattatagatgacataagttattagaaagacatcctgtgtttatggattggaagacttaatattctta

SEQ ID NO: 96429 - DNA, 490 bp, Homo sapiens
atgcctatatgtgatctgtgtgtgtgtgtgtgtgtattctgatggcatggttttataaacactataccaggagaaaggaggtgtttcatgcccactttgctggtgatgaaacttgctgtgtgaccttggtggttcaatcctctctggtctccatatgtcatccataaaagtaggaacatgatgggcgtggtctctaaattctcttccagttccagcctggctctgctgcatgatactgcctgcctcccaagggatgcgtccatatatggaggacctgccacatcccttcctgggctgccctctttccaaagatgcctgcgcttctcctctgtctaaggaacagacttgtcacaaaggggtaaattacccatacctgctccaaatgtctagacaccttgatgctatgactcaattttctttgccagccctgcaggccttcgcagagcaggcacgttcatcttcctagcatggcccagccctgccaggcatt

SEQ ID NO: 96430 - DNA, 235 bp, Homo sapiens
agatcaggctaaataattgtgacagctgctaagataatggaaaggggctgggtgtggtggctcacacctgtaatcccaatactttgggagggtaaggtgggcggactgcttgagctcagaagtttgagacctgcctgggcaatatagtgagacctcatctctacaaaaactaaaaatgttaactaggtgtgctgtcccatgactgtagtcctggctactggggaggctaaggtgg

SEQ ID NO: 96431 - DNA, 279 bp, Homo sapiens
tagccagatatggtggtgtgcacttgtaatctcagctactcgggaggctgagacaggagaatcatttgaaccctggaggtggagtttgcagcgagcagagattgcgctactgcactccggcctgggccccagagcgtgactctgtctcaaaaaaaaaaaaaagagagaccaggtaacttaactttgaggcaatcacttttagcttacttacaatggtagcattgtttctttgtgaaaatgaaattttctcagcttatccactaaattttcagcaacatc

SEQ ID NO: 96432 - DNA, 607 bp, Homo sapiens
cctgcaggtgcggccccgtggcccgcgcgctgggcccaggcaggaagtgggggaaggagagagtcagggcggcgggaagacatttctccgagttctcccgaagggagccaggcgcgagcgcgacctggggaaagtccagagtgccagccacggggaagggcgggcagtgcagagtggaagagaagccagcaagttagacacagcccctctctgggaggccgcctctaaaatggaactagcggacgtaccttggtttgtacatttgaccatggacacacgtaaagattttgaaaaaaaatctttgaaaaaaaatttttttaacgcaattcctaaacttttaactaacgcaattttgtggacctctgaatcttaattcaaatgaactggagaacaactataaagcaatttcgataatatgatcagtgacattttatattgcagaattgtaaattttgttgtcattatactgtaattttatttctttaaaagaccctttttagagccacaaatatttgcagatgatacctgatttcttgaatgtttcagattacgtggaaagtggaaatatacatgaaacaagatgtgctatgaactagtaatttttatt

SEQ ID NO: 96433 - DNA, 544 bp, Homo sapiens
actcaggacattccgttgggctagagagggagaaccactcagctggcttaatgaaagacacgggtgtgggactttgtcagcagatgcaagcctggagccaccacacagcagagaggagtaggaaaccagagtatggaagccccttcctctcctgcaccaaatcactcacagcaccatgatgggcagcagtagaaggattagaaaccacaccgccctgataggagttgaacttttcttcaactggctcttaagctgacatgagattgcgctagttggaagataccaagatactcttaaaagagaagatgaagttctcatgtttcaacccctattactattgactgtcaacttcccaaaagaccccagaaaaacatgttaatggaacaaaactaagtttattagatttactgtagtataagagaaaaccaccttggtagagtcttgatagtgcctcaggttgacaaagtcagggtctgcactgggggacttctaaggtagcttttgcaaggtggggagtagcttgggactgggcagggtttctacc

SEQ ID NO: 96434 - DNA, 374 bp, Homo sapiens
gtatagtggtgaggttaaggggttgggtgatggacggcctcaatgagaaggtaatgtaactggagcaaagacctaaggataagaggggagtatcttcatagttaaattaactttatcaaaataaactgtatcaacagtataaaccagagaaacataattaagtattttatgatgttaaaacaaaagttaacactttgaaaatttaaaattataactttatgaagtacacatgtagaggtgcgtgatattagcactattattaggccatgaatttaaatttttttgttgcttatcaatttagcaaatgtttatcaatttatgctatttgtaggacttttttctgcgtttttagactcttaaaaaatactacaatg

SEQ ID NO: 96435 - DNA, 449 bp, Homo sapiens
ctctagaggatcaacgcacgaggcgaggccaagttcccaagatcacacagctactaagtagcacagctggggctcaaaaccagagccatgtgatcagatggcccatattctttttgttccctcccatcaaccaagcccaggcccatggctgagcatgatggccaagcagggaggagggtcagctcctcttcaaggaagaaaacagcatgctgttctttatatatgtaaatgatgttctgttcctcacccatcaccaatcacacaggtacttaggttgcaaggtgtggggactgccatggtgatgatggctctccccaccagtcctcaatgggaataccagcaagacgccagtccacagtaagggattctgtctgggccctccagacacccagagggccacgatgagatccactccagaggagtaattgtaccctgccccaaactaccag

SEQ ID NO: 96436 - DNA, 553 bp, Homo sapiens
gagaataagggggagagagagaatggaataatttaccaattaagtagaatacaagataattccccagaagtgacagatacgagcttataaactgaaaaaaaaaatgcaccgagtacttagcacaatatattttaaatgaccacacactaagccagacacagaatgtcatgtgttatattgttttatttatatgaaatatctagaacgggtaaatccatagagatagcaagcagatgtgggactgccagggaccggtgaggtggaggtggggaataaatgcttaatgggtatagggtttttgttgggtaatgaaaatgttttggaactaggcacaacatagtgaatatactaaattctacagcattgttcatatagttgttttatgttatgtgaatttcacctcatttaaggaaaaaaaagagaaaaaagagactacacactgaggaatatgaaatttaagagcaccaggaataaagagaagattccgaaaccttctagagagaaacaaaggatatcatatagtcataataagctaaatttataatatagtaat

SEQ ID NO: 96437 - DNA, 328 bp, Homo sapiens
tgtttccctttgtctctactaaaaataccaaaattagccaggcatagtgaaaggcgcctgaagtcccaactactcagggggctgaggccggaggatcacctgagccttaggagttcaaggctgcagtgagccgtgatcataccaccgcactccagcctgggccacagagttaaaccctatctcaagaaaaaaaagagaaaaaagagactacacactgaggaatatgaaatttaagagcaccaggaataaagagaagattccgaaaccttctagagagaaacaaaggatatcatatagtcataataagctaaatttataatatagtaat

SEQ ID NO: 96438 - DNA, 386 bp, Homo sapiens
ctgcagtggcatgacagggcagagtcaggaaactcagattggccgggagcctacaagtggacccgtggctgccttcccctctgcactccccactaaggcaaaagcagggcagcctggtagaggctgctgcaggctaactcctctaagtctctttgtcagctgcacctgtgcccataccacaccctatgtggcatccacagctgtgtccaggagggaagatgttgccctgtcttacatcgttcagctctgtgctttcttggaaagggcagttatcaatgttgtcttcaaatttcccacacctagttctccccagcagtagctccattgagaatacggtcttggactctatctaatgtacagagagattacagtgaacacgcccctct

SEQ ID NO: 96439 - DNA, 485 bp, Homo sapiens
  misc_feature (218)..(218): n is a, c, g, or t
atgaatgaatactatgtgataagtgttggacacagcatttacataaaatatctaacttaatatttacagtgattctaggaggttttcattattatttttgtctctagtttacatatggctaaatgaagctataaagtggctaagtcaccttttgaaattctcgcagtaaatgatgatgctgggatcccgagtcggatctgttgcactcctagaccccnaaagtctgttgaggaaattcatatttcttttggcctctactgaagagtgagtttgatttttttttccctagaaatcatgagaatagttaacattttttataagcaaacttttgggggttaacaaatttgatgttataataaacgttcctgtccaggcacgggtgtcacgcctgtaatcctagcatttttggaggccaaggtgggcagatcacttgagttcaggagctcaagaccagcctaggcaacatggcaaaaccccgtctctac

SEQ ID NO: 96440 - DNA, 600 bp, Homo sapiens
agccacatcccaggactctacccacaggacgccagtagcaaaacctccttcccagttatgacaactagaaatgtctccagacactgccagatgtcccctggttaggggcagggaggggcaaagttgacctcagttgagaactactgttctagaaattcttcaggactaacttaaattgagattgactgtgttactgataaatttctgcggagggacattttcttttataataagccccatcccaatctgaaaatccagaagtgtctagatgtccactggccaagggattgaaatcagttggcagatgacaactgagtgtgtgccttttcacgattttcacactttagcagaagccttgttatctgatactgttgggacctgtaggtggttgggtaattgaaaaaggtcagttaaattgaagcagggaatgatttaaaaagaatcatcttaagttttaattaaagcttataaaagggattcaagctcaggcctttgtgaataggaccacagatatgcactccttacattaacctcagccttgatgtatcgtttaaaacatttctctcagtttgagaaaaaatagaaataaaaaacatttaa

SEQ ID NO: 96441 - DNA, 134 bp, Homo sapiens
aggtgagctcagatctgacctgtttttctgagctgcagacttgtttatctaattgtctaattgacatccacttggatgtctgatagttatcccagatctaacattggccaaatcgctcttttttccccccaaat

SEQ ID NO: 96442 - DNA, 320 bp, Homo sapiens
  misc_feature (41)..(41): n is a, c, g, or t
taagtattaataatttattaatatgaatggtaagaatatantttttgtaaaacgacaggcgctaaatatccctgctgaccgatccggagcagcgctgcctgcattggtccctcctgtctgagaaaaacctggcgtgccctccagaccccagcaacgttcgctaccttgctgccttgcagcttctgcagaaacggggagtgcaaagctacaaatccaaattcaaagccaaggagccaagatctcctgtgatcacccgaaagcatgttctcccaaaggccaagcaggaaaacaggccccaaatgctggagaccaaagttttc

SEQ ID NO: 96443 - DNA, 429 bp, Homo sapiens
ttgaattaagggtaattgtttcggataactttgaattatctgatggtatgtctaaagattgcccatgatttatttaatgttataccagaactcatatctaagttaatttattcacctgtaaaaaaggttagaatttgaaggctgcatgcgaagcttagaatttgaaggaaccttatagatcctcatgtcttgtgcttttcaaactgttttgactgtaacctcacagtaagaaacacattttacgttttgatcaagcacacatacacgtctgtatccacatacctgaagccaatgcttcacaaaacagtaatttttctatgggcagcacacatagcagaatatgttgttttatttcactttttttttttttttttttttgagacggagtcttgctctgtcgcccaggctggagtgcagtggcgccatctt

SEQ ID NO: 96444 - DNA, 355 bp, Homo sapiens
aaaaatgacctgtgctccacctattcatctctccccctaccctaaaatcttggcaaccagtgaatttttacagtttctaagtttcacctcacccagcctgtcatatagttgagatcatacaggatgtagctttctcagactgctatttttcacttagcaatatacattccttcatgtcttttcatggcttgatacttcatttctcttttttcttttctttttttatagagacagggggtctcactatgttgccaggggtggtctcaaactcctgggttcaagcaatcatcctgccttggcctcccaaagttctgggattacagacgtgagtcactgcatacggtctcatttcttt

SEQ ID NO: 96445 - DNA, 958 bp, Homo sapiens
acactttcgcagagtgggtccccgtcgcgcggcgccgcggaaaggctggaacggcgcgggtgggtgttagtcgagaccggggggcgcggggcgtgccccttggtcggcgtcgcagcccgatgggctggctggttgctacctccgggcgaccaggggcctggggacttcgtgcctgggccagggtctctttcctttcgcgggcacagtgaggagactgcgaggtgaggtgcgtccgggtggatcccgggctgcggcgactgtcacattctccccggccagaccggaggtggagcagaactgggggcgacgagcttgactgggattgcagctggacgtatttaggttcaaaacatcctcctcctggctttcttccgctccactctttggtcaggaagactggggcggggtaccccccaacccatgccctcaaattgctggcctagagggcacagcgcctttctaaaagctgcagttgggttgcctctaaaataatgaagctaacccttgctaattgtggggaaaagatagccagaagcagcaaatttctgctgtggacgtccgatataaactgatcctcttgagatggttaatgcttagttggctatacctgccccccgcccccgccgcttttttttcctttatccgttttttttttcttttttcttgagacaaggtcttgctctgtggcccacgctggagtgcagtgtcatgatcatagctcactagccctgaactcctgtgctcaagtaatcctcccgcctcggcctcccaaagtgctaggattataggcatgagctactttacccagcctgttttttcctgtgcaaataaatgcacatgtatttagatcagtttcatttttattgttaacagcattttccaccagatgcttatggttgacaactctacatcaagtgttgctgtaggctaggaatcaacaaaactttttgtataaaag

SEQ ID NO: 96446 - DNA, 743 bp, Homo sapiens
agtggctgggtggagggcaggaggacacccggggcctgacctgtgcacagcaggaccttgctatcccaccagaccggagtacacaggctgcatgtgaaggaagaggctgatctttgggctttccaaaagctgcagttctgggacctgggggaaaattggagtgcctggcttccaaacaggcataatggctctctgcaagaccaagtatgtacaaacatcccttgagcagccctgcaagcctgatgcttcaccaatgggcacccgggcttcataactgctgaaaatcatggtgttgattatcagcacagtgacggtgccaggtgctgcggaatcagcttggattttgattttgcttcctttatgtgaagccaggagagagcttagcgcccagtactccgtgccccacccccaccacatcgcagcctcccacagtcaccaggaaaagtgggggctttcagcggcagccagaaggaattcagaaacatcacatttcatttcgggaagaattggatcagcaccagtttggtgttgaggccatgagattgtggcatttttatcccaaatttatcctcccttggtctctctcagtgtgtgtgtctgtaggaagtcatcgtgtagcattatgctatgaagaaagcatcccacacttattcaattgcatcgtcccacattctggatcgggagacacagactcaagtcaacctgcagctgcctaattttgcagggaagcagccatcctgatg

SEQ ID NO: 96447 - DNA, 546 bp, Homo sapiens
attagacaaacaccaaaaattaacaaatatagaggcaaaatctactctctaataaagagaaataaaaactaagacattaacatgactgtgagtcatttggagaagaggataaaataggatgatttctaaataatagtaatctactaaacaaggtcactaggaaaatcctacaacatgaattaaactaataaggttagatacatgagcagggaattaaaggaaattcaattttaaaatgtgtaaactaaagcatcaatgacataagctatgaaataaactattagactgcagtgaaaaacctgaaagcagaaagagacttgggctgagggtggaatgggaaagcaaatgaagtgcaagttagaatatggcctaacacatttaaaagagattccaattacttcctccatttggtgattattactaggcatctgccatagtaggacactgtctgggctctggaatttttagtaaaccatctctcccgcttaaagaagaggcaacactctacctgggagcaggcaggggcatttacctgactctgcctga

SEQ ID NO: 96448 - DNA, 481 bp, Homo sapiens
caaatttccctggggggcaaaatcatccccatttgagaaccactgatctgcacgaactagaaaagaggtaccactaaaagtatacaggtagcccttcctctctggatgtaatacagccccctgccactgccatcatcacacaaaaacgcgatgagtatgatgtagcaacaacaaagtcgagcttaggaattgttaaaatgattactcaagaagtccatgtgtccatctgggagttagcttgggagcctttgccagtctctgaaggagattatgtttggaggactccatgcaatgatgggaaaagcttgttagacatccaggaccctcttctcccctgactgtatccagagtagtcccacttagagccaaaagaaggaactggaacagcacgttagatcagcaatacagcttcccactttggcctcccttgattacttctctttcctttcctttttatagttccacccggacctcaatttaa

SEQ ID NO: 96449 - DNA, 526 bp, Homo sapiens
cctgtgagatcacgcaggttggagctggccgctctgagccatcagggcagtgtggcgtccggcagcagatgtctgtgactgggcagtgcagggactcagatgggagaggtagccacaacatgggcagtctgaggtcagcagcagaatcagaatggtcagaaacagatagcacatgggacggcactcaatattcctccccaaggaacagctgcctgaaaatataattatctggtggtgagagaggcgtgtcaagggccaccagccctgagtctaaaggctctgagtctgcagggagagtaccatttctgagatgatctcaaagctcaacagagggtgcaagtcccaagggcttagatggttccattctaggggtggaaaacaggcagtggccatcccaactgctttgccaccctttctgcctaaggcaagcctcctttctgcagggcttcagttcctcgtaggaagtcccaacaggctgagcagagccaagcatgctttggtcatgtacagtttgtgcacagataga

SEQ ID NO: 96450 - DNA, 423 bp, Homo sapiens
ttcaggcatgcaaatccccagtttcttctctatgtggtttatatttaaggtgaacaagggagtctcatgggtcggaaagtcaccgtctgatatgatccagacctttggctgcccgtggttaatgagtaacctggtgagaaatagtggcaatgagaatgccatatgagcttaataaaaagtctggggtgatacacccaaggatttgcttctaattgcatttaccagacagggcagtgttgagtgcagacaactttaaaaggggcaattacccagcctgctaaacctgctataggtaaaggagtgtgctgggcaaggtgccagaacattgtataaaatgatcattatagattaaagaaacacaggcatacctagggccgtgggcatttgatacatcagatctaaaagaataatacatatgcttca

SEQ ID NO: 96451 - DNA, 806 bp, Homo sapiens
agcagcccgtcaccttgcaacggatggtgtagggcttgccgatcttgttcccctagtaacctctgcgcatggggacaatggagagctaggccaggatgatggccctgtggatggcagtggccacctccttggagcacttaacacccagaccgacgtgaccgttgtagcccgcaatggccacaaacgccttgaacctggttcgctggccggctccggtctgcttctgcaccggcataatcttcaaaacctaggcctcgagagaggccccccaggaaaaaatcaatgatctcagattccgtgatgggcagggagaagagacagatctcctccagggaagtgatcttcatgtgcttgaccaggcagcccagcttgctgacgggcatccactccttatccttggccttgcctccgcgagctccgtggcttcggccccagcctggtccacggcagtgaccccggcctcggatgccactgccgaaacctccacggaagccaccatggttccccatcccagggccccggggcctccgggactccccccgcaacccaatgccggctgcgccggcgtcatccgccatttggtgttttctcggagaagaagctacatgtggaatatattaacgcaacaaattgtgcgtacttgctagacattaggcatgatagcaagtgctagggttacaaagtattgcttttctggggaacccatggttgttggggagaaaccagaagatcagtcatcacagtgcggcaagatcagacttgtggtttgttcaggttctgggagccgtcactgcagtgagcaatgg

SEQ ID NO: 96452 - DNA, 715 bp, Homo sapiens
gttatgatggatgtcaagttccgagacgttattgttgtcaaagctggagaggtccttaagataaatgcagacattgcagggcgacctctgccagtaatttcctgggccaaggatggtatagaaattgaagaaagagcaagaacagaaatcatctcaacagacaatcatactttgttaacagttaaagactgtataagacgagacactgggcaatatgtactaacactgaagaatgttgccggcactcggtctgtggccgttaattgcaaagtacttgataagcctggtccaccagcaggaccacttgaaataaatggcctcactgctgagaaatgctctctttcctggggacgtccccaagaagatggtggtgcagatatcgactattacatcgtagaaaaacgtgaaacaagccaccttgcatggacaatatgtgaaggagagttacagatgacatcctgtaaagtaaccaagttactcaaaggcaatgaatatatatttagagtaactggtgttaataaatatggtgttggtgagcccctagagagtgtagctataaaggcactagatccatttacagttccaagtccacccacgtctttggaaattacttctgtgaccaaagaatctatgacactttgctggtcaagacccgagagtgatggaggtagtgaaatatctggatatataattgaaaggcgagagaaaaatagcc

SEQ ID NO: 96453 - DNA, 308 bp, Homo sapiens
ttttgctgaaagggcagatgcggtctctccaaaggacaacttggaactctgttgttattgacacattacaggcacattagagagcaagagcctccctggaagccccaggtcattaaataataattaattgctcactactgttttgtccttgtctccatagtatccatatggggtgaggacaaagggtgagagcagatctgtaattctggggtaatggtttggttttccatcaaactgtttcaagtagaattctttgatgttatgtgaagggaaaagcttctgtgctcaaaaaatctggaataaacaaa

SEQ ID NO: 96454 - DNA, 394 bp, Homo sapiens
acaggcgtgagcccctgcgcccagcatgaattttttaaatctaattaatctttaaggagaatgaggttttctttttaaaatgctgtttagagattctaaaatctctgcaggtacagttgatcattatttttattcttgaagatagatcctaactctccccattactcctctgctgggttatatgtgataaggttttcccacttgatacgaaactttcaatgcttctattactctacagatcaaataaaatttctgactagaatcatttcagaatctgtgttttaggagttggtttttaatttttaagattttttcctatcatgcttgtttcctaatgagttgaattttttaaagggaaagttcaagatatgaagataaaagggatagtgtgctg

SEQ ID NO: 96455 - DNA, 2034 bp, Homo sapiens
  misc_feature (226)..(226): n is a, c, g, or t
  misc_feature (989)..(989): n is a, c, g, or t
tttggttaattatttttatataatttcttgaactataatcttttgaagtggatttaaatgttacagacgtgttatgaggttttagccttaatcatctcatctatgccccccacaaccccccaccagtgctagataactttaaacaaacagcttactagttccctgatgagaaccaataggtcatgtagtaggaaccaaaagaaattggggatcatcgtttttactntcttttgaagagtgaaataaaagaattagatttttttttaatggaagaggactttaatatttattccctctaatcttttgtttttattgctaagaaaaaatcttgtaatccatacttcctgatactcagtttttttagtgttaaaacccatttgcctatgcaattataagtaaataattgaattattggcattcttaatatctcttcacttaaaagtgttaagagtgttgtcaacttgttagcaccaactttttgtataggtctttatcttatagtgatctgaaaccataattataattggctgtttcagtataggaagaaacacacacacactcatatatatatatcttcctcataatttaaaaaaccgttttgaaataattggaatagttgtaaaagtagagggagtaataattaaaaagagaagtcttcatttttttttccttgtcaaccaaacacagacatttttacctatatcacacagcaagcccttacacattgctggcaagtgttaaagtattcaataatttcaaatcgaaacagagtcttagatcagttacatctttttttttttttttttttttgagacggagtctcgctctgtcacccaggctggagtgcagtggcaccatcttggctcactgcaagctccacctcccaggttcatgccattctcctgcctcagcctcccgagtagctgggactacaggtgctcgccaccacacccggctaatttttttgtatttttttagtagaggcaggntttcaccgtgttagccaggatggctaactgacctcgtgatccatccgcctcagcctcccaaagtgctgggattacaggcgtgagccactgcgcctggcctagttacatctttttagtcttgattcagagttgtggctattcaggcatctaatctgaagaaaaaatatttgagctcagcatcgtctaatcataatagttttttttaaatttgctaattattttatttaaagtatatttaagttaaaaagcattaagttcaaacgtgcatgcttatattttaaactgttttccattcatgacatgccaaacttttcctccccagctaactttgcctttctcattaacagaattatgttttaatggttttcattgtcacttgatgctgtggccaaggaattgaaacttactttaaatgataattaagtcaaatacaaatacgttttgaattgttatactgctttttattaccacaggcactctagagctgagtttatgttgtgctcagtaggctagtctctttttctctactaagttaatgaatggtggcctggacttcagatggctagacagttatgtgcagtatctggagggtgtgatgaagcccagaaatattcccagtccttgaatttcgctagttggtaaaatgcgagctccgtttacccttgctaaggctgcctctgcagggtctctccctttataccttcatacccagtcccccaccaagatgaatgctggctggggagcagggctgcctccaggtgaaagtgtcaccagctctggtggctttggactccaggagccacaattgtgtgtaggcactaggcttctgttgggtgtttggatggtgcatttatatttacccacggtaaatataaatttacctttataaatttggtcaagcttcatgccttgcaaaataattggggtgactatatgaggacagaatactatatagtgagccattcaagtgccacttaagtgcagatgtttaagaagatacataaagtgatgaaaatgaatttaacttgaagaaaaaaaaaatgca

SEQ ID NO: 96456 - DNA, 198 bp, Homo sapiens
atatggcagctctgttggaaacttcaagtggaagggatgattgacaatgcaggattttggcagtcctgggtcttcttgtaaaaatattcccttataccatagcaatttcatagcaagtcctaacaggggtcagagaagaatcaagtttccagagccccggtaataaagtcagtcctgtagtgctggagattagctcct

SEQ ID NO: 96457 - DNA, 441 bp, Homo sapiens
aatattagcttatttttattggtaaaacttggctggacaacataactagccccacatttgacttacccatgcagtcacaggtagagcagctgaagaattgaagcctcctctcagagaagaagagcattctaggaagtctgcctattacatgggaagaaagaagcatattcatgagcaagcagtaggagagatcaagactcaggagccaggagtgtttggttttgatcctgccaagtgcatgccctactcaagggcaggcaagctcaagaaagggcaagaattattaactgggtgggattgagccacattaagcaggaggctttaacacattaaccctccgcaaaatagaaacagactctcttcttccacagctaaataagtcattagctcccccaggtcagagacccagaaggcaggtggaaaaaatagctgcagctgttc

SEQ ID NO: 96458 - DNA, 1365 bp, Homo sapiens
attacattctccttgatcgttcttgttattacgctgttttgtgaacctgtagaaaacaagtgctttttatcttgaaattcaaccaacggaaagaatatgcatagaataatgcattctatgtagccatgtcactgtgaataacgatttcttgcatatttagccattttgattcctgtttgatttatacttctctgttgctacgcaaaaccgatcaaagaaaagtgaacttcagttttacaatctgtatgcctaaaagcgggtactaccgtttattttactgacttgtttaaatgattcgcttttgtaagaatcagatggcattatgcttgttgtacaatgccatattggtatatgacataacaggaaacagtattgtatgatatatttataaatgctataaagaaatattgtgtttcatgcattcagaaatgattgttaaaattctcccaactggttcgacctttgcagatacccataacctatgttgagccttgcttaccagcaaagaatatttttaatgtggatatctaattctaaagtctgttccattagaagcaattggcacatctttctatactttatatacttttctccagtaatacatgtttactttaaaaattgttgcagtgaagaaaaacctttaactgagaaatatggaaaccgtcttaattttccattggctatgatggaattaatattgtattttaaaaatgcatattgatcactataattctaaaacaattttttaaataaaccagcaggttgctaaaagaaggcattttatctaaagttattttaataggtggtatagcagtaatttaaatttaagagttgcttttacagttaacaatggaatatgccttctctgctatgtctgaaaatagaagcttttattatgagcttctacaggtatttttaaatagagcaagcatgttgaatttaaaatatgaataaccccacccaacaattttcagtttattttttgctttggtcgaacttggtgtgtgttcatcacccatcagttatttgtgagggtgtttattctatatgaatattgtttcatgtttgtatgggaaaattgtagctaaacatttcattgtccccagtctgcaaaagaagcacaattctattgctttgtcttgcttatagtcattaaatcattacttttacatatattgctgttacttctgctttctttaaaaatatagtaaaggatgttttatgaagtcacaagatacatatatttttattttgacctaaatttgtacagtcccattgtaagtgttgtttctaattatagatgtaaaatgaaatttcatttgtaattggaaaaaatccaataaaaaggatattcatttagaaaat

SEQ ID NO: 96459 - DNA, 865 bp, Homo sapiens
attacattctccttgatcgttcttgttattacgctgttttgtgaacctgtagaaaacaagtgctttttatcttgaaattcaaccaacggaaagaatatgcatagaataatgcattctatgtagccatgtcactgtgaataacgatttcttgcatatttagccattttgattcctgtttgatttatacttctctgttgctacgcaaaaccgatcaaagaaaagtgaacttcagttttacaatctgtatgcctaaaagcgggtactaccgtttattttactgacttgtttaaatgattcgcttttgtaagaatcagatggcattatgcttgttgtacaatgccatattggtatatgacataacaggaaacagtattgtatgatatatttataaatgctataaagaaatattgtgtttcatgcattcagaaatgattgttaaaattctcccaactggttcgacctttgcagatacccataacctatgttgagccttgcttaccagcaaagaatatttttaatgtggatatctaattctaaagtctgttccattagaagcaattggcacatctttctatactttatatacttttctccagtaatacatgtttactttaaaaattgttgcagtgaagaaaaacctttaactgagaaatatggaaaccgtcttaattttccattggctatgatggaattaatattgtattttaaaaatgcatattgatcactataattctaaaacaattttttaaatacccccgctgtcgtaacaaggattattcaggatatgggggagagagagattatattgaagtgttcacgaaggagatttctcggttgaacactaagacggtatctaagacggtgg

SEQ ID NO: 96460 - DNA, 257 bp, Homo sapiens
gagtttggagttgggaaagtccagatgaacttccttcatttactgagttcggaagccacccatatcatcaccattcactgtctaaacaccccaaggtggacaagcacacaaacaagtggcccaggattgcctattggtttcaagggatggaatggccagatttttaaagtaaacactctacttgaacctaaagtgctttcagatgactgcaagattcaagatggcagctggcataaggcaacatttctttttcacac

SEQ ID NO: 96461 - DNA, 323 bp, Homo sapiens
ctgcaaaagtccctgaaaaatgccactttactcaagtttattagagaatgaaggattcttacatagaattagaggttttaaaaggacgtttaagggagatggaaggtagaatatgtcccagggttaatatggcacaaacttataaaaagccttaaagtttagcataagctgagctgacagcaaatgccacaccaccaataacaacaaaactcactctttataacatgtataggaagaaattcaccactactctaatattaaaggtaaaatagaaagcagaactatgactcctggcttgttgcatcttctccttgaatggacat

SEQ ID NO: 96462 - DNA, 477 bp, Homo sapiens
cacctcggcctcccaaagtgctaggattataggcaggagccacagcgcctaacctaattttttaaaaaagaaaaaaagatcaagaccagcctcagcaacatagcaagaactcacctcttaaaaaaaaaagcccccaaaaaaagttaattagctggctccaggtacagtggcccacgctgcaatcccagcgctttgggaggccgaggcaggaggatcacatgagcccagcagttcatgaccagccctgagaaattctgtctctacaaaaaaaatagtaataattgtttaaaaaataaattagctaggtgcactggcacatacctgtagtcccagccacctgagaggctgaggcaggaggatccaggaggatcccttgggcccaggagtgcaaggatgcagtgaattatgatggcactcctgcattccagcctggctgacagagcaagacctcatctttcataaaataaattaaaaaaa

SEQ ID NO: 96463 - DNA, 980 bp, Homo sapiens
agaatccacaaataactaaatttatctagtcaacctgttccagaacaggcttccagtcatttaggttgcccaagaatgagtaaaggaaaaggaaattcaattttccaagaccttgtttcccctctcctctttaatttcttgttcggttagcaacagtatatccattccctcgctcctttgtgaaaagtaaattcctgaatgttaactaaaccaagtgtttctaaattgggtaagagtttgaagacttaaggcagcagaatgggagagacttaaaacgttatgtctgagaattaggcattaaaggaggcctagtatttgggcgggggttgtgaggagcacatactgaacctttggacctgttgagtgagttcatgtgcctctgaactctctgactggatatgaccagtaaacttggataattagatcctggagtttaggggagagggctagagatagagatgatggatatcagcatatttttaaaacagaaaatagttaagatcacccaagacaatctggaatcgttagaagggagtaaggaaggcattattgggaaactttccagcttcaattctcatattttttctaatctcctggttgagtctttggagttgctgttctctctatgcaaaacccctcccttgaccctctctccctcactctattttttaatttgtcacctccttctcctgttctaggtctcagtttagatagcacctttctctagaagttcatagcactgtgtattcccccctttattgttcttatcacataatttttgatggtttggacactagttgttattcctcactaaattttatgttttatgaactcaggggtaagggcaccagctagcacaatgaatgcacaatacttgtcagagtgaatgcatttaagttccaagaaccaaggaaaggcggtatttcaagaagagaagtatcaaatcttccagattagtcaaataaactccaaaaaaaaaa

SEQ ID NO: 96464 - DNA, 136 bp, Homo sapiens
tccgaggggaagctggtctcccggccccgcgccctcctgcatggcctccgcggccaccgcgcgctgagcctgtgcccgagccctgcgcagtcccccaggtctgcatcacccccggggcccgcgccccagcaccccg

SEQ ID NO: 96465 - DNA, 421 bp, Homo sapiens
acttcatgttgtgggaggcagaataaaggtctcccaagatgttcacatcctaatctcaggaacctgtgaacatataaccttgtgtggcaaaatgaactttgtagatataattaaggttatagaccttaaaataggtagattagcctagcttatccaagtgtgtccaatctaatcaccaaagttcttaaaagcagagaactttctctggctggagtcagacagatgcaacaaaagagaaaagcagaagagatgtggctggaagggaagtcagaagagacctgaggtgaaagaaggactccaggctgggtgcaatggttcatgcctgcctggaatcccagcactttgggaggctgaggtgggaggatggcttggggccaggagtttgagaccagcctgggcaatatagcaaggccccatctct

SEQ ID NO: 96466 - DNA, 2168 bp, Homo sapiens
  misc_feature (1456)..(1456): n is a, c, g, or t
  misc_feature (1555)..(1555): n is a, c, g, or t
  misc_feature (1867)..(1867): n is a, c, g, or t
  misc_feature (2051)..(2051): n is a, c, g, or t
  misc_feature (2167)..(2168): n is a, c, g, or t
cctagaatgggggtggggtgggctggacagaagagaggaggagaaggaggtgactgaggggactgcagctgggtgggcggtaaccgaggggaggggaactggtggcgtccccatctcgcggggtccggaacggcgacgcgcccgcgcccagctgattggagcccttcaggcctcccgcgcccgaccggcagcccaatcctataaagcttcctctaagctgggccctccgcaaacgggatccagagaggctcgcgccttgcttgctaaggaaccatgaccggccgggactcgctttccgacgggcgcactagcagcagggcgctggtgcctggcggttcccctaggggctcgcgcccccggggcttcgccatcacggacctgctgggcttggaggccgagctgccggcgcccgctggcccaggacagggatctggctgcgagggtccggcagtcgcgccgtgcccgggcccggggcttgacggctccagcctggcgcgtggggccctaccgctgggactcggcctcctctgtggcttcggcacgcagccgccggcggccgctcgagcaccctgcctgctcctagcggacgtgccgttcctgccgcccaggggccccgagcccgctgccccgctggctcccagccgtccgccgcctgcgctcggccgccagaagcgcagcgacagcgtctccacgtccgatgaggacagccagtctgaagacaggaatgacctaaaggcatcccccaccttgggcaagaggaagaagcggcggcacaggacagttttcactgctcaccagctggaagagttggagaaggcattcagcgaggcccactaccctgatgtgtatgcccgagaaatgctggctgtgaaaactgagctccccgaagaccggatacaggtctggtttcaaaaccgcagggccaaatggcgcaagcgggagaagcgctggggcggcagcagcgtgatggccgagtacgggctgtacggggccatggtgcgccactgcatcccgctgccagactccgtgctcaactccgccgagggcggcctgctgggctcctgcgcgccctggctcctggggatgcataaaaaatccatggggatgataaggaagccaggaagtgaagataagttggcaggactctggggctctgaccacttcaaagaaggttctagccagagtgagtcaggatcacagagaggctcagataaagtgagccctgagaatggcttggaagatgtggctattgacctctccagctctgcccggcaggagaccaagaaagtgcaccctggggctggtgctcaaggaggctccaactccacggcactggaggggccccagccagggaaggtgggagccacatgagacccacaggtcccactgtcaaaggctgaaaatgtgcatattcctcactggcattttccaaaagacaaaaattgtccaagacatntactctcagtttgattttcttctgacaatgtcaagataaaatgcaatgccacttgctttaagaggacagatgagtgacctagggaaaattctatttcantctagaatggaaacggttccttaatggcactttaaccagttaacttggtgcaaaacttttgattctcttttgtagcttgagcagggaggatccgaagttcaaaaatgatttcactgctgggcatcatttgagatgtgtggttcaatgtactgtatagatgaataggttaggtctgatgtcctcattctcaattaggaaatataaaattgtttaatatccagaagaatctgatatcatcatagtgaagactccatacagacacatgaatgaattatattgtctttaccttgaacttggccttggatatttcanttttcttgttagggagtaattttgtgttttcttgagtgtcacttgataggctatgcatattggaattcaaagaaacccatactctagtcgtttctgcatttcctttaaaaatagcatgggatcatatttaaacaattgttggatagctggaaacagtgtttttaggtcagaccaggcttttggnctttcaaaatttgtgattgaaagcactttagtgacttggattttgtaaatctttcctttcctgcgtttcctttgccatttatttattctttaaaaataaacattttgtggtgtgtnn

SEQ ID NO: 96467 - DNA, 1167 bp, Homo sapiens
  misc_feature (1166)..(1166): n is a, c, g, or t
cctagaatgggggtggggtgggctggacagaagagaggaggagaaggaggtgactgaggggactgcagctgggtgggcggtaaccgaggggaggggaactggtggcgtccccatctcgcggggtccggaacggcgacgcgcccgcgcccagctgattggagcccttcaggcctcccgcgcccgaccggcagcccaatcctataaagcttcctctaagctgggccctccgcaaacgggatccagagaggctcgcgccttgcttgctaaggaaccatgaccggccgggactcgctttccgacgggcgcactagcagcagggcgctggtgcctggcggttcccctaggggctcgcgcccccggggcttcgccatcacggacctgctgggcttggaggccgagctgccggcgcccgctggcccaggacagggatctggctgcgagggtccggcagtcgcgccgtgcccgggcccggggcttgacggctccagcctggcgcgtggggccctaccgctgggactcggcctcctctgtggcttcggcacgcagccgccggcggccgctcgagcaccctgcctgctcctagcggacgtgccgttcctgccgcccaggggccccgagcccgctgccccgctggctcccagccgtccgccgcctgcgctcggccgccagaagcgcagcgacagcgtctccacgtccgatgaggacagccagtctgaagacaggaatgacctaaaggcatcccccaccttgggcaagaggaagaagcggcggcacaggacagttttcactgctcaccagctggaagagttggagaaggcattcagcgaggcccactaccctgatgtgtatgcccgagaaatgctggctgtgaaaactgagctccccgaagaccggatacaggtgtctggggtcccttttctccgctccaaagataccacagagaacgtgtcattcccacattcagtgagccaatcagcagtcccttctctatagccaacacgctccctttgcatagaaactgagggtcccttagctgaaggcaccacaagagcttgcccctatgaccctcatgccttttttcattttattattatttagtatcaaatcattctttaaaatcacatgataatgtgtgctgcaactagaaactataaagatatgtcaang

SEQ ID NO: 96468 - DNA, 1668 bp, Homo sapiens
cctagaatgggggtggggtgggctggacagaagagaggaggagaaggaggtgactgaggggactgcagctgggtgggcggtaaccgaggggaggggaactggtggcgtccccatctcgcggggtccggaacggcgacgcgcccgcgcccagctgattggagcccttcaggcctcccgcgcccgaccggcagcccaatcctataaagcttcctctaagctgggccctccgcaaacgggatccagagaggctcgcgccttgcttgctaaggaaccatgaccggccgggactcgctttccgacgggcgcactagcagcagggcgctggtgcctggcggttcccctaggggctcgcgcccccggggcttcgccatcacggacctgctgggcttggaggccgagctgccggcgcccgctggcccaggacagggatctggctgcgagggtccggcagtcgcgccgtgcccgggcccggggcttgacggctccagcctggcgcgtggggccctaccgctgggactcggcctcctctgtggcttcggcacgcagccgccggcggccgctcgagcaccctgcctgctcctagcggacgtgccgttcctgccgcccaggggccccgagcccgctgccccgctggctcccagccgtccgccgcctgcgctcggccgccagaagcgcagcgacagcgtctccacgtccgatgaggacagccagtctgaagacaggaatgacctaaaggcatcccccaccttgggcaagaggaagaagcggcggcacaggacagttttcactgctcaccagctggaagagttggagaaggcattcagcgaggcccactaccctgatgtgtatgcccgagaaatgctggctgtgaaaactgagctccccgaagaccggatacaggtctggtttcaaaaccgcagggccaaatggcgcaagcgggagaagcgctggggcggcagcagcgtgatggccgagtacgggctgtacggggccatggtgcgccactgcatcccgctgccagactccgtgctcaactccgccgagggcggcctgctgggctcctgcgcgccctggctcctggagggtgagacattgggctgcagagaaatgaagtgaacctgctaagccgattgtcaaatggatgagaaactcagagccaaggatcgggaaaacacccttaaagaacgagtgcaaacttctgctcctggaggctcccgttcactggactttgcaggagacacacaggctccccagaccccgtggtggtgcctgatgaccttcagctgaaccctgtaatgctgctaaagtctgcccctctggagaagtgctcaggtagcattgttctgcctcaggaagcatgccgattttcctgtgtcatccttgatgatcactgctaccagacttgccccctgcagggcaccccatgtgcaaggaattcaacaacctaggagttgaaagcattggtctcccaagttcagtgtgttcttttccgtatctattaccagctgatgagaataaacctgcagtcatgacagctaggtcctagtgacaggtgcagaaagctgctcttacagaaactcccctccttattaagaggctttgtctatcactcggaactgcttctactcaagattatctgttgaaagggaactgtccataccagggcat

SEQ ID NO: 96469 - DNA, 353 bp, Homo sapiens
tcagctaagttcactaagccacagtctctcgctctctctcagtcccacctttccctctctctttctatctacatatatgcaagagttgttgtgaaatactctccctgttttccagtgcaaacttctgctcctggaggctcccgttcactggactttgcaggagacacacaggctccccagaccccgtggtggtgcctgatgaccttcagctgaaccctgtaatgctgctaaagtctgcccctctggagaagtgctcaggtagcattgttctgcctcaggaagcatgccgattttcctgtgtcatccttgatgatcactgctaccagacttgccccctgcagggcaccccatgt

SEQ ID NO: 96470 - DNA, 377 bp, Homo sapiens
ttacaggcgtgagacatcacgcccagcctagaatactcatattattaacattcccataaatattatttagagaaggtttagcatcaattatcccttatttgaaaatgctttctataaatttaatatataaaataaggtggattttccgttcagcttctgtttctcaagaggattactgagttgttggtgtagcccattcataaataggaccaaaaaagtatagtcttatgtatgttgaaaaaggtccttaggtaattccagtacttccagcagaaaatcattgatttagttttaagttctacctattacaataagagttctccatccttgttacatgttagtagtgtcagggaagacttaaaaattaccaatgcctg

SEQ ID NO: 96471 - DNA, 690 bp, Homo sapiens
agctgggactacaggtgcacgccaccacgcccagctaattttttttttgtattttagtagagacggggtttcaccttgtttctcaggctggtctcgaactcttgagctcaggcaatccacctgactcagcctcccaaagtactaggattacaggcatgagccaccgcgcccggcctattggttggttttgttatatgtaaagatgactgcttttgtgtaggttaaggggtagaaggaaaatgaaattgattatgtctgttgatgcctttgatatgtagctgtattaataaaagcaagctaatgataatgtgtctggggatttgaggagcatgtacccattgaaactattgattcttaaatattgtgttttatgtatacatgtagtttatatgttcttttgttctttacattagtatgtctgcttaaccagttgtctacttaaattgctattaaacccaggaaattttttttctatagaaagtgagaagaatgcaacacaactaaaagtaaatatttgtcagtcagtagttgtccttgaggtaacttattgccacagggaatcctttcgtttgtccttgaagagagaggaaagactgcatagtttccccacatccagagatttgccagactctcttgtatttaagctgtggcagtctgttgtggattgagaccttgatcttggcaatgggc

SEQ ID NO: 96472 - DNA, 432 bp, Homo sapiens
taccagatctggttaattgtgtgttcaattatatgtatagtgagaatatgcttgttccattttcacctagtttaggaaatttaatataaattaagggactgtaattccagaagtagtagaagtgctgcaaacagatattgtaagcagacattttagaaggggattccactttaaattggattgcttgagcccaggagttcgagacccgcctgggcaacgtggtgagatcctatctccacaaaaaatacaagattagcccgacgtgatggtgcatgcctgtggtcctagctgcctgggaggctgaggtgaggggatcgcttgggcccaggaggtcaaggctgcagtgaactgtgactccagcctggggtgatagagggaaaccctgtctccaaaaacaaacaaacaaagtcgtagcagagtactttgattgta

SEQ ID NO: 96473 - DNA, 683 bp, Homo sapiens
acagactcttaattccttctggaatactgagagtgccgggaaatgacagcttaatgttcagggtacgtcttagtttgtcttggatcttgtgacagggacagctgcattagtcttggagtgaaagtgtatctgagtatgttgggccacatttgcagtagtttgttctgaactccagagctattgaccaagcccgtcctgccttctgaggtatggaagacactgaggcctcctgacccacggcacagcattctctgcttccagcgcgtctgccttgggccatcaccccagagagtttgatcaaggtctgtcttaccacaccccctcccaaattcttgcagctcccaaagctgctggaggcagcacctgagcctgtctctccgctgagcttcttcaccccaaggactgcctgctggctgcccacttctcatcaggcaaggccacagtgccatctgctggctattgggagccatgctggtcaggttgggagggcacaggagcatgctaggctgacaaggagcactgagctctccccacctcagctcaggaataacagaagtggcctttcccttaagcccccactgaccagagcccctcattcaggcttcagtcaccagagccccctgctcaagtcctttagttaccatggcctctaggtcagtctcctcaggaatcagggcccctcg

SEQ ID NO: 96474 - DNA, 153 bp, Homo sapiens
agcaaccttataaggtgatagatgcagaaacaggcccaaagagtaaaaataatttgttcagagttttccagccaagtggcgaaggtgagattcttacctgggtttgtctgaaaccaattttcactatctttttcagttatgatacactgccta

SEQ ID NO: 96475 - DNA, 368 bp, Homo sapiens
tccagacacgcatcagcccaatcaggggagataaaactgtgggcactgaaacgttcccagttttcttttccaaagagtaaaaatcaagaccttaaaaatgcttaacaaaagttaaccacatgttctcacccacgtatggaagcttaaaaaaaaagtgatctcatagaagtaaaaagaagaacagaggatactagaggctgggaagggtggggggaaactggggatagggagaggttggttgaaggatacaaaattatagctaggtaggaggaacaagttctaatgttctacgccactgtaggatgaccatagctactaataatatacagtttcacatagctaggaggaggatgttaaatgttcccggc

SEQ ID NO: 96476 - DNA, 462 bp, Homo sapiens
ctgcctcctgggttcaagtgattctcctgcctcagcctcccgagtaactgggattacaggtgcccgtcaccactcccggctaatttttgtatttttagtagagatagggtttcaccaccttgaccaggctggtcttggacctctgagctcaagtgatccaccagccttggcctcccaaagtgctgggattataggcatgaaccaccatgtctggccacatatttctatttgctgggaaggatccagtagagaggagctgcgtctcttggtggcctcggcttctaccctagaaagacgtccttgtaccatgcaaaagactcctcccttccctccttaccccatctcatttctggcatcagctcagaggccagtttgggggggctcctccagttgcccatctgcagacctgtggaccagtgatgggatgggcaggggacccctgcaggtaattccgctcagaaa

SEQ ID NO: 96477 - DNA, 299 bp, Homo sapiens
ggcttttcagtgtaagatggagtattatttttccaattgaggaggtcagcagaggtgaaaggttgatacacaaaggcacgcctttccaccatgtgtctgtcctcatctaccccagtatattgcttctctctcaggggcatttggattccagtcttgggccataagcaagctgtcaacggagaagtttctcctgtggcttcacttcctcttctgtctactctgtgtgatctaggggtgtggttatctggtggaggtgtaggtgctgtggcctcaggagtggggagcccttccttttgata

SEQ ID NO: 96478 - DNA, 446 bp, Homo sapiens
tcgagtaagtctgtcggtgccatctttccaacagcgtgtgctcactcatgtctttgtgtcacattttggtaattcattccacctttcaaactttttcattattattatatctgttatgtggtgggtgatcagtgatctttgatgtcactgttacatttgtttgggggtacacaaatcatgcttatatacgatggcacacttaataattgtgtgtgttctgactgctccactgactggctcttctctctcatctctccctctcctcaggattccctattctatgagacataaaaatattaaaactaggccaattagtacccctgcaatggcttctaggcattcaagtgaaaggaagagtcacccatctctcactttaaatcaaaagctagaaacgatgaagcttagtgagaaaggcacgtcgaaaagcaagataggccaaaagctag

SEQ ID NO: 96479 - DNA, 522 bp, Homo sapiens
aatttttgtaattttaatagagacagggtttcgccgtgttggccaggttggtctcgaactcctgacctcaaatgatctgcccacctcggcctcccaaagtactgggattacagacaggagctaccgcgcctggccttgaaattttgatttgaaaaatatttcaggaatatttttctttccatgtgaagttgagaaccacacttgaattgctccaatcatcctcacaactcaacatggctgcagggcttctggggctctgccaaatgagatggtgcccatctgatcagagtctgccttcgtatctgtcccatcggagtctgccttggtactcatcttatcggagtctgccttggtgcctccaagtacacagttaggctgatgtggcatgcacatccgaaaaaataactctagatgtgcatttcgacacatcagcaaatgcagatggtatgggctgcagatggtatgggccacagctggagagagccgtcttcactgcggtatagctgggctgcacccaacgtg

SEQ ID NO: 96480 - DNA, 483 bp, Homo sapiens
attttcttggcgtgattcttctctcttattaagagctttaatgtttaggattcttgttttgcactattacagaatcaaggtagcgaaaagggactagtgagctatttctatgtatcaggaggaaggttctgtatcccttttattacaaacacgtttttcttttattttctcttcattttctgtccattgaatggtgtatagaacttattatgctagctgatatcacaatgctgggaaaattaatttacttaaataaatagcatcaatttttaagctattttccagatagcatcctgtctggtttcgcagatagttcattagttggcaagtataaacagtcacaaactgctttagttgatagtttaaatttaaaaataaaatccttgtcctgtttatactgttttttgtgtcacaacattatgaaaacaggatttcagagttttgaaaaaaaaagtcgacgcggccgcgaatttagtagtagta

SEQ ID NO: 96481 - DNA, 600 bp, Homo sapiens
atcctaccatttccagcgtgggcctctccagaaagatactcccctaaacaaggacagaggccccaatagcaatcctaccaaaatttcaggggggcccaggttaggctctgaagtgagacaccctaggacagtgggggtcagggatccacatttattgagctcttctttatgggcacggcactgcacaaaacactttccataggagcttatttaagtcctcataaaatcatagaaaatcagtatctatcactttccaaactcaggaaccaaatagaattggctagtgagggaagcttgtatttatcccctttgtgtagcacagaaaacagaggggttagtaacttggttaggtttgcacagcacctcccaacaggacagggtccccttctctgtacataggaaaatccttcttcctcatgaggtctggcaccaagccccccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggatt

SEQ ID NO: 96482 - DNA, 425 bp, Homo sapiens
ttctggcggctctgaggggagaatcatttctttgccttttccttttctagagatgacctgcattgcttggctgtggccccttccttgtatatcccatccacttggttctgttgtcacatagtcttcttctctgttggatcgtccctctaataaggacccttgtaaatacattgggcccacctagacagccccgaatgagctccccataccgtgagctgtaatttaatcacatctgcaaagtcttttctgccatataaggtagcattcataggttatggaattaggacatggacatcttggggtcattatgctccctatcatacctggaaatctgatttttaaatttccagtggaaaaatggatctatctgtcttcacctttcctgcctaagctatcaacttgaagctatctacttcgtcgtcctg

SEQ ID NO: 96483 - DNA, 5160 bp, Homo sapiens
  misc_feature (2410)..(2410): n is a, c, g, or t
  misc_feature (2435)..(2435): n is a, c, g, or t
  misc_feature (3405)..(3405): n is a, c, g, or t
  misc_feature (3443)..(3443): n is a, c, g, or t
  misc_feature (5059)..(5059): n is a, c, g, or t
gctggcggcgcccggctccgtcctgcccgcggccggcccccgcgtctgctccctccccgcccgggcccctgtcggccgccgccagtccccgccccgactgtgaatgaaaggcgggcgccgccgagggctggctgggaacgccgcagcgacgccggcctctcgagaggcgcgcgccccgccgagatgtacggtgtgtgtggctgctgtggtgccctacgccccaggtacaaaaggctggttgacaacatcttccctgaggatcccgaggatggtctggtgaagaccaacatggagaagctgaccttctatgccctctcagctccagaaaaacttgatcgtattggcgcctacctctctgagaggctcatccgtgacgtgggtcgccatcgatatgggtacgtgtgcattgctatggaggctttggaccagctgctcatggcctgccactgccagagcatcaacctcttcgtggagagcttcctcaagatggtggccaagctgctggagtcagagaaacccaacctgcagatcctcggcaccaactcgtttgtgaagtttgccaacatcgaggaggacaccccgtcctatcaccggagctatgacttctttgtgtcccgattcagtgaaatgtgccactcgagccatgatgacttagaaatcaagaccaaaattcgaatgtcaggcatcaaaggcctgcaaggggtggtgaggaagacggtgaatgatgaactgcaggccaatatctgggacccacagcacatggataagatcgttccatcactgcttttcaatctacagcatgtagaggaggcagagagccggtctccctcacccctccaagcacctgagaaggagaaagagagccccgcggagctggctgagaggtgtcttcgggagctgctgggccgggctgcctttggcaacatcaaaaacgccatcaagcctgttctcatccatctggataaccattctctttgggaacccaaggtgtttgccatccgttgctttaaaatcatcatgtactcaattcagccgcagcactcacacctggtcatccagcagctcctgggccacctggacgccaacagccgcagcgctgcgacggtgcgcgcgggcatcgtggaagtcttgtcggaagccgcggtcatcgctgccaccggctctgtggggcccacagtactggagatgttcaacacgctgctgaggcagctgcggctcagcatcgactacgcgctgaccgggagctacgacggggcggtcagcctcggcaccaagatcatcaaggagcacgaggagcgcatgttccaggaggccgtcatcaagaccgtgggctcctttgccagcacgctgcccacctaccagcgctccgaggtgatcctcttcatcatgagcaaggtcccgcggccatccctgcaccaggcggtggacacaggcaggacgggggagaataggaaccgtctgacccagattatgctgctaaaatccctcctgcaggtatccacaggtttccagtgcaacaacatgatgtcagccctgcctagcaacttcctggaccgccttctctccaccgccctcatggaggatgcagaaattcgactctttgttctagagattctcatcagtttcattgatcgtcatggcaaccgccacaagttctctaccatcagtaccctcagtgacatctctgtcctgaagctgaaagtggacaagtgctctcgacaggacaccgtcttcatgaagaagcactcccagcagctctacagacacatctacctgagctgcaaggaggaaacaaacgtgcagaaacactacgaggcgctctatggcttgctggccctcatcagcatcgagctggctaacgaggaggtggtggtggacctcatccgtctggtgctggctgttcaggacgtggcccaagtcaatgaggagaacttgcctgtctacaaccgctgtgccctctatgctctgggcgcagcctacctgaacctcatcagtcagctcacaacagtgcctgccttctgccagcacatccatgaggtgatagagaccaggaagaaagaggctccatacatgctccccgaggatgtgtttgtggagaggcccaggctgtctcagaatcttgatggggtggtcattgagctcctcttccgccagagcaagatcagtgaagtcctgggaggcagtggctacaactcggaccggctctgcctgccctacattcctcagctgacagatgaggatcgtttatccaagaggaggagcattggagagaccatctccctgcaggtggaggtagaatcgaggaacagtccggagaaggaggaggtgagtgtccgtgccaccgtcctggggcagccccacctcctgtagattggacgctggactccaggctcccctgcctgcatagtgngcttaaggctgcatggaaagcaagnttctcgagtaattccacacttgtactgactctccccacgtatgcgtcatagatacttcccttcggaaaaattgttagggtcctccctgctcccatgaggatatcataaaactcactcttgaaaggcctggctggggatggtggctcacacctgtgatcccaacattttggaggctgaggcaggaggactgcttgagcccaggagtttgagatgatctggggcaatataaggagaccccatctctacaaaaaataattgaaaaatcagccaggcatggtgacgtgcacctgtggtcccaggtactcaggatgctgaggtgggagaatcacctgagcctgggaggtcaaggctgctgtaagccatgatggcagcacggcacttcagcctaggtgacagagtgagacctcgtctcaaaaaattaaaaagaaaggcatgctggtcatcattccccactcacagggggaccgatatgctctgggttggaaactagaagacttaactggagagataagggtgagaacagctttcatagtgttgcttccgtatgtatcaataaagaatctttttttaaatttacactatttttaaagcaattttagttacagcaaaattgagaggaaggtacagagatcgccctttgccccctcccctcccctgacacatgcacagcctcccctcctatccatatcccccagcagagtggtgcatttcttacagttcaacctgccttaacacaacagtatcatctgaagtctgtcgtttacactggggttcgccctcagcgttgtacattctgtgggtttggacaaatgcgtaatgacatgcatcccccaccagagtaccatacagagtcatttcctgccctaaaaccccctgtgctccacctcttcatctctcccctaaccactgacagccaagatgttttttttttttttttttaatgctgactgttacagttcacaagaagtanggaggacacacatctgggtgggaccgggacagaaaganttacatggtcctcaggcatggacaggctggcattccccagcctctctgcccattagggctgatatagacatggaggacagctttgacatcaagcctttccccagatgcaatcagaggtaggagaagtctctaggggtcaggatcaagcctccccctaactgtgccctcgaccacttcatttattggggcagatctctaccccagggccctcaaagcttatccagaaccttcccacggaaggaagctctgacttgggctaattggacaagtaaaatgaggttgaacgaggcatcctccatggcccttccagctccaaggactgggaacctccaatgcgttaggcatcggggtgagttggctgctctctccccatagtggcgattctcccttcccaagaggtaagagaccctcgggaattgaggagtgaagtgactcagaagcgcaaggcgaaatgcttacacagctacagagccacctcctcactagtggcctcctgggccaccagtatcagttccttcctcccttcaagagtcagcttagcccagaggtagcttggtggcaaagcaggggtgcaggggccttcatcctgtgcccttctgccatgccacaactctctccactctcagccatcagtgccagtccagagtcccacggtggttcctagggccgtactgcccagccttgccgcaggggtgaataaatgcttgtttggtcaaatctgaatcctggtgcctggcattcccagccatgcatagtctgggctctgccatttcatttttccccacctgctctggcccgtatccactgtcccactctggtggggctgctctcgatctctcccacgctgcgctccgccatctccaggcctttgctagtgcagaatgccacatctgaaccacccttccctccacactggtgcagctgagcgcctgtgaactgtctgttctccagcgcccggcccctgttcagtttcctcataaacttctctctccctgctcttgcccagggagcatcccttctctcttgcccagagagcggcattttctttgactgttgccaccacacagttccctagcaccctgcaggtgaatatccaatgttgctcggtgctgacagtggatgaatggatggacgtacagaggataagtcctcagagcgagttaaagccgagcatagctctctcttgcatgtaattcctatgctagcaaattgtgcagtttctatagactcacctacagtcctgcatgtagttggtgctcacttaatgtttgttaaatgactttatctcatacatatacttctgtcctctcctactcaaacaaaaatgccaaacaaatcaaaaaatgcacgactcagtgaattttcataaagtgtgtatgcccacgcaaccacgcctggatgagagagtggaacactgtcatcatccaggggccctgcctctgtgccccctcccctaagggagctcccagcctgagttgcgttacttctggaactttatatcaatgaaatcattctgttctgtgtctgctgcttttgcttaagattatgtttaaatgatagagcatgaggctgggcgtggtggctcatgcctgtaatctcagcactttgggaggccnaggcaggtggatcacctgaggttaggagttcaagaccagcctgatcaacatggtgaaaccccgtctttactaaaactacaaaaaattagccgggcatggtg

SEQ ID NO: 96484 - DNA, 2521 bp, Homo sapiens
gcccaggctgtctcagaatcttgatggggtggtcattgagctcctcttccgccagagcaagatcagtgaagtcctgggaggcagtggctacaactcggaccggctctgcctgccctacattcctcagctgacagatgaggatcgtttatccaagaggaggagcattggagagaacatcttccctgaggatcccgaggatggtctggtgaagaccaacatggagaagctgaccttctatgccctctcagctccagaaaaacttgatcgtattggcgcctacctctctgagaggctcatccgtgacgtgggtcgccatcgatatgggtacgtgtgcattgctatggaggctttggaccagctgctcatggcctgccactgccagagcatcaacctcttcgtggagagcttcctcaagatggtggccaagctgctggagtcagagaaacccaacctgcagatcctcggcaccaactcgtttgtgaagtttgccaacatcgaggaggacaccccgtcctatcaccggagctatgacttctttgtgtcccgattcagtgaaatgtgccactcgagccatgatgacttagaaatcaagaccaaaattcgaatgtcaggcatcaaaggcctgcaaggggtggtgaggaagacggtgaatgatgaactgcaggccaatatctgggacccacagcacatggataagatcgttccatcactgcttttcaatctacagcatgtagaggaggcagagagccggtctccctcacccctccaagcacctgagaaggagaaagagagccccgcggagctggctgagaggtgtcttcgggagctgctgggccgggctgcctttggcaacatcaaaaacgccatcaagcctgttctcatccatctggataaccattctctttgggaacccaaggtgtttgccatccgttgctttaaaatcatcatgtactcaattcagccgcagcactcacacctggtcatccagcagctcctgggccacctggacgccaacagccgcagcgctgcgacggtgcgcgcgggcatcgtggaagtcttgtcggaagccgcggtcatcgctgccaccggctctgtggggcccacagtactggagatgttcaacacgctgctgaggcagctgcggctcagcatcgactacgcgctgaccgggagctacgacggggcggtcagcctcggcaccaagatcatcaaggagcacgaggagcgcatgttccaggaggccgtcatcaagaccgtgggctcctttgccagcacgctgcccacctaccagcgctccgaggtgatcctcttcatcatgagcaaggtcccgcggccatccctgcaccaggcggtggacacaggcaggacgggggagaataggaaccgtctgacccagattatgctgctaaaatccctcctgcaggtatccacaggtttccagtgcaacaacatgatgtcagccctgcctagcaacttcctggaccgccttctctccaccgccctcatggaggatgcagaaattcgactctttgttctagagattctcatcagtttcattgatcgtcatggcaaccgccacaagttctctaccatcagtaccctcagtgacatctctgtcctgaagctgaaagtggacaagtgctctcgacaggacaccgtcttcatgaagaagcactcccagcagctctacagacacatctacctgagctgcaaggaggaaacaaacgtgcagaaacactacgaggcgctctatggcttgctggccctcatcagcatcgagctggctaacgaggaggtggtggtggacctcatccgtctggtgctggctgttcaggacgtggcccaagtcaatgaggagaacttgcctgtctacaaccgctgtgccctctatgctctgggcgcagcctacctgaacctcatcagtcagctcacaacagtgcctgccttctgccagcacatccatgaggtgatagagaccaggaagaaagaggctccatacatgctccccgaggatgtgtttgtggagaggcccaggctgtctcagaatcttgatggggtggtcattgagctcctcttccgccagagcaagatcagtgaagtcctgggaggcagtggctacaactcggaccggctctgcctgccctacattcctcagctgacagatgaggatcgtttatccaagaggaggagcattggagagaccatctccctgcaggtggaggtagaatcgaggaacagtccggagaaggaggagcgagtgcctgccgaggagatcacctatgagacactgaagaaagccattgtggacagcgtagcagtggaggagcaggagcgtgagcggcggcggcaggtggtggagaagttccagaaggcacccttcgaggagattgctgcacactgcggggcccgggcatcgctgctccagagcaaactcaatcagatctttgaaatcaccatccgggccccaccaagcccatccgggaccttaatggtgctacggtcagcgagaaccatccatccc

SEQ ID NO: 96485 - DNA, 664 bp, Homo sapiens
ctcttctgtcctctgctcccgcagcaggggaggcctgagaagggccatggtttccaatcttattgtgcaacaggagaggcgagcgggattgggaactcatctccccagtgtgctctgcaaggccggccaagctggctccaggatgcgtggttcccatggcttgaccatggcagggggtctggggatgcccagcagtgagaagcatggtgggtcacctctctcgtgtgtttctctccttcctccctgatagtttgtgaagtttgccaacatcgaggaggacaccccgtcctatcaccggagctatgacttctttgtgtcccgattcagtgaaatgtgccactcgagccatgatgacttagaaatcaagaccaagtgagtaggggaaggcaagggtagttggttcagcttacagcagaagcaacggtgggtcctgtagataacttccaacctgccattgcgtgtctgcttttgttagtatctgtgtctgctctgatgttgccgggcaggtgggccagcacccagctccctacatgtggtttctgttttttttttttttctttttgagaccgagtttcactctgttgcccaggctagagtgcagtggcgcgatcttggctaactgcaacctccgcctcccaggttcaagtgattctcatgcctcagg

SEQ ID NO: 96486 - DNA, 411 bp, Homo sapiens
tggccctggctccaacctttcctgggcccgaccaggaggctttgctcacagtttttcccattcttattccaggtgtgtgtggctgctgtggtgccctacgccccaggtacaaaaggctggttgacaacatcttccctgaggatcccgaggtgggtcatgtctctggcaggcatcgtggctctcatggtccaggcagggcctctgacgggggcagcttggaagccaggcctcctgccgggtggggaaggcagggcctctcagggtccctgggcactgagccttcccagagaaactggaacctgggctacagccatgggcagtggtgagaggccgctagggacatgaaggatgagggcatttggatctgcagaaggcagctggaagtgcgtcttggcatgcttgtggccatca

SEQ ID NO: 96487 - DNA, 808 bp, Homo sapiens
ttcagcagtcactttaactaaaaagtctttgctatttgagattttatcttcttgtctgttaaaaaactgtttggcaccttaatttgcatgaatcgatttccagtcgctcaaatccagtttgtgcaatgacaagctggtgtggctgaaacggcagttgctcaagagcattagaacagccttcaccatgtgggtttacatggacagcacggtcagcagacagtgagacgggcgcttgtccactcgtctgacaccgtggggccataggaggcagcgactgagaaggtcagtcccattaaaaatgccctttggctcatctggaagctgtatctctggtcatgcaccatgccagccacgccagccacgccagcattatcacggcatgtgctttaaaatcatgcagacgttgttctagagtgagtgtgaacagctttcacacttgggcactgtgccggttcccatgctggctttcccacatgcacacaggtggctggcacgcagctctgcacctcttactgttgggagctcagaagcctctctctgtggtggtttttcatctcgggataattgaacccagctgggaagtaccaggaccagagaatctctgctgcataatatcaccaccccgtggcaactcacaaagcaagattttcaccgagaatcgcacatagaaataatttcacatctgcttctggaaagattttcaccgagaatcgcacatagaaagaattccacatctgcttctggagcacatttccctctaaagagaggggcagagcgacttcaccgtctgtcgtcatctggtggtgga

SEQ ID NO: 96488 - DNA, 517 bp, Homo sapiens
ctccaccaataatcaatcaccttctaaacagctgtagagtccatttccagccccactgtctccttagttagcatttctctcacctgtatgactccagcagctccctaatgggcatccctgactcttgttttacttccatgtcccccaatttattagtctttacagtcaggggtagtatgtgctctcctatgcaaaacccagtatcagtgatctactgctctcaggataaagtccaagcaccttaactggtacataaggtaacacacttattttgcaagtcaggctcatctcttactcttgttcaaccccgtacactatcttcatggagaatttctcaatttcttgactgaaccacgctatttctgggtcttctgcacatgctgttctaacaacctaggacacaacttccccatcccactcacttcatggtcggcctcatttctgctcagcttaggtatcaattctgcaaggaaaactttcctgactcctgtctgggttatgtgcccattctatgtga

SEQ ID NO: 96489 - DNA, 651 bp, Homo sapiens
tcctctgtaaagtggttattttaattcatattacaaatgatgaaattgaaacacaaggaagataatttttgccaagatattatgtggtaaggattaaccttgcttttagaaatcgtgtttttgcaacaagtctgtactgtctttaaattataggttaaggttcagaagtgtattacagcatttagataagctgatgttatttctaccaccttgaaaaaaaatgctcttgtgatttatcagcaccttccttcagtcattgctctgttgctcttggatttctagcaagagaagaaagagttatttgtactcattgtctccaatttctttcttccaatttcttcttaaatctacttaaaccaggattttgctccaaatgctccactcggattactatctaccaaatcgcaaatgacatccacactggtatttccaatgaccacttcctggtcctcatcctacttgacttgtcagcagcacttgatgaagttgattacaccctcctccttgaatcactttcttctcttagcatccagaaaaaacgaccagtcttcttaaggccttgacctcagatgtctcaagatgtcacatcagctgtacaaagcaagtcacaaaggccagcctgtatacaagtggagggcaaatagacaacac

SEQ ID NO: 96490 - DNA, 417 bp, Homo sapiens
gactttcttccttcacctacatcgggttttcccaacacgcaataaacaagtgcagggactatcctcagaacataatggtgagtacagtcacatagcaaggatggttaaagccctaagaagagatggaaccacttggactgcatggcagttggggcccaggaccaagctgtggggagctccagcattcaggggccgcagaggggacccagcaagtggaacacacagaggaggcatggcaagagacccaggcgggaagccaggaggaatgctgttcctttcatcagaggatgcagcattcaaggtaccatcttgggagcagaaaccaggcccttaccagacaccaagcctgccagcacattgatcttggatttcccagcccccagaactataagaaataaatttcttttcttcaaaatt

SEQ ID NO: 96491 - DNA, 418 bp, Homo sapiens
taattgagacaatcatatgacttttaaccatgttaacatggtaaattatatgcacagattttctaaaattaagccatctcagcatacatgggctaaaggaaacttggttatagtgtttaatctcattcatacatggttggattcagtttgctaatataaagtttttacatctacattcatgactaaaataaacctatatttattttttctcttttataacatttctatctggtgtaaatatcagagttataaaggtcttacagaatgaattgggaagtatttcctcttttcctgttctctggaaaagttcgtataaaatttagatgatctgctccttgaaattttggtaatattcatctgtaaaatgatctgagccaatgcttcccttgtgaaacaattgtttttctttttttcccac

SEQ ID NO: 96492 - DNA, 171 bp, Homo sapiens
tgccaccgccgagcgcacgggccgagccaagcctgatcccggagccggagggggactgggaccgagagaacggcgatggggggcggccccgccgcaggaggacccgggcgcgtaaccccgggggcccggcccgctccagacccagacccgcggggtgcggcaccctgagcc

SEQ ID NO: 96493 - DNA, 165 bp, Homo sapiens
tgagcacagaccactgtggaatgagacaccaaaggggctgcgctgtgtggtggtgatgagagatggagagaaacagggagagatggagagagaggcagagacagaaggagagagacagagagagacaaggagagagagagagagacagggagagacggagagaga

SEQ ID NO: 96494 - DNA, 591 bp, Homo sapiens
gagtggagaatgccaagagacccacctctgaggcctagtggctgggatacgagcacaagctttagagagtggctctcagcgtctggcctgcaaaatccagggcagttagcaaaattgagattccttatccctaagactctgatgagtggttctggatctggcctaagaatccaccttaaggtgtcccaggtgacatgacaattgcttctcaatcatgtgctgagaaatagcaaagaacctccccaccaggagcctgccaggggcagcctcatgctcagccatggctgtgcatatgcgaagtgggcgccgggggtcttggggagcttggtatcctccctccaaccccacaggacactcactaccacctggtgacagccagtcagacttgtgcttgctctgcagatgcatctccccacgagtggattctggagcctgtttacagctatggggagggtaagaagtggcccctgctcttcagagccatcatgcacagatagttgagccctaaggaaacccaaagccagctgtcccaggtactgaccctgctcccagcccaactcagcttccccaaatgaggctcctgctggccaa

SEQ ID NO: 96495 - DNA, 362 bp, Homo sapiens
atctgcctgccttggtctcccgaagtgctgggattacaggcatgaaccaccacgcccggcctgtaatcactttaaagtatagaaatcagtggcatcaagtacgtttgcagagttgcacaactattaagctagttccagaactttttcatcactccagacagaaaccctgaaccccttagcagtccctcctcactgtccccttcccccagtccctggcaaccactgctttctgtctctgtggatttgcctgttccggatattccatattaatggaatcatacaacttgtggcctattgtgtctgtctggctcctttctcgttcaacatttccaggtctatccacattgtagcccatatcagaa

SEQ ID NO: 96496 - DNA, 437 bp, Homo sapiens
tgggaaggaaattaatcttcatagagttctacttcagttctgggagctgaggtactacaagctcagcttacctctcactctccttaggaccagatttttaaccctattttactaatgagaaaattgaagcccatagaggttaagtaatttgcccaatactacatagtttatacccaacagagccagaatgaaaagccaggtctctgtacaattctcttaggttcacacctccttctctaatcaactcccaaccccacaccccataaggtcaagccaggataaccaaaccaacctcctaccaggtaccccaccttggaaatctctgcaagtcaggccacctctacatcaccactagattgtttttctcagaacccccttatttaaaatagtcagaatgttgtataggtagaagtaggtaatatgtagacttttgtgtc

SEQ ID NO: 96497 - DNA, 815 bp, Homo sapiens
agacagatctcaaaaatgggagaccacatgcaaaggaaactacgttttcacaacacatggttggagaggtcaaagaaaatgtgatgtattactttcagttttatcatcagcgggaccatctggggctagtggtggggctcgaagaaggaagaagaaaataaagaagagaatcagatccccaaagtagagagactgaattacagcaatgacctcgacttgcatttactaggatgagctgttgtgagagtaaatatgaaagctggaattcataattcattcaacctgtgtttcatccacttaccccaaaccaaaacataacaatcattgagcatccaccattcacatgtaactgtggtggagagagagatgaaaaaacacaatgcctaacctcaaggagtttacacactactcagagagataaataccatagacaaataattatactatactgtaaggctacttgggctaaacctataccaaaatcacaaggacattgaggctcagtaaggtgagatgacttgctccagatcacacagggttgaagctgaaattttaatctagagtccagttccagaatctgtgcttataaactgtgctgtgctgtatttgctttaagaatataagggtcatttcctgcttgaataatcaaggaaggcatgatggaaaagttaggggcatcataaaacccaaagacaattctgatcatatttttacttcaacacttctacaggaaagaaagccttcccatcactaatagtgagttctctggcagcaagcctcagtcattgcagcaggaatactgcttaaatattata

SEQ ID NO: 96498 - DNA, 331 bp, Homo sapiens
gaagaaagacaaaaaatatgtagccattaaaaatatttcaaacaaaacaaaaaaccacaataaagtgaaacaaacaaacaaaagccctccaaaagcacattaggctaagatgattttacaggcaagttccactaaacagataggtcctaaccttgttctagagaacagagatagaaatattgtgcccctgctcatcttttttgttttggttaatataaccttgatagcaaaaactagactgtacaagaaaagaaaattataggccaatcttacatatgaatatgattccaaaaccctttttataaatcaaaatttagaaaagaaactagca

SEQ ID NO: 96499 - DNA, 513 bp, Homo sapiens
caaggtcaggggagtgtccttgtgcagcctcggctgtggctgcctgtgtggctgagcagactaaggggcaggtcagccgcccttccttccacctctgcctggcatctcccaaccagatggggaggctaggccggtcttgctcatgtgggatctggatgcagcccttcacacagagcccgacatggagcagatgctccggagatgctgacggctaggattcccccgccaggcacctggcggtcctgcagaagggccaggacaatgtccccagccctccaccaattccagggcagatgagaatgccaagttgtgcctgcccgcaatgtgtgtatgtgtgtgcgtgtgtgtatgtgtgcatgtgggtgtgtacgtgtgtgcaggcacgtgtctgcccacaatgcttgtcagacaggatctgccctccgtggctgagggctggaggggacgaccacaggaagtgatactgccaagtcatcccaagtcaccctaaatataaccctcaatgtacaacac

SEQ ID NO: 96500 - DNA, 264 bp, Homo sapiens
tactgttcagaatgtaacatgattattttgaaataaagattttcccctagtttttaaaaaagttactttatacattaacccttatgttcctctttgatcaatttttccagtagtgtaaacagtcttcagggaagtagatttcttacagaaattgtcaagtggctctctgctgttagcatggttactaatcttttggttacttttcatattttttatactttctggaagtggacaacttacttgtaaataaaagtgcacacctta

SEQ ID NO: 96501 - DNA, 303 bp, Homo sapiens
caagtgattctcctcagtctcccgagtagctgggattacaggcgtgccaccatgcgactaacttctgtatttttttagtagacaccgggtttcgccatgttgcccaggctggtcttggactgctgacctcaagtgatccacccgcctcagcctcccacagtgctgggattacaggtgtgagccaccgcacccagcctactgaggagtttagagtcaggggagtgacacggtcggatttgcattctgagatggtcacaggctgctttgtggtgattgagtagaaggagtgaggccgaaggctgg

SEQ ID NO: 96502 - DNA, 371 bp, Homo sapiens
ctgtgttgtgatgcagatgtgatgcagatgaagtctctcaagaagcagccctccaccagatgtggtggctcatgcctgtaatcccagcactttgggaggctgaggtgggcagattatttgaggtcaggagttcaagaccagcctggccaacatggcaaaccccatctctactaaaaatacaggccgggctcggtggctcatgcctgtaatcccagcactttgggaggccaaggcaggtggatcatgaggtcaagagatcaagaccatcctggctaacacagtgaaaccccgtctctactaaaaatacaaaaaaattagccaggcgtggtggcgggcacctgtagtcccagctactagggaggctgaggcag

SEQ ID NO: 96503 - DNA, 510 bp, Homo sapiens
aaataaatcagtcttaccacttctctgtgcagattgccagtaaatctcctttcattgaaacaaggcaaataaattaaacatggtgaataacccactgacagaaagcatggtatttttctgggcaatctgaactacaaattggctgacaacaggaaacagtatggccctacactacatgattttctatcattaaaactatggaaatattttccttgtcctcatgtcctcatagatatgtctcttttaaatagcatagagctggatttttaaaatccaatctggtaagctatttaaatttaaattggtggttatagtgattaataatgtagttgggcttgttttgcccctcttattcatgtataatgtatttttatacttgttttgttcatattgttttattttgaattaattgaatctttgtctttattttattattttgtattcattgatttaaaaaattttatgttaaccttgaaatactgtcatgcagatttaataaattcttaagct

SEQ ID NO: 96504 - DNA, 583 bp, Homo sapiens
gctacatcctataaggccataatgccaatatcaccaatttgttactctgtcagcaatggatagccctttgatatattaaagggagggaaatcatatgctctattcatccattcatctatccatccatccatccatccatccacattaatgtatctgtatcaatatggcacacttgaaaagcatatgtcctctgaatttatattctagttctgctatatgctcactgagtgatcttctgcaaattactgcctctctcagcctcagttacctgaaaaataggcataattagatctacatcttacatctctcatcaggtttatcacagtgacatacaattgccaagcaggcaagtccaccttgaatgcctttttgactcgtttgagggttccaatactgtgtgtgccaacttagaccattatttcccagaaacattcctcttagtctatcgatttcattcccttgcaatgcactggcctttacacctgcatagtcaacagtgattaaagacagcatttctgtctctcctgccacatcggtacatttgtgtataggtaggtgttgctatttgtgtaacgtattacga

SEQ ID NO: 96505 - DNA, 415 bp, Homo sapiens
ttccttgtcgaggtgagttttttttccctgtagattattcagtttatccatcaggttttgactttttaaaaccactttcaattttaagaagacaatttttcaacatataacctctagttttatactatctctcagctaagcatgcaatcgtcttctgtttactgactttaggtgctatttttagcagtaaatattattctgaacaaccctcagtaacgctgagattatgggtttgaggaatgccaacatcaacagaatcaggtgtgggaactacctgacaagggtttttaaaacagctgtcaaacattctatgacagtctattacaggcaaatgtaatacagataatttcagcaaggaaatagattcataaaaaagaacaggatcaaattataaaactgataaatacgataacag

SEQ ID NO: 96506 - DNA, 178 bp, Homo sapiens
aactcacaaaattgtatggggacacgagattccacattcagacccagaatgaccctcttgttctttctgcaaatgctaagaacctccttgaaaatgtatactaaaattaagaatagaaggatcatggggaaatcctgcaacccacatagttctgtaaattttatagtggttgattttt

SEQ ID NO: 96507 - DNA, 418 bp, Homo sapiens
tgcaaacttcgcctcccaggttcaagccattctcctgcctcagcctcctgagtagctgggattacaggcatgcactaccatgctcggctaatttttgtatttttagtagacgggatttcaccatgttggtcaggctggtctcgaactcctaacctcaagtaatctgcccaccttggcttcccaaagtgcagggattacaggcatgagttaaagcatagtgaaatttgatacattcaggtgaaaagcaaacatgaaaatttgcatcctcccagcaatcaaattacattagacatggctaaatcatgatttcatgtagttaacaagcagtgaagggtgaggccaaccaagttcagacaaattgaaccttctacccaattctactctcctctcctcctttctccgaataaaacccaatact

SEQ ID NO: 96508 - DNA, 416 bp, Homo sapiens
taaaagtgtgccatggtggtttgctgcagctatcaaccatcacctaggtattaaatccagcatgcattagctatttttcagaatgctctccctccccccgaccctatcacctgagaggccccagcgtgtgtttttcccctcctcgtgtccatgtgttctcattgttcagctcccacttataagtgagaacatgcggtgtttggttttctgttcctgccctggtttgctgaggataatggcttccagctccatccatgtccctgcaaaggacatgatcctgttcctttttatggctgcaaaaatacttcttttaggggacttgttagctttctattctggcttagaatttccacttaaacttgtttttctgggatatatagcagaggggtgggactggctggattccacactactcg

SEQ ID NO: 96509 - DNA, 805 bp, Homo sapiens
ctcagtgtctcttaaagatgattgatacatttcacagcaccatttcttgttataacggcactcaagcattcatcaacaacttttgaaacatatacgaaaattatctaaaaatcctcaaaataccaattcagaaggaacatctacaggaacacctgacgaggctgcacccttggcaggaagaacacctgacacggctgaaagcttggtggaaaaaacacctgatgaggctgcacccttagtggagggaacatctgacaaaattcaatgtctggggaaagcaacatctggaaagtttgaacagtcagcagaagaatatgttaggccatgtgtctctataacagctattgaactctgcattgtacagtgaaagcagtcatagataatgtgtgagcaaataggcatgattgcactccaataaaactttgtataaaaaaccatttggtaagctgaatttggcctgtgatatatagtttcctggcccttcacacagaagatagatggagtgtaattacataaaaagttttaaagacaaagtaagcttttgtagtagttcatgctgtagtcttttttttttttgtcaccaatctgtggcctagtatcaatctattatgaaaatctgacccatccagggtaaaatgaatcaagttcagaagctcaatttacagatttaaacctgtaggtctttctttgccattattttattttgatttgtttaactgaattttttttaacttaaaaaataacaatagtatttggtagggtttctttttcatggtgaaagccatcagttaaggggccatgtcta

SEQ ID NO: 96510 - DNA, 267 bp, Homo sapiens
aatctttaaccctgataaatttccttagtatgaatttttttaattataccaaataacttcaagagaggaaaaaataaaacattttgatgacctctaaaatgtagtcatcaactgctaaatgtttaaaaatagtgttttatcatcatcagaaagacttcatgttaatacaaatacatgacatacaaatatacatctaaatatacattatatttataacataaatatacatctaaatatacatcatatttataatataaatataagatt

SEQ ID NO: 96511 - DNA, 653 bp, Homo sapiens
tgcctctgcatttcaggggtttaggattggcatttttaaaatgtcaacaaataaatgttcatatccacacttgacattttttccaaggagaattttaattgtataattgctggtaaattcatgcagccaacatggagggcacacggacaagatctatgagcattacaagtgcacttacctttgacccagcaattctatctctaggaatctatcctaaagatgctccagaacatctagagacaacatatgctgaaggttagtcattgcagtcctccttgtgatgacgaatgcctgggaacagcctgaatagcaccaactgagggatggtgaaatacattttggaacctccatgcagtggagtactacacagtcataaaaagcaatgagttttttatggtactgaatgttaataagtgaaaaaataagctaatggtgacatgctctgcaatgccacttgtaaagaagggggaagttatatgttatttgcttgtactttttttatgtatagaacatctctggaagaatgaataagaaattagtatctgcaattgcctctggggaagaaacctgggggaagaagatatattttttactgtttgcccttttgtacacttagtaccgtgtatacttatttttgaaaagcaagagtgtac

SEQ ID NO: 96512 - DNA, 167 bp, Homo sapiens
tgtcacccaggctggaacgtagtgcaacagtcagactcactgcagccaccacctcccaggctccagtgagtttcccacctcagcctcccaagtaattgggactacagacgtgcaccaccacacccagctaattttcttttttcttttttttcttttttctttgtgag

SEQ ID NO: 96513 - DNA, 407 bp, Homo sapiens
ctctccctaatttaggagtcccagctcccagctccctgtcccctcagacccagacatcgaggactcccccctcccttggaatgtaggaatccagtcccccagcctcctccttcctccagagaagcccagaacagccccagatactctcggctgcctccccagtgcccaaatccagaactgggagctcaggctcctccttcctgtttaccggccccgccctctccatttcccagacctcaccatgggacgcccccgacctcgtgcggccaagacgtggatgttcctgctcttgctggggggagcctgggcaggtgaggagggttgcggaggcctccggaggggagggatctgaaggcagcagtggcgctggggagtctgtgggaatgccgcgggggttatgtgggtgc

SEQ ID NO: 96514 - DNA, 261 bp, Homo sapiens
tctagacatcctttagcatcctaaccagaggcagcagcagcagcagcagcagcagcagcagcagcaactggatttgctttttcaccagaggatccagatttccctgtggccttgcaaacaaaaaagaaggaagacggagcagcacagtcatcccctttgtgaaaaaagcattcagagacggggtttcaccgtgttagccaggatggtctcgatctcctgacctcgcgatccgcccgcctcggcctcccaaagtgctgggat

SEQ ID NO: 96515 - DNA, 492 bp, Homo sapiens
tctagacatcctttagcatcctaaccagaggcagcagcagcagcagcagcagcagcagcagcagcaactggatttgctttttcaccagaggatccagatttccctgtggccttgcaaacaaaaaagaaggaagacggagcagcacagtcatcccctttgtgaaaaaagcattcaggtaactgagtgactcagcaagcctgggtcttggggaaattacgaatacctggttgaagggcagtcctcaggcagagcccctgagacccgttgaactctagagtgtgggagcagaggagattcatggcctgcccaggggcagtgtccacaggggcagagtgcccccaggactcgccctggctcagttaaggactcccctcaggaactgcagaggtgcaaggcagggtgcagctctgcctggactgagctggaaatgcagccgtgtggctgaagtggccacttcctgctttctgtaaagcagccacagggaactgtgaa

SEQ ID NO: 96516 - DNA, 147 bp, Homo sapiens
caccctatgtatttgttgcttgcctaactctatctccctcccaaccatccttctttccctctttttcctccctccttcccttcctacttccttccatcatccatttatatacccatctatccattcatccatccatccactcgtcca

SEQ ID NO: 96517 - DNA, 225 bp, Homo sapiens
ctaatcaaatagagatgtcaagtaggtgggatgatatagagatctggaattaaggaaagagatctaagttggagacatacatttggaaatcactagcatatacacagtagaaaaagtcacgaggggccaggcacggtggctcacgcctgtaatcccaacatgtcatgaggccaaggcgggcagatcacctgatgtcaggagtttgagaccagcctggccaacatg

SEQ ID NO: 96518 - DNA, 192 bp, Homo sapiens
tcaggacatttcagtgaggccacctacaagcagaaaggaggcccagggctagggacagaatggccccagagccagtcagctgcagcaattcttgtgagaaagggagggcaagctgccagagcagctgtgcccaatatgatgcctacacgagacagatgtccccagtagagtgtgttcagtgaccttctaaac

SEQ ID NO: 96519 - DNA, 484 bp, Homo sapiens
ctgatttggtaatgggaaatcttcaaggagttgaagcaaaggcttgcatgatcacatcctttgcttcctttcctatccaaatatttttattcaaattttactttctctaggatgtacctgccaaatactacagccttttccttatctggaaattcatagcagtttttttcagtaatgctcttcagatatataattataaaagatttacatagattttagagatacatgtcttatttttcttagtaaatttttaagtttgtaattcttgaaatggtcaccaaattagcttatcatctatttcttcttgaataagttatttagtaaattagtggataaatggaaatattggcttttttttacaataaaatataacatttagaatatgaatctattatggatatgaatcacttcctcagaaacatggatgctacccagctttcctgccaatcctgggcttatgcacacacagtcaattcaaccctgc

SEQ ID NO: 96520 - DNA, 523 bp, Homo sapiens
acgtcagcggcggaaatggtttctatcaaaatgaaagtgtttagagattttcctcaagtttcaaatgaggcgaatcccgttttccgcgatgctgcagcgcgcgggttttaaccgcagggtcacgcggaacgccgcgccgcgcgactgtgcctcggtctctgcgcccggctctccctccggtccgcaagaggaggaaggcccgcggcgtgccgaggtcagcggcgcggagccaccaggcgagacggtcacggacgcctgaaccgaggtcaccgaggccacggggccgggaggccctcagcagagcccgggggctccgcacctcaaggccggccaggaagaaacagcagcaggagcccagggcgccccggggagcccccgacacgcgggccgagcgcccagagcggcccaggccctcgcgaggagaccggcctccccagggcggggcttccgactcgggcgcccgtgagccccggaggcggcgcgaaggggcagagtccgcgtttctaaccagcccccgggtggg

SEQ ID NO: 96521 - DNA, 350 bp, Homo sapiens
tagaagcttcatatgttacccaaatttgatgaggagtatcatagtcagtactcctgtggagttttcaagtaaagccctcataatgatggtgggaaggaaggtgtgttccctaagagtgaggcttggcataaacccttcacacattacctggaagtatcacacttcaattttaaaaagattcacatgaatttacagtgttttttaatgttacataataggtaatacctatttttagtatgtaataaagccttaaattatataacattcaataaaaatacctgtacctttccacagtgtactagaaaatgttccaatttgtgtagaactgacttttactcttcttttcattc

SEQ ID NO: 96522 - DNA, 458 bp, Homo sapiens
tgacactcgaggagagacagaccctgccctgctggttggtcctataggaaggccccagcctaggtggcctagttctgccagcccaaccctgcctgtccctgtgacctttagttctctggacctcggtttcctcatttgataaacatttgtcaagcccaggtggctggagtgaggacgcagaggactaatgatctcctcaggaaaagaacagtttagtaaaatgaaggggatggaccagaagctctctgggggccccaccgactttcccaatcgaaagcaactgtaatgaactgtgtctggagtgctgtgtgccaggcactgtggatccagaaacggattaagaccttctgccacaaacaaccagaaaactgggcaagatataagcagcagacacttgacaacaggcagcacacaggacagtgaccccatgactgcctcagcttctgcctggagacagt

SEQ ID NO: 96523 - DNA, 238 bp, Homo sapiens
catcacaataaaatgtatccctacttggtgtttactatttgttgggtactattctaagctttacctagattaactcatttaatcctcccaattatctccatgatgtaggtaacagtatcgcttataatttacaaacgagaaaactggggcagagagtaagttaaataggagactggctgtctagcttcaaagtccatgttcttcaccaatacttcaacctgctttgtataacacactc

SEQ ID NO: 96524 - DNA, 486 bp, Homo sapiens
  misc_feature (1)..(1): n is a, c, g, or t
  misc_feature (25)..(25): n is a, c, g, or t
ntcattcggcactgactctcttaanctaccactgctacacattatgctccaagacactgaatctgaaaggatgcttccagtcttgccaagtggtttcactaccaaggccagtctccatctatgatagacccaaggaagatcatttacaactagaatctagtcatttaggagattgtgtgctccctggatgggccatctgcactggtgtgaggtttatctcattgaagggaaaaccttttgaatcttcttgaatatcagcaccaggaagagcagtacaaactggagaagctgggtgtcagcccagaacgggaactaaataagcactcgtagcttgaatgaataaacaagcagctcccacttggatagtatttccacacatcaggacttgagaggtaagtgggtagagctcggtgcctattacttatcttctggaattaacatggattgtgctgagaactcaagcaaaaataaaataacttttagact

SEQ ID NO: 96525 - DNA, 393 bp, Homo sapiens
cagcgccactagcctcatcagcgccaccagccccattgagcatcttttcatgtgcttattggcaatttatatattttctttggagaaatgtctactcaactcttttgcccattttaaaatcaggtttttttttgttgttgttgaattgtaggagttctttacatatttgggatatgaaccacttatcagatacatgatttgcaaatattttctcccattctatgccttttcactattgattatatccttttacgcacagaagttttacatttttgatgtagcccaatttttctattttttcttttgttgcctgtgcaagagttttattttaaatgcaattttgggatgtctattagacatccaagtcaaaatgtcaaatagacggctggatat

SEQ ID NO: 96526 - DNA, 278 bp, Homo sapiens
gaggcctgggacttacgggtggtgtgggttctgccttgttcagaactgtcacccagcctggaggtgctgtgacccagagcttgcgtgtgaggcagggggtgggaaggacctggggcttgaccctatagcccacagaagctgtcagtccttgacagcccagccaggacccggccttcacctggggagccctggccgctcatacacacctccagaggcagattagagtgggtggtgacctcatagaggttgcagctgcctaggcagaaatgacaagtgtg

SEQ ID NO: 96527 - DNA, 727 bp, Homo sapiens
aggctttagctaacgtgtactttcgccctgcgatgggccgcacattttcgccgccagtcttttgctcctgtttcaggtatgcgtgtgcattgtaaacttgtctgactgaactgattataagaaatgcacgtcactgcgcccggccccaacatgtttttctaatgcttaaggaaacccggagataatattcccatgttttgccacttagtaaagcattttatatgcctgtgtcagcgagcacatagctgcaagtgtagcccatggccagtctgtcactgtgtccttggcagaaaaaaagaatccaacaaatcggtaggtttttatatttaagacatggcacttgcattttattatgctggcgtgcatccccagcatttggataaggggccaaggtcaagtctctcagactgttggctgacaaacattaaacctggaaatcctaacagagtgtatgaaaaacaattacagtcaagggaacatgatagagaaagcttcggtcatcttagagaatgcatatattgccatgaagagaacattggtttaaaaaaaaatgttcaagagaatgaaaagacaagtcacagactgggagaaaatacttgcaaagtacatatctgataaagaactgatatccaaaatatataagaactcttaaaactcaacaataaggagacaaaccgattaaaaaaataggccaaagaccctaacagatgtcaccaaagaagatatg

SEQ ID NO: 96528 - DNA, 533 bp, Homo sapiens
ctgctgcccccactgcaagtgttgtgtgacacctggaaaagcaacgacaggacactggaatgtgggcttggcttctacttctgtgaagattggctcttgacccccatgaagctggagactggacattacaataggaaacctcagtgtttccaatatcctgcctgcccatctgctgatatttgcagcaatcaaaagcagcaagaacagcagtcctctgcctcatttccactttccaaattgtccatgagtgcacctaattggtggtacctaattcccatccagaactctagctgccatggagggaagcattttgtgcaatatggcgcaaattatgggtgcgttagtccccgccttaaccacggaggagacgttccaagacctccagtggatgcctgaaacctcggctagtaccgaactctgtatgtactatgtttttcttatgcttgcatacctttggtaaagtttaatttataagttaggtacactaagagattaacagtgttaactaataataaaattgaacagttaaaaca

SEQ ID NO: 96529 - DNA, 143 bp, Homo sapiens
ttatctgtcaaattataataggaactttgtattaagttttcatatttggctatccaaatagatttttattttgaccagaattcttagataattaacttaaagcaaataattacttagtgttacctttaacatgcatggccttg

SEQ ID NO: 96530 - DNA, 521 bp, Homo sapiens
cctcaaccccatctcaccttacatcagtacctggtccctgaaggtgattaagtttctagactctatctcaaatgctaggaaatctctttgttggctatccaactttcctcttataaaggtttgcagagcctcttcttttcttttgaagtcttctcaagctttagaaggtttttaaaagttcatttaaatattttcaataacttaaaaaaagtgctacagtattttaaaagataacatagaccagtactttcccaataggagaaaaatacaagctgcaaatgcaagccacttgcatagttctacattttctaatagctacgttaattaaggggaaaaaacaggtggaattaattttaataatatattttccttaacacaatatatccaaaattttattaacatgtaatcagtataaacatttctctttcaaacgaagtatttgaaacccagtgtatgttttatatttacagcacatcttaatttggactggctcaagtgctgatagctagcaagtggctagt

SEQ ID NO: 96531 - DNA, 804 bp, Homo sapiens
cttttcctattggcacagctgcaggcattcacccatgcaagcttccagcttgcttatctatgtctccaactcaattttacaggctgctctttgttagaaaagaaattattttggggctgctttttgttaaaagggaagccttactgaggactctcttactctcactaatcttctaaataatgtctttttagctcctgtatcaacagggtcttgctctgttgcccaggatgtagtgcagtggcacaattatgactcacctcctgggctcaagggatcatctcacctcagcctcctcagtagctggaaccacagatgtgtgccaccacacttgaccaagtttttatttttttttttagagacgggggtctcactatgttgcccaagcaggtctcgaactcctgggttcaagcagtccttccaccttagcttcccaaagtgctgggattacaggcatgggcaaccacgcccagctagggcaagtgtttatttaatagcccaggaattggaaaagcagaaggatggctttgaaaccaatttatcaattagtgaggggtgatggggttaaaatatagggtttctctaatgtaagtgttggacatgaaaaggaaagggaggagtattcatgtcttttctggaaatgggcagagatttcctggaatctggatgctgccctttttccttcctttaatggtaaggtattgccttttatggctgccagtaggtgtgccagttgtatggtaatcaggttatgatgaagttagaggctcttcagaggtcagatgagctgccatcttggatctcccc

SEQ ID NO: 96532 - DNA, 397 bp, Homo sapiens
aacaagggttaattataatcaactgttgaaacacactgttctaaacgcagtattattcacttgccacctattttgggagttcatgtataagcatataaaattaccattagactgtttcaaagtggtagaccttattttaaagtaagagcatttattttacatgtttaaaataagggatatgtaaatctttcctttctccctactcacctctgttcaccacaggcagtcattgttgacatcatcttgtgcttcattctagaaaaatttggcatatatgtatataatattacacgttatgtgttacaagtatatattaacatacatatcttgataatgtatttatactatgtatcttgaaacaatttcatttacatcttttaattatgtgaaatctttt

SEQ ID NO: 96533 - DNA, 350 bp, Homo sapiens
agatcttgccgttcttttgtcaaacttcttttgaaaaatgtctgttcatgtcctttgcccatgttttaatgggatgattattttatttttgtgtgtgtgaagttgtctgaattccttgtagattctggatattagtccccattggatgtatagtttgcaaatattttctcccactctgtaggttgtctgtttactctgttgattatttcttttgtgtagaagctttttagttcaactaagtcccgtctgtctatttttgtttttgttgcctgtgcttttgaggttttagtcacaaattctttgcctagaccagtgtccaaaagagttttccctagttttcttttcgtaat

SEQ ID NO: 96534 - DNA, 774 bp, Homo sapiens
actggtccttatcaccccagctcctttttgtttttctgtctcctgccttttccagaagtctgttgaactcaaagggctgaatgacagcagtcttccctccgtgactgggaaactacacgggaggaaccgtatcctgacgcagacgcgatgcggtgttccatcaggaaatgcttcatactctcagtgggcatcgtattcctgtggcccttcatcactttgaaaatccccaaggaaactgaagatgatcaaaatgtgatgactgtcaaaggccaagtagcaagccttgagccttgctcagtttgggaactgggaatatagggtggaaatggtgtggacaggcagattctggaaagcccctgggctttcttccttcctgaccttttcacctgagagcaggaagctccaaagggaatgggggtatggacctgggcctattagtccatgaagaagctgtatttattttccttattcgttaaggtaaagaagacagcaaatactgcttgagccctggatattttagccaatggccaggcatcctgagaatgtgccaggctcactctagggagaatggttcactccacctctttccctagaaaagcttatgggaagccactggggtgtaaaatttgttctttttatgaaaggatatatatgtttgcccttgtcaatgcccccggaggccagttataacagccggaaggacccaagatcactagaagactggcagaacctcaccttcaaatatatggaaaaaatccagaagagaagaaagag

SEQ ID NO: 96535 - DNA, 373 bp, Homo sapiens
aaaattttactatatttgaaaggctagttatgtattctgttatttagatataagagcatgagagtcttgatattaaattggtaaattaattattggcaacctagtggtttgggttggcaaggattctgtcaataatcatttggtagagtagcagaagcaaaggaggtgtcttaagaaaaatcaacaccaaaagggttttcttccttcgggagaaagaatttttataaaaagaatcttgaattgctaattgttatgaacctcataagaaaaaagtatttttatttacaaaaatgaaatgagttctattagatagatgtcgttttgatattctaggaactacaaaatgccttctgtgatatttaaagatacacta

SEQ ID NO: 96536 - DNA, 1553 bp, Homo sapiens
cacagtaagagattatagcaaagcatctataatcaactcagcttaagaagttttgaccttctggttaggcttcttgccacaacagaacagcaccataaccatggctttcttctcccgactgaatctccaggagggcctccaaaccttctttgttttgcaatggatcccagtctatatatttttaggagctattcccattctccttataccctactttctgttattcagtaagttctggcccttggctgtgctctccttagcctggctcacctatgattggaacacccacagtcaaggtggcaggcgttcagcttgggtacgaaactggaccctatggaagtatttccgaaattacttcccagtaaagctggtgaagactcatgatctttctcccaaacacaactacatcattgccaatcacccccatggcattctctcttttggtgtcttcatcaactttgccactgaggccactggcattgctcggattttcccatccatcactccctttgtagggaccttagaaaggatattttggatcccaattgtgcgagaatatgtgatgtcaatgggtgtgtgccctgtgagtagctcagccttgaagtacttgctgacccagaaaggctcaggcaatgccgtggttattgtggtgggtggagctgctgaagctctcttgtgccgaccaggagcctccactctcttcctcaagcagcgtaaaggtttgtgaagatggcactgcaaacaggggcataccttgtcccttcatattcctttggtgagaacgaagttttcaatcaggagaccttccctgagggcacgtggttaaggttgttccaaaaaaaccttccaggacacattcaaaaaaatcctgggactaaatttctgtaccttccatggccggggcttcactcgcggatcctggggcttcctgcctttcaatcggcccattaccactgttgttggggaaccccttccaattcccaggattaagaggccaaaccagaagacagtagacaagtatcacgcactctacatcagtgccctgcgcaagctctttgaccaacacaaagttgaatatggcctccctgagacccaagagctgacaattacataacaggagccacattccccattgatcaacccccaaagccatgagggatccaagtagagccacagaaaaagaagaattccaggagagggaaagatcgtaaggatgagagaggagaccatccaagccagaaattatttaataaatcagagttctagcaatagagtcctctcccaagtggctgaggcaggcttaggggaaagaaccagaggggcaggggaggactggggagggctggctagccagaggagttggctgtatcacccctggttattttagggcaacaacccagttggggagtcttatgaatcattccagccaactctctgatcacaaagaatactgtgcccctttctcctaaaccttagttcaccatcactacgtaggtttagacttagaagctttatttggaacagggatagtttgtttcctcttggtcctttcc

SEQ ID NO: 96537 - DNA, 788 bp, Homo sapiens
ggtgtataaaagtgacagtctcactatatttttcccagaagttagtagtctcacttctataaatcattattaatttcctaagtgaaaagtagtacctccttattacttttaattgcatttctttaactattatgtatactgcattcttagatatttaatttctatcatcattccaaaccagactttattgactggcagtaaactgagctaatttaattaagagaagttaaatgcctcaagccttctgaggaattattgttttaatgatgattctcttttggttaaaaggctgtaatccaaaatgcatcataagttaatcacactgtacttttcgcctctttttccccactaagaactttttcttgaagaaatgattatcattaaatgcctaaatgagaaagatgtttatcaaaactgacatcatcacataagttaacaagcctcctgactgtgcattgacttcgatattatcacactccagagtgctatacaaatttgtaaatagctctcaggggaggacaaatagaagtgagtttgaaaatagcttaatctcataaagtctaagtaaaaatgagtaactttaagattcttaaaattatttactgggggccaggagtggcggctcatgcctgtaaccccagcactttgggaggcaaagaaaaaataatctaatatatcaccaaaatgtatctaggggagggttggggttcacaggaatagctagtgaaggtggtgggattgaacagatttccaagagtgatttgttcagatgctgtgttagggtgctc

SEQ ID NO: 96538 - DNA, 589 bp, Homo sapiens
  misc_feature (583)..(589): n is a, c, g, or t
ctaaaggcagagaatgtccatccaacatgcccttctgactatacagtcaccacttttttgggggaattctttagcagatcttattgttctttctgcagaagctatcattcctacctccccaacccccaaaatctctaatacaggccaagtcattttttatgatgggtctctgagatagggcagtttgttagaggagaggctagggtagagagggagagaatggaggtatctgaaaataagtaagattaattttactcatttttctaacacgagtcagtatgcttgaagttttcattgtatttgatgtcatgtaaatttactgtaaaaaataagaaaaaattttaaaatgctttattgattaaatttagggttgcttttcagtatactcagtaactccgaagtcagtgttaacagtactgagcttacataagatttattgaatttacctaacttaggcaaatgttttcaaacttatatgcttttggtccaaagtcaaatcaattattttgaaaaagatgaatgggatttttttcagtgtggatatgaaaaataaaataaaatgatagctatgtttggaacaaannnnnnn

SEQ ID NO: 96539 - DNA, 884 bp, Homo sapiens
  misc_feature (878)..(884): n is a, c, g, or t
caataaatggcactccagctaagttaggttaaaaaaaattagatttcattagaattttaaaacaaacttgatgtttctgttatttcttcattccactaaatgatatggtttgaaaatatttatgctcagatttttaaatggtctctacaacaaattgtcacttgttgggttcaattaagtgctcattgtataagtgcacatggtacaaatcaacaccagcttataggattgtggaaagaattaagagatgaatttagtgatcttatataccctgtcagttggtcatattgtggaagagctctacaaaacttactgtactgttaactccaagattttcttccaataacagggatgctagccagatatttaataatcaaagaccaaaaatggcagtttaatttttctacccaatatcctatggcatatgaatgatccaaatttgaagctccaaggataggaaaaagcttacttgtgcctgtcctagacaagtactagagtttatattgaaatcaaaacttctaaaaataaaaatcagtaagattaattttactcatttttctaacacgagtcagtatgcttgaagttttcattgtatttgatgtcatgtaaatttactgtaaaaaataagaaaaaattttaaaatgctttattgattaaatttagggttgcttttcagtatactcagtaactccgaagtcagtgttaacagtactgagcttacataagatttattgaatttacctaacttaggcaaatgttttcaaacttatatgcttttggtccaaagtcaaatcaattattttgaaaaagatgaatgggatttttttcagtgtggatatgaaaaataaaataaaatgatagctatgtttggaacaaannnnnnn

SEQ ID NO: 96540 - DNA, 714 bp, Homo sapiens
tgaattaatgcctgattggtaagtaaaacaaataaatctcttagttttaaaatatatctgcaagattactctaaagtaactatagtttagaaatgtacagtgaatactttgaaggtctagacttacaccaatctgtttcctaatcattaggaatctgtattagagttctgtcagtcaagatttgatccacttatttattcaacaaatgtactatgcatgtagtgtgtgtagctactgccctaggcactggggatgcagtattgccttcaaggaatttacatctaatctattacttaatatattcaaaatgggagaatctttgcttgaacctattaatagtaatgaggtcaagtacaatcatacatattttccaaagagttaacctttcagctggtctcatatttgtcctgtcatgctctaaacattatattacaggcgtgccatacctcatccttcctgttaaagcagcagcctcccagcccctaggatttcttcccgtccacattcttgctgtcatctcagccatccacacctcccacatcacaaatttactccctcataacatatctacttgcacaatgttcctcaaatcctgtttaaaatccattagtgttttgctcaagaaccttcactagttttttatttctaaataaaacatttgcccttctttaaggccctaaatctcgagtcatttaatgtaattaaacttgtttt

SEQ ID NO: 96541 - DNA, 185 bp, Homo sapiens
gagaggtgacccatctacatggtcatccattcatgggtacagttttattttatgaccgctccaagcctcttaggacactccacagtgtctttgttattgttccttgtgtttggtgcttctctctgaaaacaggattatacattcctggcctgttaaatacaggctggccatgtgacctgctttag

SEQ ID NO: 96542 - DNA, 367 bp, Homo sapiens
gcacaggtacgaatgagatatggtgctcagcttcaaggagttacagtctaaataccaaaataacagaatcaagagcagcagactaaattgggcccactgtattttttaaaaatttaatttgactgctgggtgcggtggctcactcctgtaatcccagcacttcgggagcctgaggtgggtgaatcatgaggtcaggagtccgagaccaacccggccaagttggtgaaacactgtctctactaaaaaaaaatacaggccaggtgtggtggctcacgcctataatcccagcgctttgggaggccgaggcgggcgggtcacgaggagatcgaggccatcctggctaacacggtgaaaccccgtctctact

SEQ ID NO: 96543 - DNA, 436 bp, Homo sapiens
gtcagggggaagacttacccaacccagcccctggtcctcctggctggaactcaacaaagaacagcggtggaaacttagaataaaaggccctggctgctctgtgactggccacagaatctctccttttcattggctgtcatggatattgatgactagacccagacggcaattgtttaggttcttttttaactcctcaggtgtgaatgcttttcccccagctggatagtccgtgctgctgttaatatcatctccctacgtaatataatatgatcacagggcttctgcgaactatcttctcccgaccaatgagagctggtttggagactagtaatgggaaccactgttctcataatctgagtatctgactcctcctatgaacttcctaaggaaatctattttgtgcatgtctcaacttccgctttaaaagttgagcact

SEQ ID NO: 96544 - DNA, 281 bp, Homo sapiens
ctaaataactttcttgagaaataattcacatggtgtgcagtttacctttgaaagtatacaagttggctgggcacaatggctcacgcctgtaatcccagcactttgggaggccgaggcgggtggatcacctgagatcaggagttccagaccagcctggccaacatagtaaaaccctgtctctactaaaaatacaaaaattagcccggcatggtggcacgccctgtagtcccagctacttgggaggctgaggcaggagaattgcttgaacccgggaggtggag

SEQ ID NO: 96545 - DNA, 481 bp, Homo sapiens
gtagctgggattaacaggcgcctgccaccacacccggctaatttttgtatttttagtagagatggggtttcgccatgttggccgggctggtctcgaactcctgacttcaggtgatccacccgcctcagcctcccaaagtgctgagattacaggtgtgaaccaccgtgcccggcctacttatttcactttttatcggacaacagaagaagccttccttattagggtcaacagctggatcacaggctctgtatctgtgtgggttcctttggggttcattggagacttcttcaaccaacctagtttctctgatctggtcagcctgggcatctgaggggcagggccagagaggcctgactgctcactggccattggtctctgaccagacttaggtcttcaggagtagaccgcagtttgtcactcttcaggagtgctgggatgaggccgaccagccttctgaggagaccttcttttctttgtctgg

SEQ ID NO: 96546 - DNA, 484 bp, Homo sapiens
caatccagcagggcgcccgctgtgctcctgatccagggaagcacccgttgccactcctgatcgcgctaaaggcttgccattgttcctgcatggctaagtgcctggtttcgtcctaatcaagctgaacactagtcactgggttccacggttctcttccgtgacccacgacttctaatagagctataacactcaccgcacggcccaagattccattccttcgaatccgtgaggccaagaaccccaggtcagagaacacgaggcttgccaccatcttggaagtggcctgccgccattttggaagtggcccaccaccatcttgggagctctcggagcaaggacccctggtaacactggcagtacttatactttcattggttatacttatacttccccggttatatttatactttcctggcagtacgtatactttcatggtttatactattttaaaattattttttattaaatggagccaaatttttta

SEQ ID NO: 96547 - DNA, 626 bp, Homo sapiens
caatccagcagggcgcccgctgtgctcctgatccagggaagcacccgttgccactcctgatcgcgctaaaggcttgccattgttcctgcatggctaagtgcctggtttcgtcctaatcaagctgaacactagtcactgggttccacggttctcttccgtgacccacgacttctaatagagctataacactcaccgcacggcccaagattccattccttcgaatccgtgaggccaagaaccccaggtcagagaacacgaggcttgccaccatcttggaagtggcctgccgccattttggaagtggcccaccaccatcttgggagctctcggagcaaggacccctggcatctggatattaagactgtctccagccctttgaggttgagagaggaagcaagcacggaggaatggatttgacaacccacatgtccgtgactcaaagcaagcaaggccttgcacaaccaactcgccacccacacaatctgcacagtctcagtgagaaagcaggagcagggagctctccgctgagagtgaagaaatgtcctcaactcaacttctctgcagtgtgcatgtgtgtgaaacgcagacacacacgggaggaatttggctctgtcattttagtgtac

SEQ ID NO: 96548 - DNA, 484 bp, Homo sapiens
ctctagaggaccccgtagggagctatttcattggttatacttatacttccccggttatatttatactttcctggcagtacgtatactttcatggtttatactattttaaaattattttttattaaatggagccaaattttttaaaagtcatcttttccactaaattggcatcaccatgttaaatctaaatttccctactaagtctttattttattttactttaagttctaggatacatgtgcagaacatgcaggtttgttacataggtatacatgtgccatggtggcttgtgcttctagtcctagttactagggaggctggggagcagggtaggaggattgctggagccctcagatttgagagtgtagtgagctaggatcatgccactgcactgcagcctcggtggcagagtgaaaccatgtctcaggaaacaaacaatggtttgtgtcatctgagatgcaaaaaaataataacaataataaga

SEQ ID NO: 96549 - DNA, 825 bp, Homo sapiens
caatccagcagggcgcccgctgtgctcctgatccagggaagcacccgttgccactcctgatcgcgctaaaggcttgccattgttcctgcatggctaagtgcctggtttcgtcctaatcaagctgaacactagtcactgggttccacggttctcttccgtgacccacgacttctaatagagctataacactcaccgcacggcccaagattccattccttcgaatccgtgaggccaagaaccccaggtcagagaacacgaggcttgccaccatcttggaagtggcctgccgccattttggaagtggcccaccaccatcttgggagctctcggagcaaggacccctggtaacactggcagtacttatactttcattggttatacttatacttccccggttatatttatactttcctggcagtacgtatactttcatggtttatactattttaaaattattttttattaaatggagccaaattttttaaaagtcatcttttccactaaattggcatcaccatgttaaatctaaatttccctactaagtctttattttattttactttaagttctaggatacatgtgcagaacatgcaggtttgttacataggtatacatgtgccatggtggcttgtgcttctagtcctagttactagggaggctggggagcagggtaggaggattgctggagccctcagatttgagagtgtagtgagctaggatcatgccactgcactgcagcctcggtggcagagtgaaaccatgtctcaggaaacaaacaatggtttgtgtcatctgagatgcaaaaaaataataacaataataaga

SEQ ID NO: 96550 - DNA, 761 bp, Homo sapiens
ctcgccgtccaccactgctgttttgctgccgtcgcagacccgccgctgacttccatccctccaatccagcagggcgcccgctgtgctcctgatccagggaagcacccgttgccactcctgatcgcgctaaaggcttgccattgttcctgcatggctaagtgcctggtttcgtcctaatcaagctgaacactagtcactgggttccacggttctcttccgtgacccacgacttctaatagagctataacactcaccgcacggcccaagattccattccttcgaatccgtgaggccaagaaccccaggtcagagaacacgaggcttgccaccatcttggaagtggcctgccgccattttggaagtggcccaccaccatcttgggagctctcggagcaaggacccctggtaacactggcagtacttatactttcattggttatacttatacttccccggttatatttatactttcctggcagtacgtatactttcatggtttatactattttaaaattattttttattaaatggagccaaattttttaaaagtcatcttttccactaaattggcatcaccatgttaaatctaaatttccctactaagtctttattttattttactttaagttctaggatacatgtgcagaacatgcaggtttgttacataggtatacatgtgccatggtggtttgctgcacccatcaacccgtcatctaggttttaagccctgcatgcattaggtatttgtcctaatactctcc

SEQ ID NO: 96551 - DNA, 286 bp, Homo sapiens
gtcatgtggtcggaagggctctgggctgggagtccaggcagggtaagaggggctgcagccctgccacttaccccctccaggtcatttgaaggatgtaaagaccgcattctgtactgatgattcttcaccctggttgcatgttggactcacctgcagagctttttaaaacactgatgcccaagcctctctccaggccactgaaatcaagttgtattgggtggggccctgggcagagatctatttgaaaagctccccagtgattctaatgggcagctgggggagaacc

SEQ ID NO: 96552 - DNA, 412 bp, Homo sapiens
ttttataaagcaggcacaattataaattatgcagaaaaggttaatacattcaactacaaaaaattagaacctctctttgtgagaggtgattgaaaaatgagtaaaaagtcaagctagaagatatttgcaacttatttaactcatgaatgattactatccaaagcatattatgaactgctaggaatcaataagaaaacaaccaaatcttttggggaaaaaattgccaaaaaatgtttacagaggagaaagcataaaggtttacaactatataaaataatgtcccaccttattatttattacagaaatgtcaagtaataaacaatgaaataccgttttacatttacttaattaaccaaaaaaaatttgtcttacattgttaagtggtctgcatgtggcttcagtaaaattctta

SEQ ID NO: 96553 - DNA, 726 bp, Homo sapiens
atttctccatgcctttgaaggaaggggtaaaaaagccaggtaggaataagagaatagtaataaccaccattggctaaaagaaaaactgtgaatttcaaaaatgtgtgataggttgagtctgggttaagatccacagaattacattggacacattgtacattcatctttgtgttaagtagcacaggcatataagtgggttaattctaaaaaaaaattgtatcagctggctgggcatgatcactcatgcctgtaatcctagcactttgggaggtcaaagtgggtggattgcttgagcccaagagtttgagaccagcctgggcaacatggcaaaaccccatttctactaaaaaaaaatacaaaaattagccaggtatggtggcacacacctgtagtcccagctactcaggaggctgaggtgcgaggatcacttgagaccaggaagtcgaggctgcagtgagctataatcatgccactgcactccagcctgggcaacagagtgagaccctgtcttcaaaaaaaaaaaaaattgcataagctgggattccaaggttaacaaatgaagctggattcaaattctaggtctgtatctctttggagaagtttcttaacttctctgaacctgttttattatgaagatattaatagtgcctgtctcatttggttggtgcaaggtttaaatgaaatagcacttgtaatgctcttggtacagtgtcttcacactcagta

SEQ ID NO: 96554 - DNA, 762 bp, Homo sapiens
agggttgggtaaaaatggtgacctgaatttcacagatctgattacttagttttgggaaagatatagaagattatataatagtaatattacaactagaaatataatagtactatcacctttcaaggcattattattgtgtaaattattgtgtgtccccttctgttccagctattcattatcccttctcatttgtctttatgaagagatacatgatttgccattcatagtctatacaaaatacaactattgaacattggatagtctatgcaaataggatagtctatgcaaataggatagattgaatggttttattcaagagaatgactgtcagtataagtctccatatttaattttaatggccagtcatgtagtattgaaatagccagttagactctttcatgagagagactggaaaagacccagtgctagtatatttttcctttctaaaaattgagatacaattcacataccgtaaaatcagtccttttaagttatataatccattcatttttagtgttttcacacgtcgtgcaaccatcaccactgtctcattccagaacattttcatcatcccacaaagaaactctgtacccagtagtagtcatttcccattaccccttcccctccccaactcagcccttggcaaccactaatctaaatctactttctgcctctatggatttgcctatccagtattctttttcaattagccagtctccagcatcatcacagccagtgatcccacactgaaggttgtgaaga

SEQ ID NO: 96555 - DNA, 444 bp, Homo sapiens
cagtgagcccagatcgcaccactgcactccagcctggtgacagagcgagactccgtctcaaaaaaaaaaaatttaaatcgtgaagtcatctattgatctgttcctttctgattttaattgcattttattcctttgaagttattccctatgcaaaggcaaaaaaaaggctatatattttctaactgagattgatttttggtattgttacaggcttcgctgcaactgaattgcaacaggcttgagctgcttcccatctcgcaccctgcagaggcaggtatggtggtgacaagccagagtccacatgtggatggaagatacaagccatgttgaaaggaagctccatcctgctttctctttcctcttcaaactctgcccagtttctagcagccatccaagcctcctttctctcagcttctagcctcctgatgcttcaagctctaaagg

SEQ ID NO: 96556 - DNA, 158 bp, Homo sapiens
cttgttcacgtcctaagttgctctagtgttcccggcaacgtacccggcactgagttctcaggactggtgcaggtcagcggctccgcaggggtgagctgggcgctgcctgcatctgacgagatagcagtatgttagcatctgtggtgttctgtctaccg

SEQ ID NO: 96557 - DNA, 609 bp, Homo sapiens
cctggcaggtagtagcacccagcagacaacatcaaagactcccaacactgcagagcttagcacctgggaaagctgggaagaggccacatgctgaggttccaggaaggagtcagaataatccctggggcctggtagctggtaactggatctcaaatataagcttggagttcagggatggaggcataaaagcaaagagagatttcctctctaggggctaagaaatattcaggaattcaagaagaggcaaaagtcgatccaaaaaggttacaagaagtgaagttggagtaagagcggccagaagcttggtgtcaaaaagcaaagtcacagtgtagttatgccatgcaggggtgaagatcaaatgtgattccttaaatccttcatgattttgacttcatcatgtgcacagaaactaagctgagcctataggtaagggataaggggctgcggctgtggggaaaacagggcccaggggctgggtgcgttggctcatgcttgtaattccagcactttgggaggccaaggtgggtggttcacttgaggtcagaagttcgagaacaggctggccaacatgatgaaaccccgtctctactagaaatatgaaaaaaaaaa

SEQ ID NO: 96558 - DNA, 415 bp, Homo sapiens
cctgacgccatgcagatagatattgatctagatacagtctagatgctaaagtagagaaaggcgattggtgcagctgttccactgtgatggaaatgtgcagggtgagtgaatagtccctagacgtggagatattcctgactgcttttacgatactgtcagcatcctatgattgtcttgataatttctgcctttgggaaactgtttcagtttttaggtaactgagctgcatgtatcagttgagaaacggcaggctggcataatggaaaaaggacagcccaggcttgggggtcagacgtaggcggattcaaatcctaactgctgcttctcggttatgtgaacttgggccagttcctcagagtacctcatcccctgactttgtgtatcggggataattcctactttctgggttgttgtg

SEQ ID NO: 96559 - DNA, 417 bp, Homo sapiens
ccacacctggtcccatttattaaaaactttaaaaagcaatgttaaatcacatatatgctcattagaagttaaacaatgcggatgttgtataaagtaaaagttgctaacctcttgctctgcctcaccttataatcccacccactcaaggtaacacatcagtcctgttctttatttctcatttaaaccttaacattgtcctcattccggagttttaagagaaaaagacaggataaatcctgtgatttagaaacataacagagaaaaatagaatatggaagttttccattcaattaaagttttctaaacccacaaagagataatgcgatttagctattgacccagaagcttgcggatctcttattttcaaataattgattattctaggttaatgaattaaacctaataatagtcagagtc

SEQ ID NO: 96560 - DNA, 362 bp, Homo sapiens
caagatggtggtgcacgcacgaatgaggctgccgtggaggacaggttggcaactgctgaaaagatggctgttgaccaggatgttgttggccaggtatcagtcgttcctggattgcttgtgggtctccaaggccaacaccaggacaaccatttggcctcatgtgcccagtcaattcccttggtgccgaggacatgcctataaatggacgagactgctgcatgttcacgaagggtgatctgtgtaccctccacccagtctcccctactgggactgtcgtgcaaaattatggcccagtcttacaaccagggtattgacagcgagacaagcccccatctgatccagattctccagttgtacttgct

SEQ ID NO: 96561 - DNA, 485 bp, Homo sapiens
gatggcgcgggttactctagaggatcccttcgatgtgggctcagagcttgcaaaaatgtgagttatgcatgttgggaagttggagacagaaatcgctcgctttgagtctatccctacacctggcttctgcctccttccccacccactcccactccctgggtagaggagaggtctgcagagcccaccccagtacatactgtcaaaggagataagcatgctgggtcatcccactcctggcctcagtatccccactccaggtgtgggccacacacctgctggaaatagactgaggctctagagaattctacctcttcttctgaattagcagtccccagctttctccaactaccaggtttcctcaggctaatgaggacagtgggtcctgggtagtgaggctgccccaggggaggaaatttcagagaacagcttgtggatttttcagcttctccaagcatcccctctgaggccacatcgaagcttcattg

SEQ ID NO: 96562 - DNA, 493 bp, Homo sapiens
gatggcgcgggttactctagaggatcccttcgatgtgggctcagagcttgcaaaaatgtgagttatgcatgttgggaagttggagacagaaatcgctcgctttgagtctatccctacacctggcttctgcctccttccccacccactcccactccctgggtagaggagaggtctgcagagcccaccccagtacatactgtcaaaggagataagcatgctgggtcatcccactcctggcctcagtatccccactccaggtgtgggccacacacctgctggaaatagactgaggctctagagaattctacctcttcttctgaattagcagtccccagctttctccaactaccaggtttcctcaggctaatgaggacagtgggtcctgggtagtgaggctgccccaggggaggaaatttcagagaacagcttgtggatttttcagcttctccaagcatcccctctgagtccacatcgaagggatacacaagagcga

SEQ ID NO: 96563 - DNA, 455 bp, Homo sapiens
ttaaagtgaagacccagaggattttagaaacaaaagctcagagcttgcaaaaatgtgagttatgcatgttgggaagttggagacagaaatcgctcgctttgagtctatccctacacctggcttctgcctccttccccacccactcccactccctgggtagaggagaggtctgcagagcccaccccagtacatactgtcaaaggagataagcatgctgggtcatcccactcctggcctcagtatccccactccaggtgtgggccacacacctgctggaaatagactgaggctctagagaattctacctcttcttctgaattagcagtccccagctttctccaactaccaggtttcctcaggctaatgaggacagtgggtcctgggtagtgaggctgccccaggggaggaaatttcagagaacagcttgtggatttttcagcttctccaagcatccc

SEQ ID NO: 96564 - DNA, 433 bp, Homo sapiens
agaaggaaactctgtctcaaaaaaaaagaaggggagcgatcacgtgcatccctctgctgagatgggagcagcagcgtggggttgggctttgaactggcatcgtaggcattttgttttctacatttagaggaaaaatatacatcaaatattcaagtcccctgggcacagataaaagagttttcagatatctctgcagccaaatcccaaatgggatgcagaagggagaactgtgtaaaatcacgctcttccagaagctgggctttgtaatggggctggcaaaaattcccagggcatcgtttgtggcctcaatgtgattttcatgtaagtcatggattttctaaatctttgaggttagtggatctaaagaaaagcttggtaaacatccagatgttgtcaaacatatttaggtcattgttctctgacagttcgtgat

SEQ ID NO: 96565 - DNA, 195 bp, Homo sapiens
ctaaagtgggcacgtattggccttggccaagagtcaccccgtggcaaatcaggcctggggtggttcttccagcaaagccagaaatccatcttatgtgaaatccccctggtccctggtttctcaacactggcaacttctcaaaattttcaaaagcattgtgaacacgcaaaaacatgtctacagcccagcctctga

SEQ ID NO: 96566 - DNA, 212 bp, Homo sapiens
agagatgaggtctcactatgttgcccaggctggcctcaaattcgtgggttcaagtgatcctcccacctcagcctaaagtgctgggatcatgggtgtgagccaccagatgcagcctataattatagttttaaatcagttttatgatatctattctcatgaagcacctgaatttgccaataatctatctttcaaaatctttggttatcccatgc

SEQ ID NO: 96567 - DNA, 465 bp, Homo sapiens
tttcgatgtgcggactcagagcgtgagggttcaggagttagtataacacaatcagtggccaggagcgcaaacttgggggcaggatagaccccaatttcaactccaaactatttgaacatctgtgagctgcagattagcttctctaggcctcagttttcttctctataaaacgggaatggcaatacctacatcacagggttgttgtgaggtttacatgggatgatacaaagtgcttaatgtagtctcacatacactgtaggcactcagcaagtgatggttatcattctgttatcatactggctgttattattctcacctaagtaaagacaggatcaaaggtggctgcttctgctctctgactgagcagccagtacctgatcagaggcgaagggtggattctggcagagaggactctgtgggagccagggcttttcccctctcccaacctgatgggtcccactcctt

SEQ ID NO: 96568 - DNA, 414 bp, Homo sapiens
attcagtagtttcatactaaagttccaaatattacagaagtttctcagctatagagcaacttctgagaattttttaatatatctgtttttggtctttaagattactaccacttattaagcactagaggggaaaaagagaaagccacaggtaactattttttttttaactcatcttctatgtgtgatcatacaagcaatttattgtaggaaatttcaaaatatagaaagcatcaagaaaaaaactaaaagcagctgggtgcagtcgctcacacctgtaatcccagcactttgggaggccgaggctggcggatcacaaggtcaggagatcaagaccatcttggccaacatggtgaaaccccgtctctcctaaaaataaaaaaaaattagctgggtgtggtggcacatgcctgtaat

SEQ ID NO: 96569 - DNA, 226 bp, Homo sapiens
ggtgactcatagaggatccccagtttaagcgcaggcaagatttggtatactctcagaaatagaggtggacaggctaatgacattatatcatacacagaaatattctctgctgagaaggtggctttgggggccaccgggagggcctggtcctttcccgagtgagacggagttgcaggggtctctgagcccaggagggccaccgcctgactcaggagttcacaggctc

SEQ ID NO: 96570 - DNA, 421 bp, Homo sapiens
attttctaaaatactgttaaaaaattgaatcagttctcaaaatttcccacccgcccctccccgtccttttttttatggagacggtccggctctgtcacccaggctggagtgcagtggtgcgatcacagctcagcagcctgacttggtgggctcaggtgatcctcccacctcagccacccaagtagctgggactgtaggcgtgcaccaccatacccagcgaattttttgtagaggcagagtctcactattttgccccagactggatgacatttttggtttttttttttcttcttgagatggagtcttgctctgttgcacaggctggagtgcagtggtgcaatctcagctcactgcagcctccgcctcccagattcaagcgattcttcagtctcagcctctggagtaactgggattacaggca

SEQ ID NO: 96571 - DNA, 793 bp, Homo sapiens
acctgaaaaaatttagaaactgtaaacaccatttacaatacaacaatacaaagcacttagacataaatcattcaaaacatatgtatctgttgacatctttactaaggaaattataaaactttattgaagagcacaaaaaatgatctaaataaatgtagagagaaatcatgttggctgggcagggtggctcacgcctgtaatcccagtgctttgggtggccgaggtgggcgttatcccttgaggtcaggagttcaggagttcgagaccagtctggccaacatggtgaaacttcatctctactaaaaatacaaaaattagctggacgtggtggtgcatgcctgtagtgacagctactcaggaggcttaggcgagaggatcactgaaacctgggaggtggcagttgcagtgagccaagattacagcactgcactccagcctgggtgacagagtgagactctgctctgtctcaaaaaataaatactatacacatacgtgttttcgggccatcagggtgcatatcatgggcaagagcggggcactcagtgatgacatttggtgccacactattatgatgggtaattatataatctcggggtgatatcgctaaaatgggctccccgggaaaagacgggatgtcgatcacaatgtcgaataaataacgcaaacaaggtccacggaacttaccacaatccaaatgggaacgaaagtagatgtaccttaaccagatatgcataagcctggacaaaaccggacgggtattcacacagggataaaacacccctgagaaaacgca

SEQ ID NO: 96572 - DNA, 453 bp, Homo sapiens
agaaaaatacccttgggttgatcatattcaggttaaaggttgctgtatccaataaagttaaaaaaggatgttaaaatattttggctaaattgttttttatacctcaattttttcaactataaaataaatccaggtgttttccaaacaccacagaggtattatcagaaaaaaggggggacaggttccgccacaccccccaaccacagtatgagtttagtgtatcctttccactttccttaatgctcatgcacatggactcatgcattttaatttgtagaagacagagtcatactctacacaatactccacatatagtgttcacataacccatcaaggcatgctccaggccaacacacccaagtctaattcatcctctccaacagccacacatgggaagcatctccactcattcgaccagatccttactgatgggttcaagcttttcccagttct

SEQ ID NO: 96573 - DNA, 367 bp, Homo sapiens
agaaagctattatgaatctgctgaagaatgagttacataaatttaagtgtgtgctgtctgggttcagtggctcacacctgtaattccaacactttgggaggctgaggttggaggatcatttgagctcaggagttcaagatcagcctgggcaacatagtgagacttcatctccacaaaaatttaaaaaaaaattagccatttgtggtggtacacacctgtagtcccagctgctcaagaggctaaggcaggatgatcgcttgagcccaggagattgaggctgcactgagctctgatctcgccactgcaccccagcctggtgacagagtgagaccctgtctccaaaggggttaaaataaaagtgtgttct

SEQ ID NO: 96574 - DNA, 300 bp, Homo sapiens
aatagagattaatggcttttggccttggagcagagcagtatgtatgtgaggcatggcgctgggtcactgtctctaagtcatgcaggccacacaccttcctgctccctctcagtttttcctctccctttcacagttctaggagaaccatgacatgaaaatggttcccaaatcctttcccacatcatgggggcttcatcaaaggcctaggcagcaccaagagcaaaacgaaggccctgggcacaaaacaccgtaccagctttggccacttccccatgggaagacgggcagagaaaagtaccc

SEQ ID NO: 96575 - DNA, 927 bp, Homo sapiens
gtgttcgttggctttaaaaaaatcacattaacattcatgttgatatacaaaaactcttctccatctgttttgtgtgagttttaccaagaaaccaaacaactggaaggtacccacgttgaagatggcaaaactaccaactgccatttgcatgaattgttgagcatgactagtattaaaaaaacttaaaaattgatataacttttgttcctacaaattggcaaaggattttataaactagtaagtcagcattagcaaaagtgcgaaaatggcactatcagatactagtggtaagagcataaactgaatattttgaataccctacaaaactaggacagtgtcctagaatttgtaatggcataaaccagaaacaacataaataaaggaacagaatttacagtacttccatgtgatgggacaccatgaactcattaatattcaaaaaacatttaagtttaaaaatgctcagaactaaagtaacatttaaaaaacaggctagctcatctacacacaacatagtaacatggtaacaatctcataaaaaatactatatgtatagagaaagaaccagaaggaaatgctctcaaatataagaaatgttaataaggtggttagtttttagttttcttcaccctgttcagtacttctgagtatctcctatgagctcattaatctttaattttaatcatcttattttaaaaaaacaaggaccatcttgatatatgtttacttttattaaggaaaaagaatctatgaacacaggaacagaaatcaggagatcttggctctcgccctttcagtgccacaaagctgttttgtgaacctgtaaataatccatttggagtctccatgtttctcaattgtaaaatgaggatatgctgcttctacacatttcacagggtcattgcaagaataaaatgagacaatgag

SEQ ID NO: 96576 - DNA, 450 bp, Homo sapiens
aatgaaactatataaaccaaggcatttctgactccagtaggaggcagctgctgtgagggagaagccctggccaggaatctgttatagttattttgtcaccaactggaatggccttgggacaaagcacaacagctgtcttgacctcatcaatagccttgacctcatccctcgtgtcatgctgtgtcatcttcaacatctgtcacttccatcagccttagcattggccttggcctcagtttcctcatgtgtgacttgaggatgatgattcttataggaatcaataagcttgggataaagaagctattgggtcacattatacatactttaaatgcattaagtggggtctgcagttcctagagattagcagattgcattgcgtgagaacagagccatagagaatgtttgaggtcccattaatagctgataggaggctgatcagtaaacactggg

SEQ ID NO: 96577 - DNA, 890 bp, Homo sapiens
agcgggagttcacggcgggggcgggggctcaggcatggcgggctgcaggtcccgagccctgcccctcaggaaggcagctaaggcccgagcgcagcgccggtgggccggcagtgctgggggacccagtacaccctccgcagccgctggcctgggtgttaagcccctcattgccggggccggcagggcccgccgctgctccgagtgcggggtccgccaagcccacgcccacccggaaccccagctggcccacaagcgccccgggcagccccggttcccgctcgcgcctctctctccacaactccctgcgagctgagggagccggctccggccttggccagcccagaaaggggcttccacagtgcagcggtgggctgaagggctcctcaagtgccaacaaagtgggagcccaggcagaggaggcgcccagagcgagcgagggctgcgaggactgccagaatgctgtcacttctcaccaggaatcaaagtactaccagagacacagaggcccagaattagttttgcaacttggtaagaacacataaccattttttccactaagagaatattaagacatttttattcatatattatgataaaactcttatgaaattctttctgacaactttgtttggctactgtctcttaagttttgaaagtttcatgggaaatttcacatgaaaattgttttgctgggaacaccttttcatattgtgaattttttctcttgtctcttcctttagcctgtagacattatttagctttctatttaattttgttggtctacttattaattgtttcctattttagtctactgaattctgctgtgagaaataatactcataaaatactattgtgagaaaagtactcataaaatattataatgagaaaac

SEQ ID NO: 96578 - DNA, 378 bp, Homo sapiens
gtcacatcttgtagagctgttggggtgattggtttggctctctttctgtatatcatgcattgtgtgtcttacaaccagaatcccttcttgctctctgctttgagacttcatgaatacccggtaacataacattacaaatctagattttttaggtaaagtttccaaatttttatatattggctcaaaattatttaatattgtataggccaaacaaggtttgtctgtgggctgtccattgtccaggagctatcagtttttaagggctctggagagctctggctcggagcccagtttagaaagagctctgggtcttctccagtcctcatcatctgtgaatttctgattttcctggatttagtatgagccactggaaggaac

SEQ ID NO: 96579 - DNA, 349 bp, Homo sapiens
tttctgataaagcaacgaaagcaagagaggcaggccagtgtcacgcaagtggttaatgacagttgacctttgtcatttggacctttgtcattagaactttgtcaacagacctttgtcaacagacctttgtcatttggaccagaccaccatcctctagttcccactctctccaccatgtctcactgcctttcatcttttgattacttacctatgccagttagtttcctaaccagctttttaggtgatccccatgagcaccctgtgaggttggtgctaccattacccatcatacagatgaaggaactgagaggctcagagactagtatcctgaccatccatgtgaaatgca

SEQ ID NO: 96580 - DNA, 771 bp, Homo sapiens
accagtttatgatctaagagtgaaatcaacaggacttcgggaaggatgtgaatatgaatatcgtgtttatgcagaaaatgctgctggcctaagtcttccaagtgaaacctctcccttaattagggcagaagatccagtgttcctaccatctcctccatccaaacccaaaattgtggactcaggcaagacaactataactattgcctgggttaagccgctgtttgatggtggggccccgataactggatatactgtagaatacaaaaaatctgatgacactgactggaaaacttccattcagagcttacgagggacagaatatacaataagcggactaacaacaggagctgaatatgttttcagagtaaaatctgtcaataaggttggtgctagtgaccccagtgatagctctgaccctcagatagcaaaggaaagagaagaagaacctttatttgatattgacagtgaaatgaggaagaccttgattgtcaaggctggtgcctcatttaccatgactgtgcctttccgaggaagaccagtacccaatgtcttgtggagtaagccagacactgacctccgtactagagcttatgttgataccacagactctcgtacatcactgaccattgaaaatgccaacagaaatgactctggaaagtacacattaacaattcagaatgttttgagtgctgcttcactgaccttagttgtcaaagttttagataccccaggtcctccaaccaacattactgtgcaagatgtaaccaaaga

SEQ ID NO: 96581 - DNA, 286 bp, Homo sapiens
tttctgtagggcaactgggcaatacttagagaaactaagcgtgtcctacgagccacacattccactgctcagccttcactccaggggagctgtctactaggaacatgtggaaacacgtgccgggatgggtatacagtgttgcctgctgttgagaagagttggtggcagtccaggttcttcgcctaccatgaactttctataagtagaaacgtggtaaatgcttactacggaatactgcacatcagttagatcagctggatgaggccatgcacagaccttcaaagca

SEQ ID NO: 96582 - DNA, 603 bp, Homo sapiens
tgagctcagatctgacctgtttttctgagctgcagacttgtttatctaattgtctaattgacatccacttggatgtctgatagttatcccagatctaacattggccaaatcgctcttttttccccccaaatctcccttgatttctcctttaaaacccccttctcaaagctatgctcaaactaaaattcttaggagtcattctagatatttctttttgttcttaccccacttattccatcagttctgttctttctttaaaaaatagtctgaatcggccaggcgtggtctcacgcctgtaatcctagcactttgggaggccgaggcgggcggatcatgaggtcaggagtttgagaccagcctggccaatatggtgaaaccttgtctctactaataatacaaaaattaagctgggcgtggtggcacacgcctttagtcccagctacttgggagactgaggcagaagaaccgctggaacccaggaggtggaggttgtagtgagccaagatcgtgccactgcactccagcctgggtgacagagtgagactctgtctcaaaaaaacaaaactctgaatcggtcgaggggaaggggagggagagcactag

SEQ ID NO: 96583 - DNA, 478 bp, Homo sapiens
cctgacagggttgctgggagaactaaggatgctggggactgagcatggagcccggcacgtggcgcatactgttttatgggatggtgtctctgtggctggaggaaatgaggaggttctgggggtggtggctgctgggctctgcagcaggtctgactcagggggacgggaggagctgggacttcattcccaaggtcaaaggggaataaaggtgtctgaggaggaggtgtcatgttcaaagggacattttcagaagattaatcagcaagatgatataggatggactggtattggttgaaagagactggaaagtcagaccaaatgtaagagtaacggctggaccagcacgaggtgctaaagacacgttcaagggccctggccagcgaagcagggctgaagaggcacgtgtgagccgtaaccgccggggacatatgaacacccgtggacaggttgagcggagaacccagaacagcttggaggt

SEQ ID NO: 96584 - DNA, 561 bp, Homo sapiens
cagatctaccattcaacccagcatatgggtttatttcccaaaaggaaataaatccttctaccaaaaacacatatggtcatcacagtgctattcacagtagcaaagacagatcaacgtggctgcccatcaacagtggactggataaagaaaatgtggtacatataaatcatggagtattaggcagccataaaaagaacaaaatcatgtcctttgcagccagccacatggatgcagctggaagccataatctaagcaaattaagaacagaaaaccaagtactgcatgttctaacaaatgggagctaaatattgagtacctcaggatgcaaaggtgggaacaacagacactgcagactggaacactgtgggtgaggagggcagaaggataggttgaaaaactacctattgggtactatgctcactacctgggtgatgggatctgtacctcaaacctcagcatcacacaatatacccttgtaacaaacttgcacatttacccactgtttctaaatgaaaagttgaaatattttttattaaaaaacacaaaagcaatatgtttctc

SEQ ID NO: 96585 - DNA, 376 bp, Homo sapiens
catatcagcgaagagagctagtttgatttcttttcccagttggatgcagctggaagccataatctaagcaaattaagaacagaaaaccaagtactgcatgttctaacaaatgggagctaaatattgagtacctcaggatgcaaaggtgggaacaacagacactgcagactggaacactgtgggtgaggagggcagaaggataggttgaaaaactacctattgggtactatgctcactacctgggtgatgggatctgtacctcaaacctcagcatcacacaatatacccttgtaacaaacttgcacatttacccactgtttctaaatgaaaagttgaaatattttttattaaaaaacacaaaagcaatatgtttctc

SEQ ID NO: 96586 - DNA, 425 bp, Homo sapiens
ggcaggatctgtgggcttcaagctcttttttgttccctatgaattttagcaatagttttgtttctaattctgtgacaaatgacgttggtattttcaggattacattggatctgtaaattgctttgaacaatattgccattttagcaatatcgattcttccaaatccatgcttatggaaggattttccatttatttgtgtcatcttcgatttctttcagcagggctattgtgttctcattgtagagatttttcacctccttgcttagaagagttccataattaaattggaatgctctgtgcaggaaaatgctaccaaagaaatacatcatattcacgaacatggagaccttactatataacagcacatagggaaaccagtcttagtacaagcctgtgaactgagacaaggtaagtagctttgttct

SEQ ID NO: 96587 - DNA, 311 bp, Homo sapiens
catctaatacccagaattccccattccttctccctggtttccctaatgtagccagcatctggtcacatcaccacttacaaaagaggaagtgagaagctgatctaaagaatttccactaagcgagcaggtagcataaatgaatgaacacagtgagactttcccatgtgatccactcaagacacataggtttactatgtcttaccttgctatataaataatttaccaaataattatcttttctttccaaatgtactataaacacatatacaacagtgtgagcccaaacttttttttttttttttttttttaga

SEQ ID NO: 96588 - DNA, 353 bp, Homo sapiens
ccggccttgtcacccatttttctggtgaggaaacgggctgatcttcagcaagtttcctgtgtcccctttggtgccagcatccacctggtatttttgcccagccagactgcaagcttttgagcaagcagacctgaatgcccctccttctcagccttcaaggtctgcggtttgcctcacttcacctggccagcctaggacaccttcatgcccacagagccacagccctggtctacacccacctcctttgttctttactgcctctgcctcactaaccaggagcaccccaacaacctgccattcaggtacagaccccatggagatgccaccctggaactcaaacatctataagccca

SEQ ID NO: 96589 - DNA, 2641 bp, Homo sapiens
  misc_feature (103)..(103): n is a, c, g, or t
  misc_feature (108)..(108): n is a, c, g, or t
  misc_feature (111)..(111): n is a, c, g, or t
  misc_feature (113)..(113): n is a, c, g, or t
ggccggcggcggcggcggcggctccgctccgcactgcccggcgccgcctcgccatggacgcgcgcgggggcggcgggcggcccggggagagcccgggcgcganccccncgncngggccgccgccgccgccgccgcccgcgcccccccaaacagcagccgccgccgccgccgccgcccgcgccccccccgggccccgggcccgcgcccccccagcacccgccccgggccgaggcgttgcccccggaggcggcggatgagggcggcccgcggggccggctccgcagccgcgacagctcgtgcggccgccccggcaccccgggcgcggcgagcacggccaagggcagcccgaacggcgagtgcgggcgcggcgagccgcagtgcagccccgcggggcccgagggcccggcgcgggggcccaaggtgtcgttctcgtgccgcggggcggcctcggggcccgcgccggggccggggccggcggaggaggcgggcagcgaggaggcgggcccggcgggggagccgcgcggcagccaggccagcttcatgcagcgccagttcggcgcgctcctgcagccgggcgtcaacaagttctcgctgcggatgttcggcagccagaaggccgtggagcgcgagcaggagcgcgtcaagtcggcgggggcctggatcatccacccgtacagcgacttcaggttctactgggacttcaccatgctgctgttcatggtgggaaacctcatcatcatcccagtgggcatcaccttcttcaaggatgagaccactgccccgtggatcgtgttcaacgtggtctcggacaccttcttcctcatggacctggtgttgaacttccgcaccggcattgtgatcgaggacaacacggagatcatcctggaccccgagaagatcaagaagaagtatctgcgcacgtggttcgtggtggacttcgtgtcctccatccccgtggactacatcttccttatcgtggagaagggcattgactccgaggtctacaagacggcacgcgccctgcgcatcgtgcgcttcaccaagatcctcagcctcctgcggctgctgcgcctctcacgcctgatccgctacatccatcagtgggaggagatcttccacatgacctatgacctggccagcgcggtgatgaggatctgcaatctcatcagcatgatgctgctgctctgccactgggacggctgcctgcagttcctggtgcctatgctgcaggacttcccgcgcaactgctgggtgtccatcaatggcatggtgaaccactcgtggagtgaactgtactccttcgcactcttcaaggccatgagccacatgctgtgcatcgggtacggccggcaggcgcccgagagcatgacggacatctggctgaccatgctcagcatgattgtgggtgccacctgctacgccatgttcatcggccacgccactgccctcatccagtcgctggactcctcgcggcgccagtaccaggagaagtacaagcaggtggagcagtacatgtccttccacaagctgccagctgacttccgccagaagatccacgactactatgagcaccgttaccagggcaagatgtttgacgaggacagcatcctgggcgagctcaacgggcccctgcgggaggagatcgtcaacttcaactgccggaagctggtggcctccatgccgctgttcgccaacgccgaccccaacttcgtcacggccatgctgaccaagctcaagttcgaggtcttccagccgggtgactacatcatccgcgaaggcaccatcgggaagaagatgtacttcatccagcacggcgtggtcagcgtgctcactaagggcaacaaggagatgaagctgtccgatggctcctacttcggggagatctgcctgctcacccggggccgccgcacggcgagcgtgcgggctgacacctactgccgcctctattcgctgagcgtggacaacttcaacgaggtgctggaggagtaccccatgatgcggcgcgccttcgagacggtggccatcgaccgcctggaccgcatcggcaagaagaattccatcctcctgcacaaggtgcagcatgacctcaactcgggcgtattcaacaaccaggagaacgccatcatccaggagatcgtcaagtacgaccgcgagatggtgcagcaggccgagctgggtcagcgcgtgggcctcgcgtgcgagggggctcccttcacctcggtgcctcagttcccccagctgtaagacagggacggggcggcccagtggctgagaggagccggctgtggagccccgcccgccccccaccctctaggtggcccccgtccgaggaggatcgttttctaagtgcaatacttggcccgccggcttcccgctgcccccatcgcgctcacgcaataaccggcccggcccccgtccgcgcgcgtcccccggtgacctcggggagcagcaccccgcctccctccagcactggcaccgagaggcaggcctggctgcgcagggcgcgggggggaggctggggtcccgccgccgtgatgaatgtactgacgagccgaggcagcagtgcccccaccgtggccccccacgccccattaacccccacacccccattccgcgcaataaacgacagcattggcgccaa

SEQ ID NO: 96590 - DNA, 3409 bp, Homo sapiens
  misc_feature (103)..(103): n is a, c, g, or t
  misc_feature (108)..(108): n is a, c, g, or t
  misc_feature (111)..(111): n is a, c, g, or t
  misc_feature (113)..(113): n is a, c, g, or t
ggccggcggcggcggcggcggctccgctccgcactgcccggcgccgcctcgccatggacgcgcgcgggggcggcgggcggcccggggagagcccgggcgcganccccncgncngggccgccgccgccgccgccgcccgcgcccccccaaacagcagccgccgccgccgccgccgcccgcgccccccccgggccccgggcccgcgcccccccagcacccgccccgggccgaggcgttgcccccggaggcggcggatgagggcggcccgcggggccggctccgcagccgcgacagctcgtgcggccgccccggcaccccgggcgcggcgagcacggccaagggcagcccgaacggcgagtgcgggcgcggcgagccgcagtgcagccccgcggggcccgagggcccggcgcgggggcccaaggtgtcgttctcgtgccgcggggcggcctcggggcccgcgccggggccggggccggcggaggaggcgggcagcgaggaggcgggcccggcgggggagccgcgcggcagccaggccagcttcatgcagcgccagttcggcgcgctcctgcagccgggcgtcaacaagttctcgctgcggatgttcggcagccagaaggccgtggagcgcgagcaggagcgcgtcaagtcggcgggggcctggatcatccacccgtacagcgacttcaggttctactgggacttcaccatgctgctgttcatggtgggaaacctcatcatcatcccagtgggcatcaccttcttcaaggatgagaccactgccccgtggatcgtgttcaacgtggtctcggacaccttcttcctcatggacctggtgttgaacttccgcaccggcattgtgatcgaggacaacacggagatcatcctggaccccgagaagatcaagaagaagtatctgcgcacgtggttcgtggtggacttcgtgtcctccatccccgtggactacatcttccttatcgtggagaagggcattgactccgaggtctacaagacggcacgcgccctgcgcatcgtgcgcttcaccaagatcctcagcctcctgcggctgctgcgcctctcacgcctgatccgctacatccatcagtgggaggagatcttccacatgacctatgacctggccagcgcggtgatgaggatctgcaatctcatcagcatgatgctgctgctctgccactgggacggctgcctgcagttcctggtgcctatgctgcaggacttcccgcgcaactgctgggtgtccatcaatggcatggtgaaccactcgtggagtgaactgtactccttcgcactcttcaaggccatgagccacatgctgtgcatcgggtacggccggcaggcgcccgagagcatgacggacatctggctgaccatgctcagcatgattgtgggtgccacctgctacgccatgttcatcggccacgccactgccctcatccagtcgctggactcctcgcggcgccagtaccaggagaagtacaagcaggtggagcagtacatgtccttccacaagctgccagctgacttccgccagaagatccacgactactatgagcaccgttaccagggcaagatgtttgacgaggacagcatcctgggcgagctcaacgggcccctgcgggaggagatcgtcaacttcaactgccggaagctggtggcctccatgccgctgttcgccaacgccgaccccaacttcgtcacggccatgctgaccaagctcaagttcgaggtcttccagccgggtgactacatcatccgcgaaggcaccatcgggaagaagatgtacttcatccagcacggcgtggtcagcgtgctcactaagggcaacaaggagatgaagctgtccgatggctcctacttcggggagatctgcctgctcacccggggccgccgcacggcgagcgtgcgggctgacacctactgccgcctctattcgctgagcgtggacaacttcaacgaggtgctggaggagtaccccatgatgcggcgcgccttcgagacggtggccatcgaccgcctggaccgcatcggcaagaagaattccatcctcctgcacaaggtgcagcatgacctcaactcgggcgtattcaacaaccaggagaacgccatcatccaggagatcgtcaagtacgaccgcgagatggtgcagcaggccgagctgggtcagcgcgtgggcctcttcccgccgccgccgccgccgccgcaggtcacctcggccatcgccacgctgcagcaggcggcggccatgagcttctgcccgcaggtggcgcggccgctcgtggggccgctggcgctcggctcgccgcgcctcgtgcgccgcccgcccccggggcccgcacctgccgccgcctcacccgggcccccgccccccgccagccccccgggcgcgcccgccagcccccgggcaccgcggacctcgccctacggcggcctgcccgccgccccccttgctgggcccgccctgcccgcgcgccgcctgagccgcgcgtcgcgcccactgtccgcctcgcagccctcgctgcctcacggcgcccccggccccgcggcctccacacgcccggccagcagctccacaccgcgcttggggcccacgcccgctgcccgggccgccgcgcccagcccggaccgcagggactcggcctcacccggcgccgccggcggcctggacccccaggactccgcgcgctcgcgcctctcgtccaacttgtgaccctcgccgaccgccccgcgggcccaggcgggccgggggcggggccgtcatccagaccaaagccatgccattgcgctgccccggccgccagtccgcccagaagccatagacgagacgtaggtagccgtagttggacggacgggcagggccggcggggcagccccctccgcgcccccggccgtcccccctcatcgccccgcgcccacccccatcgcccctgcccccggcggcggcctcgcgtgcgagggggctcccttcacctcggtgcctcagttcccccagctgtaagacagggacggggcggcccagtggctgagaggagccggctgtggagccccgcccgccccccaccctctaggtggcccccgtccgaggaggatcgttttctaagtgcaatacttggcccgccggcttcccgctgcccccatcgcgctcacgcaataaccggcccggcccccgtccgcgcgcgtcccccggtgacctcggggagcagcaccccgcctccctccagcactggcaccgagaggcaggcctggctgcgcagggcgcgggggggaggctggggtcccgccgccgtgatgaatgtactgacgagccgaggcagcagtgcccccaccgtggccccccacgccccattaacccccacacccccattccgcgcaataaacgacagcattggcgccaa

SEQ ID NO: 96591 - DNA, 2716 bp, Homo sapiens
taagtatatgaaaagatgctcatatgtcatcagggaattacaaatttaaaacaatgacataccactacacacctattagatgggcccaaacccaaaagattgacaacattaaatactggcataaatatggagcaacaggaactctcattcattgatggtgggaatgcaaaatagtatagccactttggaagacagtttggcagtttcctaccaaagcaaacatacttttaccatgtgatccagccatcatgctccttggcatttacgtaaatgaaatgaaatcttatgtctacacaaaaacctgtacatagatatttacagcagatttattcataactgccaaaatttggaagcaaccaagatgctcttcagtaggtgaatggataaactgtgggtcatccagacaatggatattattcatcactaaaaagaaatgagctatcaaggcataaaaagacctaccagaaacttaaattgcatattattaagtgcaagaagcctatatgaaaagataacatactatatgatttcaactagataacattttagaaaaggcaaaactatggagacagtaaaaagatcactggttgccaggggtcagtgtggagggaaggatgaataggtagagcacaggggatattttgggcagtgaaactattccttatgatactacaatcatagatgcatgtcattatacatttgcccaaacccacagaatgcacaacacaaagaatgaaccataatgtgaactatggaatttgggttctaataatgtgtcagtgtaggttcttcgattgtaacaaaggtaacactctggtgggggatgttgacaatgggggaggctgtgcatgtgcggggacaggggtatatggaaactgtatactttctgctcaatttcattgtgaatctaaaactgctttgaaaaacaaagtctattaagtcagtcagttaatccttcactatttcaccatctccttcaccttacggtgaaatcaaagtaacaaacagggctgcaaggccctatgcaatctggcctccttccccattcctgcctccctccctcctgcttactttgctccagccatgctggcctccttgccagccagaatgccaggcacactgcacctctgggcctttgcacttgctgtgctctctcccaggaacattcttccctgagagagcctccctggttccctgccatcttccttcaggtctttattcaaatgtcaccttcttcgtgaggtcttccccatcactctaattaaaaatgcagctttagctgtgcacagtggctcacacctgtaatcccaaagtgctgggattacaggcgtgagccaccgtgcccagcccaaaagcccatttctaatcgtccaccttcccagatgcttcccaggtgcaccgtgacccctgtgtgctgtgtggtcttttgtagggagaaaggatcaatcaagaaagggaaacccctgctcccatggagcttgccttctggtggaataagaaaattagtaaacattaattaataaataggtacttctctatgcaagtttacagaaaaataaacaaatatgtacataagaaagaagatggttttggatagcgataagtgctggatgaaaatgaaaccaggtgataagccagcgatgactccactgagggaggttgtgagcgttacacaacatggtcagaaaagaccccgttggacccaagtcccagctggtaagaaagtgccagcttcatgacggtggggagaagcattccagtatcaccgttttaaaatatgagcatcctaaatattacacaaaccatacttacgctaaatatttgggatctacactaaaaatgtagtgtagtgtaaggatggggtttcaccatgtgggccaggctggtctcgagctcccaacctcaagctatccacccacctcagcctcccaaagtgctgggattataggcgtgagccactgcacccagccaatctgatgggttttttttttttttgagacggagtcttgctctgtcacccaggctggagtgcagtggcgcgatctccgctcactgcaagctccacctcccgggttcacgccattctcctgccacaggctcctgagtaaccccttttgcttggttctcattctctctcttggctgccaccatgcaagacctgcctttcgccttctgccatgattgggaggcctccccagccacatggaactgtgagtccattcaacttctttttctttgtaaattacccagtctcgggtatggctttatcagcagcatgaaaacagacaaatatactgttgtttcttattaaatgttattggcttattttgaaaacaaaagcttaccaaatacatgtgattatgggaaggggccagaaagttacactgcaagtaaaaatatcagtaactatgtttactgggtggcgatggcaaaaacaatagtttttcctttttttttttttggagacaggatcttgctctgtcgcccaggctacagtgcagtggtgcaatcacagcccactgcagcctcgacctccggagctcaattgatcctcccacctcagcctcctgagtagctgcatctacagatgtgagccaccaaaaaaaaaaaaaaattatttttgacagtgcaagactctgtctcaaaaacaaacaatatccttttctatgtagaaaacccaaaataataaacaaaaaaaaactttcaaaaaaaaaaa

SEQ ID NO: 96592 - DNA, 1995 bp, Homo sapiens
taagtatatgaaaagatgctcatatgtcatcagggaattacaaatttaaaacaatgacataccactacacacctattagatgggcccaaacccaaaagattgacaacattaaatactggcataaatatggagcaacaggaactctcattcattgatggtgggaatgcaaaatagtatagccactttggaagacagtttggcagtttcctaccaaagcaaacatacttttaccatgtgatccagccatcatgctccttggcatttacgtaaatgaaatgaaatcttatgtctacacaaaaacctgtacatagatatttacagcagatttattcataactgccaaaatttggaagcaaccaagatgctcttcagtaggtgaatggataaactgtgggtcatccagacaatggatattattcatcactaaaaagaaatgagctatcaaggcataaaaagacctaccagaaacttaaattgcatattattaagtgcaagaagcctatatgaaaagataacatactatatgatttcaactagataacattttagaaaaggcaaaactatggagacagtaaaaagatcactggttgccaggggtcagtgtggagggaaggatgaataggtagagcacaggggatattttgggcagtgaaactattccttatgatactacaatcatagatgcatgtcattatacatttgcccaaacccacagaatgcacaacacaaagaatgaaccataatgtgaactatggaatttgggttctaataatgtgtcagtgtaggttcttcgattgtaacaaaggtaacactctggtgggggatgttgacaatgggggaggctgtgcatgtgcggggacaggggtatatggaaactgtatactttctgctcaatttcattgtgaatctaaaactgctttgaaaaacaaagtctattaagtcagtcagttaatccttcactatttcaccatctccttcaccttacggtgaaatcaaagtaacaaacagggctgcaaggccctatgcaatctggcctccttccccattcctgcctccctccctcctgcttactttgctccagccatgctggcctccttgccagccagaatgccaggcacactgcacctctgggcctttgcacttgctgtgctctctcccaggaacattcttccctgagagagcctccctggttccctgccatcttccttcaggtctttattcaaatgtcaccttcttcgtgaggtcttccccatcactctaattaaaaatgcagctttagctgtgcacagtggctcacacctgtaatcccaaagtgctgggattacaggcgtgagccaccgtgcccagcccaaaagcccatttctaatcgtccaccttcccagatgcttcccaggtgcaccgtgacccctgtgtgctgtgtggtcttttgtagggagaaaggatcaatcaagaaagggaaacccctgctcccatggagcttgccttctggtggaataagaaaattagtaaacattaattaataaataggtacttctctatgcaagtttacagaaaaataaacaaatatgtacataagaaagaagatggttttggatagcgataagtgctggatgaaaatgaaaccaggtgataagccagcgatgactccactgagggaggttgtgagcgttacacaacatggtcagaaaagaccccgttggacccaagtcccagctggtaagaaagtgccagcttcatgacggtggggagaagcattccagtatcaccgttttaaaatatgagcatcctaaatattacacaaaccatacttacgctaaatatttgggatctacactaaaaatgtagtgtagtgtaaggatggggtttcaccatgtgggccaggctggtctcgagctcccaacctcaagctatccacccacctcagcctcccaaagtgctgggattataggcgtgagccactgcacccagcctgggtgacagaatgagacccctgac

SEQ ID NO: 96593 - DNA, 2457 bp, Homo sapiens
taagtatatgaaaagatgctcatatgtcatcagggaattacaaatttaaaacaatgacataccactacacacctattagatgggcccaaacccaaaagattgacaacattaaatactggcataaatatggagcaacaggaactctcattcattgatggtgggaatgcaaaatagtatagccactttggaagacagtttggcagtttcctaccaaagcaaacatacttttaccatgtgatccagccatcatgctccttggcatttacgtaaatgaaatgaaatcttatgtctacacaaaaacctgtacatagatatttacagcagatttattcataactgccaaaatttggaagcaaccaagatgctcttcagtaggtgaatggataaactgtgggtcatccagacaatggatattattcatcactaaaaagaaatgagctatcaaggcataaaaagacctaccagaaacttaaattgcatattattaagtgcaagaagcctatatgaaaagataacatactatatgatttcaactagataacattttagaaaaggcaaaactatggagacagtaaaaagatcactggttgccaggggtcagtgtggagggaaggatgaataggtagagcacaggggatattttgggcagtgaaactattccttatgatactacaatcatagatgcatgtcattatacatttgcccaaacccacagaatgcacaacacaaagaatgaaccataatgtgaactatggaatttgggttctaataatgtgtcagtgtaggttcttcgattgtaacaaaggtaacactctggtgggggatgttgacaatgggggaggctgtgcatgtgcggggacaggggtatatggaaactgtatactttctgctcaatttcattgtgaatctaaaactgctttgaaaaacaaagtctattaagtcagtcagttaatccttcactatttcaccatctccttcaccttacggtgaaatcaaagtaacaaacagggctgcaaggccctatgcaatctggcctccttccccattcctgcctccctccctcctgcttactttgctccagccatgctggcctccttgccagccagaatgccaggcacactgcacctctgggcctttgcacttgctgtgctctctcccaggaacattcttccctgagagagcctccctggttccctgccatcttccttcaggtctttattcaaatgtcaccttcttcgtgaggtcttccccatcactctaattaaaaatgcagctttagctgtgcacagtggctcacacctgtaatcccaaagtgctgggattacaggcgtgagccaccgtgcccagcccaaaagcccatttctaatcgtccaccttcccagatgcttcccaggtgcaccgtgacccctgtgtgctgtgtggtcttttgtagggagaaaggatcaatcaagaaagggaaacccctgctcccatggagcttgccttctggtggaataagaaaattagtaaacattaattaataaataggtacttctctatgcaagtttacagaaaaataaacaaatatgtacataagaaagaagatggttttggatagcgataagtgctggatgaaaatgaaaccaggtgataagccagcgatgactccactgagggaggttgtgagcgttacacaacatggtcagaaaagaccccgttggacccaagtcccagctggtaagaaagtgccagcttcatgacggtggggagaagcattccagtatcaccgttttaaaatatgagcatcctaaatattacacaaaccatacttacgctaaatatttgggatctacactaaaaatgtagtgtagtgtaaggatggggtttcaccatgtgggccaggctggtctcgagctcccaacctcaagctatccacccacctcagcctcccaaagtgctgggattataggcgtgagccactgcacccagccaatctgatgggttttttttttttttgagacggagtcttgctctgtcacccaggctggagtgcagtggcgcgatctccgctcactgcaagctccacctcccgggttcacgccattctcctgccacaggctcctgagtaaccccttttgcttggttctcattctctctcttggctgccaccatgcaagacctgcctttcgccttctgccatgattgggaggcctccccagccacatggaactgatcttgctctgtcgcccaggctacagtgcagtggtgcaatcacagcccactgcagcctcgacctccggagctcaattgatcctcccacctcagcctcctgagtagctgcatctacagatgtgagccaccaaaaaaaaaaaaaaattatttttgacagtgcaagactctgtctcaaaaacaaacaatatccttttctatgtagaaaacccaaaataataaacaaaaaaaaactttcaaaaaaaaaaa

SEQ ID NO: 96594 - DNA, 421 bp, Homo sapiens
ttgatcctcccacctcagcctcctgagtagctgcatctacagatgtgagccaccaaaaaaaaaaaaaaattatttttgacacaggatctagcactgttgcccaggctgaagtgcatctgggctcactgcaagcttctcctgagctcaaaccaccctctcaccttagcctcccaagtagctgggactagagcctcactccaccacgcccggccttgtttttcctttgtgaacatcgttctacaatgctgtgggtacatcgctttttcaatatgaagttttctttggaagtttataaatccagtttgggccttggaggaaagcagtcagtgatagaaattttgtgactctgagtgagtttggtggagcttcgagttgtagattgtttcccagggaccgctgcagacacaaagccctgactgca

SEQ ID NO: 96595 - DNA, 748 bp, Homo sapiens
taaaagagaagacagttatttaaggaggtttgagattcaagggcttttttaattttaaaattaaccatggtagaaacctgtgtgttaatatgctgagggaagttgccaatagtgagatgaaagatctaggcaaggggatagcaaggtgactgcaccagatacctggatctgggcaggaataaacctcaacagtgatcatgttgaccttgagtgacagggtataatgtttgggaaggtgctttgtaaactataaggggcaatacaaacatgtagtacaccttctctgagatccgggaaaggacaacctgagcataggttggggctggtcataggccactctcccctactgtttctctagagtgtgtgtagtccctagcaagtctcagatgcctcgagtcgtggatggaaacaaggtcccaggaccattgtcctgagcctcctttctccgtgctctacctggggaatgcttgactatcaacccacagaagctctctctggagcctcactgcctaaagagcttcttgtcgtaattgtaacctgtcatggttaaccccttgcaagcatgccctgccccttgtctctcccaagctttggctgctgcagcttctttccacaaaatcccagcagatagccgggcgtcgtggtgcgtgtctgtaatcccagctactcgggaggctgaggcatgagaatcgcttgaacccaggaggtggaggttgcagtgatattgcgccactgcactccagcagcc

SEQ ID NO: 96596 - DNA, 356 bp, Homo sapiens
ggagggtgtctgtgcacgcatgtgcacacttaaatgcatgtgtgtgcataacccactgtaaccattgtgaggattattatctaactgtagactgctcccctttaggagctttttcatcatgttggggacagagacaggaagatgggaggctgatcttgatagcgtgaggccctgccctcaggactgtgattctagcagaggcatggtgggatcttagggctcgtatgtgcaaagaaaggctgtgcgaaactcaaaagctggggcttctctttacggtgcctcgatctcttaaaaggccccttctacccaccttgctcctattggttaatttctcagctacacagaaaagtctagtg

SEQ ID NO: 96597 - DNA, 770 bp, Homo sapiens
agccgccggggaaggagacgctgcccttccgcagcgatggcatcccggctctgtggaggggccctctggtatgtgtgtccctgtccttctggggcgtggatggtgcctgggacccagctggcaaccagttgaagacgttctccttggaagctcttggccctgaggactttgcctggggcattggccctgccatggcgttccggagggccgagggcacgtctatgatccaggccctggccatgacggtggccgagatccccgtgttcctgtacacgacgtttgggcagtctgcattctcccagctacggttgacgccaggcctgcggaaagtcctctttgccacggccctggggactgtggccctggccctggctgcccaccagctgaagaggcgacggaggaggaagaagcaggttggtcccgagatgggaggggagcagctgggcacggtgcccctccctatcctcttggccaggaaggtcccttcagtgaagaaagatggagtctcgctctgttgccaggctggagtgcagtggcgcaatcttggctcactgcaaccttcacctgccaggttcaagcgattctcctgcctcagcctcctgcgtagctgggattataggataatccaaccggagagtcagagccccagcagaagagcagaaacctgagtgggatctcttccattgagcccagaagcaatcgggtctccacagtgtggctccatgatggggggaatatccagcccaaacgcgtgctcggactatggatgc

SEQ ID NO: 96598 - DNA, 1665 bp, Homo sapiens
atctagaggatcctcccagaggcacaaggaggcagaggcacatggggggtggcagagagaaggctcctcctcccttccctgggttggtatctgacagctgtggtggctgagggccgttgcccctgactttgccccacccccatcatctgggagtccccaaggcccagaggggacatttccatggagaagaacggttcctgggggaagcagaggccaggaccagtggggcctgtgggagagaaaggctgtgagagagggggttgttgtggagaattgggacaggcagagccaggatgccccaggtgggggaccccaaaacctcccatcgctccagggctgctgacaagggtgctgggagggtggaggtgaaggatggggcctagagccctgtggtgaaggtcacagtgtcctgagctagaagccacctgtggctatatggtctcagcatccagctggcctgtcctgatgccctccccacctcaaccgccttctcagagagtttgcaactccagagaaggagagtggggccaccttagtgggcagcaggcctgggccatccagagatggggcagaggtgggcctcccactcctgtgctctcttctgagcaggaactgggcccttgacagtgtcctttgacattccctcgccctaccaaagatcgtcttttctcctcccacctctgtcaccaccaaagacgggcggaggtggggctgggccctcctgcccccgcccatcccccttccatgagcccagacctccctgggtggtgctaggctctgagctgggggctcagaccagggatcgctcaggcccctgtcacctgtgggcccggggaccacttgggggaggtcagaggatgtatgtggccggaccagcttccccaccttcattaggacaagaaactgcccagcactttgccttcagttcaacgcacaaacgctcctggggcctcatgggggcagagcctcccctgggcctgcagagagtcctgttagcagcgacgtccccccgccgcggggtcctgtcagcccggcagtgtcttctcagtgtcttcacctgagcgagtgtctgtggccccaacgcgttctgctgtggctctgccctttccaggttgagaggcctgcaggagaaacacactcccctcctgggtttccacactcaggaggtcagaggactggctcctgtgaccagggcccctctcccctgaatgggaaaggggtctggggatgggagggcgcaccacagagaggagatgatgctgggtgtggcccatcttctgtgggccccttcccagacaccggatccatgggcactaacccgcctcccaggctgatgcccggaggcagcttcctgggcaggagggttccatgggcactaacccacctcccaggctgatgcctggaggcagcctccagggcaggaaggaccctgtgctccccgccccccatcctgacatcctgttcttttgcacttaccctgtgctgtgaatgtaacagtgggccttggccccgcccactctgatttgcattttcatttgtgtttgtttacacatccatgcactgcctgtagcagtcgattgtcacagcttcgacttttggatggtagagtgtgtgcactgactgtgagtcgaataaacaattgagacgatttccttccaaaagcca

SEQ ID NO: 96599 - DNA, 2537 bp, Homo sapiens
ggagcaggcgtgcgggccgtgagcggcgccagagggtacctggctctgtggaggggccctctggtatgtgtgtccctgtccttctggggcgtggatggtgcctgggacccagctggcaaccagttgaagacgttctccttggaagctcttggccctgaggactttgcctggggcattggccctgccatggcgttccggagggccgagggcacgtctatgatccaggccctggccatgacggtggccgagatccccgtgttcctgtacacgacgtttgggcagtctgcattctcccagctacggttgacgccaggcctgcggaaagtcctctttgccacggccctggggactgtggccctggccctggctgcccaccagctgaagaggcgacggaggaggaagaagcaggttggtcccgagatgggaggggagcagctgggcacggtgcccctccctatcctcttggccaggaaggtcccttcagtgaagaaaggatactccagccggagagtccagagccccagcagcaagagcaacgacaccctgagtggcatctcttccattgagcccagcaagcactcgggctcctcccacagtgtggcctcgatgatggcagtgaactcatccagccccacagccgcgtgctcgggactatgggatgccagagggatggaggagtctctgaccaccagcgacggcaatgcagagagcctgtacatgcaaggcatggagctgtttgaggaagctctgcagaagtgggagcaggcactaagcgtgggccagcggggggacagcggcagcacccccatgcccagggacggcctccggaacccagagactgcatcagagccactgtctgagccagagtcacagcggaaggagtttgcagagaagctggagtccctgctgcaccgtgcctaccacctgcaggaggagttcggctccaccttccccgcagacagcatgctgctagacctcgagaggaccctcatgctgcccctgaccgagggctcgctgcggctgcgggcggacgatgaggacagcctgacttcagaggattccttcttctccgccaccgagctctttgagtccctgcagactggagattacccgatcccactctccagacccgccgctgcctatgaggaggccctgcagctggtgaaggaggggagagtgccttgccggaccctcaggacggagctgctgggctgctacagtgaccaggactttctggccaagctgcactgtgtgcggcaggccttcgaggggcttctggaagacaagagtaaccagcttttcttcgggaaagtgggccgacagatggtgacaggcctgatgaccaaggctgagaagagccccaaaggcttcctggagagctacgaggagatgctgagctatgccctgcggcccgagacctgggccacaacacggctggagctggagggccgaggggtggtatgcatgagcttcttcgacatcgtgctggacttcatcctcatggacgccttcgaggacctggagaaccctccggcctcggtgctcgccgtcctgcggaaccgctggctgtcagacagcttcaaggagacggccttggccactgcttgctggtcggtcctgaaagccaagaggaggctgctgatggtgcctgatggcttcatctcccatttctactccgtatcggagcatgtgagccctgtcctagccttcggcttccttggacccaagcctcagcttgctgaagtctgtgctttcttcaagcaccagattgtgcagtacctgagggacatgttcgacctggacaatgtgcgctacacgtcactgcccgcgctggcagacgacatcctgcagctgtcccggcgccgcagcgagatattgctggggtacctgggggtgcccgcggccagcagcgcaggcgtgaatggggcgctgccccgagagaatgggcccctgggggagctgcagtagaggcggcacgggctggggggtggcagagagaaggctcctcctcccttccctgggtttccacactcaggaggtcagaggactggctcctgtgaccagggcccctctcccctgaatgggaaaggggtctggggatgggagggcgcaccacagagaggagatgatgctgggtgtggcccatcttctgtgggccccttcccagacaccggatccatgggcactaacccgcctcccaggctgatgcccggaggcagcttcctgggcaggagggttccatgggcactaacccacctcccaggctgatgcctggaggcagcctccagggcaggaaggaccctgtgctccccgccccccatcctgacatcctgttcttttgcacttaccctgtgctgtgaatgtaacagtgggccttggccccgcccactctgatttgcattttcatttgtgtttgtttacacatccatgcactgcctgtagcagtcgattgtcacagcttcgacttttggatggtagagtgtgtgcactgactgtgagtcgaataaacaattgagacgatttccttccaaaagcca

SEQ ID NO: 96600 - DNA, 2328 bp, Homo sapiens
ggagcaggcgtgcgggccgtgagcggcgccagagggtacctggctctgtggaggggccctctggtatgtgtgtccctgtccttctggggcgtggatggtgcctgggacccagctggcaaccagttgaagacgttctccttggaagctcttggccctgaggactttgcctggggcattggccctgccatggcgttccggagggccgagggcacgtctatgatccaggccctggccatgacggtggccgagatccccgtgttcctgtacacgacgtttgggcagtctgcattctcccagctacggttgacgccaggcctgcggaaagtcctctttgccacggccctggggactgtggccctggccctggctgcccaccagctgaagaggcgacggaggaggaagaagcaggttggtcccgagatgggaggggagcagctgggcacggtgcccctccctatcctcttggccaggaaggtcccttcagtgaagaaaggatactccagccggagagtccagagccccagcagcaagagcaacgacaccctgagtggcatctcttccattgagcccagcaagcactcgggctcctcccacagtgtggcctcgatgatggcagtgaactcatccagccccacagccgcgtgctcgggactatgggatgccagagggatggaggagtctctgaccaccagcgacggcaatgcagagagcctgtacatgcaaggcatggagctgtttgaggaagctctgcagaagtgggagcaggcactaagcgtgggccagcggggggacagcggcagcacccccatgcccagggacggcctccggaacccagagactgcatcagagccactgtctgagccagagtcacagcggaaggagtttgcagagaagctggagtccctgctgcaccgtgcctaccacctgcaggaggagttcggctccaccttccccgcagacagcatgctgctagacctcgagaggaccctcatgctgcccctgaccgagggctcgctgcggctgcgggcggacgatgaggacagcctgacttcagaggattccttcttctccgccaccgagctctttgagtccctgcagactggagattacccgatcccactctccagacccgccgctgcctatgaggaggccctgcagctggtgaaggaggggagagtgccttgccggaccctcaggacggagctgctgggctgctacagtgaccaggactttctggccaagctgcactgtgtgcggcaggccttcgaggggcttctggaagacaagagtaaccagcttttcttcgggaaagtgggccgacagatggtgacaggcctgatgaccaaggctgagaagagccccaaaggcttcctggagagctacgaggagatgctgagctatgccctgcggcccgagacctgggccacaacacggctggagctggagggccgaggggtggtatgcatgagcttcttcgacatcgtgctggacttcatcctcatggacgccttcgaggacctggagaaccctccggcctcggtgctcgccgtcctgcggaaccgctggctgtcagacagcttcaaggagacggccttggccactgcttgctggtcggtcctgaaagccaagaggaggctgctgatggtgcctgatggcttcatctcccatttctactccgtatcggagcatgtgagccctgtcctagccttcggcttccttggacccaagcctcagcttgctgaagtctgtgctttcttcaagcaccagattgtgcagtacctgagggacatgttcgacctggacaatgtgcgctacacgtcactgcccgcgctggcagacgacatcctgcagctgtcccggcgccgcagcgagatattgctggggtacctgggggtgcccgcggccagcagcgcaggcgtgaatggggcgctgccccgagagaatgggccccttcccagacaccggatccatgggcactaacccgcctcccaggctgatgcccggaggcagcttcctgggcaggagggttccatgggcactaacccacctcccaggctgatgcctggaggcagcctccagggcaggaaggaccctgtgctccccgccccccatcctgacatcctgttcttttgcacttaccctgtgctgtgaatgtaacagtgggccttggccccgcccactctgatttgcattttcatttgtgtttgtttacacatccatgcactgcctgtagcagtcgattgtcacagcttcgacttttggatggtagagtgtgtgcactgactgtgagtcgaataaacaattgagacgatttccttccaaaagcca

SEQ ID NO: 96601 - DNA, 1940 bp, Homo sapiens
ggagcaggcgtgcgggccgtgagcggcgccagagggtacctggctctgtggaggggccctctggtatgtgtgtccctgtccttctggggcgtggatggtgcctgggacccagctggcaaccagttgaagacgttctccttggaagctcttggccctgaggactttgcctggggcattggccctgccatggcgttccggagggccgagggcacgtctatgatccaggccctggccatgacggtggccgagatccccgtgttcctgtacacgacgtttgggcagtctgcattctcccagctacggttgacgccaggcctgcggaaagtcctctttgccacggccctggggactgtggccctggccctggctgcccaccagctgaagaggcgacggaggaggaagaagcaggttggtcccgagatgggaggggagcagctgggcacggtgcccctccctatcctcttggccaggaaggtcccttcagtgaagaaaggatactccagccggagagtccagagccccagcagcaagagcaacgacaccctgagtggcatctcttccattgagcccagcaagcactcgggctcctcccacagtgtggcctcgatgatggcagtgaactcatccagccccacagccgcgtgctcgggactatgggatgccagagggatggaggagtctctgaccaccagcgacggcaatgcagagagcctgtacatgcaaggcatggagctgtttgaggaagctctgcagaagtgggagcaggcactaagcgtgggccagcggggggacagcggcagcacccccatgcccagggacggcctccggaacccagagactgcatcagagccactgtctgagccagagtcacagcggaaggagtttgcagagaagctggagtccctgctgcaccgtgcctaccacctgcaggaggagttcggctccaccttccccgcagacagcatgctgctagacctcgagaggaccctcatgctgcccctgaccgagggctcgctgcggctgcgggcggacgatgaggacagcctgacttcagaggattccttcttctccgccaccgagctctttgagtccctgcagactggagattacccgatcccactctccagacccgccgctgcctatgaggaggccctgcagctggtgaaggaggggagagtgccttgccggaccctcaggacggagctgctgggctgctacagtgaccaggactttctggccaagctgcactgtgtgcggcaggccttcgaggggcttctggaagacaagagtaaccagcttttcttcgggaaagtgggccgacagatggtgacaggcctgatgaccaaggctgagaagagccccaaaggcttcctggagagctacgaggagatgctgagctatgccctgcggcccgagacctgggccacaacacggctggagctggagggccgaggggtggtatgcatgagcttcttcgacatcgtgctggacttcatcctcatggacgccttcgaggacctggagaaccctccggcctcggtgctcgccgtcctgcggaaccgctggctgtcagacagcttcaaggagacggtgggtcactgccctgctctcagacccacacttgctcacatcagcccgtgtggttgcctggctccgtcccctctgtccctagcactggcaccagggctgggcccccaccccctagatccgcggctgccaggcctgggagaccagagtctgccctggagaagcctccagggtgccccgttgctgcctggtgccccagtttagaaccaacatggtgtgcgctttcttcctattgtgtggttttacttttgtgctggtatgaattcgattccattttaatgcatcctgttaaatcaagttaaaagaggggaaagcaaaaccaaaaggaaaaaaaggcacagagtgagagacaa

SEQ ID NO: 96602 - DNA, 3604 bp, Homo sapiens
ggagcaggcgtgcgggccgtgagcggcgccagagggtacctggctctgtggaggggccctctggtatgtgtgtccctgtccttctggggcgtggatggtgcctgggacccagctggcaaccagttgaagacgttctccttggaagctcttggccctgaggactttgcctggggcattggccctgccatggcgttccggagggccgagggcacgtctatgatccaggccctggccatgacggtggccgagatccccgtgttcctgtacacgacgtttgggcagtctgcattctcccagctacggttgacgccaggcctgcggaaagtcctctttgccacggccctggggactgtggccctggccctggctgcccaccagctgaagaggcgacggaggaggaagaagcaggttggtcccgagatgggaggggagcagctgggcacggtgcccctccctatcctcttggccaggaaggtcccttcagtgaagaaaggatactccagccggagagtccagagccccagcagcaagagcaacgacaccctgagtggcatctcttccattgagcccagcaagcactcgggctcctcccacagtgtggcctcgatgatggcagtgaactcatccagccccacagccgcgtgctcgggactatgggatgccagagggatggaggagtctctgaccaccagcgacggcaatgcagagagcctgtacatgcaaggcatggagctgtttgaggaagctctgcagaagtgggagcaggcactaagcgtgggccagcggggggacagcggcagcacccccatgcccagggacggcctccggaacccagagactgcatcagagccactgtctgagccagagtcacagcggaaggagtttgcagagaagctggagtccctgctgcaccgtgcctaccacctgcaggaggagttcggctccaccttccccgcagacagcatgctgctagacctcgagaggaccctcatgctgcccctgaccgagggctcgctgcggctgcgggcggacgatgaggacagcctgacttcagaggattccttcttctccgccaccgagctctttgagtccctgcagactggagattacccgatcccactctccagacccgccgctgcctatgaggaggccctgcagctggtgaaggaggggagagtgccttgccggaccctcaggacggagctgctgggctgctacagtgaccaggactttctggccaagctgcactgtgtgcggcaggccttcgaggggcttctggaagacaagagtaaccagcttttcttcgggaaagtgggccgacagatggtgacaggcctgatgaccaaggctgagaagagccccaaaggcttcctggagagctacgaggagatgctgagctatgccctgcggcccgagacctgggccacaacacggctggagctggagggccgaggggtggtatgcatgagcttcttcgacatcgtgctggacttcatcctcatggacgccttcgaggacctggagaaccctccggcctcggtgctcgccgtcctgcggaaccgctggctgtcagacagcttcaaggagacggccttggccactgcttgctggtcggtcctgaaagccaagaggaggctgctgatggtgcctgatggcttcatctcccatttctactccgtatcggagcatgtgagccctgtcctagccttcggcttccttggacccaagcctcagcttgctgaagtctgtgctttcttcaagcaccagattgtgcagtacctgagggacatgttcgacctggacaatgtgcgctacacgtcactgcccgcgctggcagacgacatcctgcagctgtcccggcgccgcagcgagatattgctggggtacctgggggtgcccgcggccagcagcgcaggcgtgaatggggcgctgccccgagagaatgggcccctgggggagctgcagtagaggcggcacgggctggggggtggcagagagaaggctcctcctcccttccctgggttggtatctgacagctgtggtggctgagggccgttgcccctgactttgccccacccccatcatctgggagtccccaaggcccagaggggacatttccatggagaagaacggttcctgggggaagcagaggccaggaccagtggggcctgtgggagagaaaggctgtgagagagggggttgttgtggagaattgggacaggcagagccaggatgccccaggtgggggaccccaaaacctcccatcgctccagggctgctgacaagggtgctgggagggtggaggtgaaggatggggcctagagccctgtggtgaaggtcacagtgtcctgagctagaagccacctgtggctatatggtctcagcatccagctggcctgtcctgatgccctccccacctcaaccgccttctcagagagtttgcaactccagagaaggagagtggggccaccttagtgggcagcaggcctgggccatccagagatggggcagaggtgggcctcccactcctgtgctctcttctgagcaggaactgggcccttgacagtgtcctttgacattccctcgccctaccaaagatcgtcttttctcctcccacctctgtcaccaccaaagacgggcggaggtggggctgggccctcctgcccccgcccatcccccttccatgagcccagacctccctgggtggtgctaggctctgagctgggggctcagaccagggatcgctcaggcccctgtcacctgtgggcccggggaccacttgggggaggtcagaggatgtatgtggccggaccagcttccccaccttcattaggacaagaaactgcccagcactttgccttcagttcaacgcacaaacgctcctggggcctcatgggggcagagcctcccctgggcctgcagagagtcctgttagcagcgacgtccccccgccgcggggtcctgtcagcccggcagtgtcttctcagtgtcttcacctgagcgagtgtctgtggccccaacgcgttctgctgtggctctgccctttccaggttgagaggcctgcaggagaaacacactcccctcctgggtttccacactcaggaggtcagaggactggctcctgtgaccagggcccctctcccctgaatgggaaaggggtctggggatgggagggcgcaccacagagaggagatgatgctgggtgtggcccatcttctgtgggccccttcccagacaccggatccatgggcactaacccgcctcccaggctgatgcccggaggcagcttcctgggcaggagggttccatgggcactaacccacctcccaggctgatgcctggaggcagcctccagggcaggaaggaccctgtgctccccgccccccatcctgacatcctgttcttttgcacttaccctgtgctgtgaatgtaacagtgggccttggccccgcccactctgatttgcattttcatttgtgtttgtttacacatccatgcactgcctgtagcagtcgattgtcacagcttcgacttttggatggtagagtgtgtgcactgactgtgagtcgaataaacaattgagacgatttccttccaaaagcca

SEQ ID NO: 96603 - DNA, 3628 bp, Homo sapiens
gctggtaccggtccgaggagttatgatgggaaggagacgctgccttcctgtagcgatggcatcccggctctgtggaggggccctctggtatgtgtgtccctgtccttctggggcgtggatggtgcctgggacccagctggcaaccagttgaagacgttctccttggaagctcttggccctgaggactttgcctggggcattggccctgccatggcgttccggagggccgagggcacgtctatgatccaggccctggccatgacggtggccgagatccccgtgttcctgtacacgacgtttgggcagtctgcattctcccagctacggttgacgccaggcctgcggaaagtcctctttgccacggccctggggactgtggccctggccctggctgcccaccagctgaagaggcgacggaggaggaagaagcaggttggtcccgagatgggaggggagcagctgggcacggtgcccctccctatcctcttggccaggaaggtcccttcagtgaagaaaggatactccagccggagagtccagagccccagcagcaagagcaacgacaccctgagtggcatctcttccattgagcccagcaagcactcgggctcctcccacagtgtggcctcgatgatggcagtgaactcatccagccccacagccgcgtgctcgggactatgggatgccagagggatggaggagtctctgaccaccagcgacggcaatgcagagagcctgtacatgcaaggcatggagctgtttgaggaagctctgcagaagtgggagcaggcactaagcgtgggccagcggggggacagcggcagcacccccatgcccagggacggcctccggaacccagagactgcatcagagccactgtctgagccagagtcacagcggaaggagtttgcagagaagctggagtccctgctgcaccgtgcctaccacctgcaggaggagttcggctccaccttccccgcagacagcatgctgctagacctcgagaggaccctcatgctgcccctgaccgagggctcgctgcggctgcgggcggacgatgaggacagcctgacttcagaggattccttcttctccgccaccgagctctttgagtccctgcagactggagattacccgatcccactctccagacccgccgctgcctatgaggaggccctgcagctggtgaaggaggggagagtgccttgccggaccctcaggacggagctgctgggctgctacagtgaccaggactttctggccaagctgcactgtgtgcggcaggccttcgaggggcttctggaagacaagagtaaccagcttttcttcgggaaagtgggccgacagatggtgacaggcctgatgaccaaggctgagaagagccccaaaggcttcctggagagctacgaggagatgctgagctatgccctgcggcccgagacctgggccacaacacggctggagctggagggccgaggggtggtatgcatgagcttcttcgacatcgtgctggacttcatcctcatggacgccttcgaggacctggagaaccctccggcctcggtgctcgccgtcctgcggaaccgctggctgtcagacagcttcaaggagacggccttggccactgcttgctggtcggtcctgaaagccaagaggaggctgctgatggtgcctgatggcttcatctcccatttctactccgtatcggagcatgtgagccctgtcctagccttcggcttccttggacccaagcctcagcttgctgaagtctgtgctttcttcaagcaccagattgtgcagtacctgagggacatgttcgacctggacaatgtgcgctacacgtcactgcccgcgctggcagacgacatcctgcagctgtcccggcgccgcagcgagatattgctggggtacctgggggtgcccgcggccagcagcgcaggcgtgaatggggcgctgccccgagagaatgggcccctgggggagctgcagtagaggcggcacgggctggggggtggcagagagaaggctcctcctcccttccctgggttggtatctgacagctgtggtggctgagggccgttgcccctgactttgccccacccccatcatctgggagtccccaaggcccagaggggacatttccatggagaagaacggttcctgggggaagcagaggccaggaccagtggggcctgtgggagagaaaggctgtgagagagggggttgttgtggagaattgggacaggcagagccaggatgccccaggtgggggaccccaaaacctcccatcgctccagggctgctgacaagggtgctgggagggtggaggtgaaggatggggcctagagccctgtggtgaaggtcacagtgtcctgagctagaagccacctgtggctatatggtctcagcatccagctggcctgtcctgatgccctccccacctcaaccgccttctcagagagtttgcaactccagagaaggagagtggggccaccttagtgggcagcaggcctgggccatccagagatggggcagaggtgggcctcccactcctgtgctctcttctgagcaggaactgggcccttgacagtgtcctttgacattccctcgccctaccaaagatcgtcttttctcctcccacctctgtcaccaccaaagacgggcggaggtggggctgggccctcctgcccccgcccatcccccttccatgagcccagacctccctgggtggtgctaggctctgagctgggggctcagaccagggatcgctcaggcccctgtcacctgtgggcccggggaccacttgggggaggtcagaggatgtatgtggccggaccagcttccccaccttcattaggacaagaaactgcccagcactttgccttcagttcaacgcacaaacgctcctggggcctcatgggggcagagcctcccctgggcctgcagagagtcctgttagcagcgacgtccccccgccgcggggtcctgtcagcccggcagtgtcttctcagtgtcttcacctgagcgagtgtctgtggccccaacgcgttctgctgtggctctgccctttccaggttgagaggcctgcaggagaaacacactcccctcctgggtttccacactcaggaggtcagaggactggctcctgtgaccagggcccctctcccctgaatgggaaaggggtctggggatgggagggcgcaccacagagaggagatgatgctgggtgtggcccatcttctgtgggccccttcccagacaccggatccatgggcactaacccgcctcccaggctgatgcccggaggcagcttcctgggcaggagggttccatgggcactaacccacctcccaggctgatgcctggaggcagcctccagggcaggaaggaccctgtgctccccgccccccatcctgacatcctgttcttttgcacttaccctgtgctgtgaatgtaacagtgggccttggccccgcccactctgatttgcattttcatttgtgtttgtttacacatccatgcactgcctgtagcagtcgattgtcacagcttcgacttttggatggtagagtgtgtgcactgactgtgagtcgaataaacaattgagacgatttccttccaaaagcca

SEQ ID NO: 96604 - DNA, 928 bp, Homo sapiens
tttttttttttgaaacaagtcactttaccctccttaggacccattttgggggggaaaaaccaacacattccagagctttccaagtcctttgaacttcaggttcacattcagggatcacacagttctgcctgttctcagggcacggcaactgccaatcccgctgaagaggcctccctgggcacagcacaggctgcacggtgcacgcatttccctgaaggcagccccttcttcggaagcagctgttccaggcctcggaacagggcctgggtatccgcgtggtgggctggcagctgacggcctgctcagtggagccaggagctaactcagaccccaaagcaagcagggggccagtggcggggcccagcgcccagcaggacacccatgcaagaggctgagcccccccctcgtgccgatttccacactcaggaggtcagaggactggctcctgtgaccagggcccctctcccctgaatgggaaaggggtctggggatgggagggcgcaccacagagaggagatgatgctgggtgtggcccatcttctgtgggccccttcccagacaccggatccatgggcactaacccgcctcccaggctgatgcccggaggcagcttcctgggcaggagggttccatgggcactaacccacctcccaggctgatgcctggaggcagcctccagggcaggaaggaccctgtgctccccgccccccatcctgacatcctgttcttttgcacttaccctgtgctgtgaatgtaacagtgggccttggccccgcccactctgatttgcattttcatttgtgtttgtttacacatccatgcactgcctgtagcagtcgattgtcacagcttcgacttttggatggtagagtgtgtgcactgactgtgagtcgaataaacaattgagacgatttccttccaaaagcca

SEQ ID NO: 96605 - DNA, 612 bp, Homo sapiens
ccctgtggcagggatatggcagggatgtggtcatgagcaggacatggagggccccgcgcttttctcctgagtgcacgcccttggggcccctctgttcccctgacttagaaggtcgggaccgattcccagatgaggaagaaggggaaggtggtccagagtgggggcagcccgtgtaaaggccacaggggatgcctgtgtgacgcctgcccttctgctcctcacaggatactccagccggagagtccagagccccagcagcaagagcaacgacaccctgagtggcatctcttccattgagcccagcaagcactcgggctcctcccacagtgtggcctcggtgagcagcaggtgccagggctccagggctccaggtccgggcttacccctgctgaggactctgccctcagcaagcttatagactggtagagtccattcattcattctctctctcactcctccacccacgcgggctttcagggattgtccctaatcactcactgtgccaggtgttggtgggagaaaggtgggctggtgcagaggagagaaactgatggtctcctggggagacctgtacctgtgaaagtgcaggttattcattcatcagccactgac

SEQ ID NO: 96606 - DNA, 711 bp, Homo sapiens
ctgggatccagagccccacacacagtggcttcaagtcctagatccactggctgtgtgaccttagacaagtcatttcacctctctgagttttactttcctcttgtgtgaaacagggacaataacagcccttatcttatgggatgagatacacatgtaatgcccccagtgtggctccagacacatgacgaccacattaaaaacacactcagattcttcccggcctcctcctccctcctgtcactttctctgctatcctcaccacgcctatctcggaaatctctcatcgggctttcaccagccagaaactcttcagcgcctctctcctgccttaattcataaatgaaacaaggatttatggagcagctgggaccggaggtcaggcgctgaatcagacagagtaacatttctgtccttgcggatgtgaccaggtgtggaggcagcagggtggaatatgtgacctgtcaggtgctggaaagtgctgaggacaggaaaggagcgtggagggcgaatgaggaggatgagaaggtgacttggggggaagctagcaggaggggagggaaggcagggagccatgcatttcaatatctggggaaaagcatctcagtccagggactggcagatgtcacagctcagaggtgggagctgccctgagggagtgtgtcccggaacgaccaggaggccagtgggtgaggggagtgagccaggatggaa

SEQ ID NO: 96607 - DNA, 683 bp, Homo sapiens
agggtggagcaggggtgaggcagggtacagtgtacattgcttgggtgatgggtgcaccaaaatctcagaaatcactactaaagaacttatccatgtaaccaaaaaccacctgttcctcaaaaacctattgaaattaaaaaataataaaatttaaaaaagaatagtataaaaatagcccaatattactcaggaaaacagaggtgaaaatttaatacaaataatagcaaactgaatccagcaaaataaatatatcatgaccaatttgagtttatctcagaaacacaacattgatctaacattataaaatcaattaaatattaaaaagaaaaattataaaaataatcttaatagatacagtaaaatattcatggtaaatattcttagcaaaatagcagtaaaaaaattctttaacatgataaagaataactaccaaaaaaaagttaagcatcatatataatggtgacacactgaaaattttccctatgggatcaggaaaaagaaaaatgatcagcctgaatcagactttccccgatttcttggttattttcaaatttattctactagacaatgtagattatatattgatacctgttctcatctatatgataagagaatgtcctctactctccaagttataatggtttagttaagctttatatataaatgaaatattgagttctata

SEQ ID NO: 96608 - DNA, 117 bp, Homo sapiens
attatgaagggttaagcagtttagcctttattctttagataatgaagactaatgaaagagttatggtaacacctaaagctaagagcaagtcaaagacgatatttttgagtaccaaat

SEQ ID NO: 96609 - DNA, 398 bp, Homo sapiens
taaatatattgtcttctttcctcgattatggcaaaagggcaatgcttcgggttaagaaaaccaaggtacaaagagggtaaatgactcggctaaagctccagaacaagttggtggcaaatccagaatatgtttgacttttggtttcctctgtacagattttaaaatatgaatgctatagtttaaaagaaagaaatggtggaaaggaaaagtagagaaagaaatgccaattccagtccaaagctttatttgccaagttttcttagaatgagttttaccaatttatgaattcttgtaaacagaaggtataatggaaatactgaaaaacttttgcctaaagtggcattattgactgctagtgtgatgctactgtaatgtaataaattattaaatgttgcaaa

SEQ ID NO: 96610 - DNA, 580 bp, Homo sapiens
  misc_feature (500)..(500): n is a, c, g, or t
  misc_feature (504)..(504): n is a, c, g, or t
gtgtcctttggtaactttgtctcctctagaatggctaattcatgaaggcacagtccctgcctgtctgccaccatgattgcagccaggggtctggcacccagttggcccccagcacatatgcacagggtgacacgccatctctgctctggtacgagctcctcgtctcctaggggaggtaagtccattcattgctgtgacccatcatcctctccaaatagaaaagccactagatgggcacctgtcccagcctggccgctggaagtgacagccaagaacaacgtaggctcccagaaacagaggcactagcatggccacactggggtcaggcaggggagatcagggacacccagtggggagaagatgacgcgcagactcagccctggggggcaagggctggaggcagagccctgacctctctgtcccactcccttgcccaggctgcacccagtgttggtagagtccctccaagcctataagctgtaactcctgtcctggacggncagncccagagctctgatgggtgcctctgtttcccttccctactggtttgtgtggaaatttccaacacattgagcggggc

SEQ ID NO: 96611 - DNA, 351 bp, Homo sapiens
ctcatcccctcccgttcttagcagaccacggtagttagaagctcaggctgtgtggtcagacccaattgcaagctctggccctgccacttgttggctgtgtgatctcaggtaaactatttgacctctctgtgcctctcaccttctcaactgtgaagcaggacaccggtgtgtaactcagaagcactgtgagaattggttgggacaaagcatatcaggggcctgccacagagtaagcaggtcacagaaagcagctgcagaggatatcacaggtctactggtgagaaaaaggacgctcggaggagtacccagcaccaggcagagtaagtgaaccggaacgtaaacttagtcttt

SEQ ID NO: 96612 - DNA, 600 bp, Homo sapiens
tcccgctgggcactaggcggtgccgggcctgactcatccccagggtctggccaatacatggggcccctgctggtgcccttccgaccttcagtcttcacttcgtatttctatacttatgtttattctaaaagtaatgcaaatttggttacaaaacatctggaaagagagaagagaaaactagctgaacacaagcaagctcagcatcttcggggaatttactgctaatcccttaccctgatgaggcacttttattcagctgtaattggtgtgtagagttgggaaacttgctcttccatcaagccccagactccacacagactagacaggctgtgcacacttgaacaggctctatgcacacctgcatagggtctatgctcacctggatgggctccatgcacacctggacaggatccatgtcacctgagcaggctccgtgcacacctgaagagtctttacacacatctggaaggactctggactgacctgaatgggctccgtgcacacctgaagagtctttacacacatctggaaggactctggactgacctgaatgggctccatgcacacctggacaggctccacacacacctggacaggatc

SEQ ID NO: 96613 - DNA, 352 bp, Homo sapiens
aatgaattttgttcagagttaactgcactaggaattttcctagttattattaaaaacagtcacagaatattgttgctctttgcttatattacttccttctaaattccctttctctgaaatctgagatggtacaactttggttttttttcctagtttcttgatgaagaggttttaaagaatcccattccctcctccctgctccaggacttctgtcccttggttattcttacctttacctacttcttcagcttctccactggaacctttcaagtgacactcaaacatgctgtactctttaacaatcctccagtgacctcatttctctttccacttgtcatcctgtctgctaccc

SEQ ID NO: 96614 - DNA, 580 bp, Homo sapiens
ttgatcccatcccagcaagacctgtcttggagtgtaggtctggctcagatagcaaactccagccctttcacactgacaggtatcatatcacaggctcctaggtctttaggtcccatggagagtgccactcccagttccactgttagttacttctatggtctgtgttcaagtcaaataaagacatttgttcattccatgcacagcacagagtaggtgctcaaaaaagtactttttatacagatgaatgaacaactactaccagttaacctagaacctgtcctttcagctctagtttttaattgtaattttattttattttagagacagggtcttggcacaatcacaattcactgcagctttgacctctcaggctcaattggatcctcccacctcagcctccatagtagctgggactacaggtacatgccaccatgcccaactaatttttgaaatttatttttagagatggggtcttgctatgttgcccaggctggtctcgaattcctgaggtcaagcaatccacctgcctcagcctcccaaggtgctgggattataggcgtgagccatcactcacctctag

SEQ ID NO: 96615 - DNA, 366 bp, Homo sapiens
ccgcccactggctgtgtatgggggataggtcaacctctcagcgtcagctccttatccctgccctgatcctcgtaaaagggggataacctgtacagaaatttttaggatgggagttcagagactttaagctacatttattatttactacaagccagatgtggaagtatctgtaaaggtaaacttgtttagcactgcaaaaggaaaacaaatcttgggaccccaaactcattaagccaaagggaaaagtcaagccgggaagtgggtcacgcaaatctgcctcccattttgattcctaaataagatggctacgaagatgaaaagctacacacctccctcatatcttgcccacaaggaaattccttgcgg

SEQ ID NO: 96616 - DNA, 399 bp, Homo sapiens
gcgcgctctcaagctgttgaagttggccgatctgttttcgaaaggatgaacaaggaaggcctttctcaggagaaatgaactgagagaatgaagtggttcctacagagggaacagcaagtgctcctgaggctggaaagcccttggtgacttctggaacctagaggaaggccaaaatagcttgttgctttccaagtggtgcttctcaacttggcactcagtggtatcaccacgagggcattaggcactatggaggtttgagcctgcccccccgcccagagtctgatgtcattgtctgggtgtggcatggggagttttccaagtcccccaggtatgtctaatgcacagcgcaggatgacaggcaggtcaggtaagattgtaagtggacgcaggacagagctt

SEQ ID NO: 96617 - DNA, 203 bp, Homo sapiens
tataatgaatttgttcaattatctcttaggatgttgtcctcatgtacatggttaaagtcagacacatctttcaattcggaggaagagggaaatttcaagcaaaagtggagggaaggcaatttccttttaagcaaatagtgaggaagttgcatacatcacttttattcacattccattgacaaaaattttgtccatggccacac

SEQ ID NO: 96618 - DNA, 414 bp, Homo sapiens
gcaaggtttttctgagatactatagatggagagatttccatctggaaaacagatggcagcagaaaagtgatataaattagtatttaggaatagttcttttacatctcaggtcctgatggatattgtcaagggagtcttcactttaactttttctagagaacacatctctttttgtttggatgagtcacaacaatgaagttgtttatttaacacatatttttgaggccctattacgtggcagacacttgttaggtacaggtgagttggtggtgaacaaaatagacctccctggccctcatggcgttttacagcctaataatgggaaatagacattaaaatatataaattttaagccatattaattggattgatggaaagtccaaagggctgttaaagtgtgtaataggggatctt

SEQ ID NO: 96619 - DNA, 429 bp, Homo sapiens
tcctcaaacacagctagcactttccttgcccaggggtctttgcacctgctgtccccttgtcctggaacactcttccacccacccctcagtatctgcatggctccttcctctcttcccttggtgtttgctcagatgtcgccttatccaaggaggcgtccagatcacgccacatcaaaaagcagccacccttcacccctagtgctcctcatctttattttccttcaaggcactttgtggcctccaaggtgtttatttgttcactgtcgcccattggagcatggggaccttttctcttgttcactcctgtgaccctggtgcctggaacaggggattactaactgagttcctgaattaaccagtgtgtgctcagccccctcttcacccttcccctgcttctgccgggcttttgcctccctaggaagccccccg

SEQ ID NO: 96620 - DNA, 110 bp, Homo sapiens
tttgagaccagcctgagcaacatggcgagatcctgtctctaataaatacaaaaattaaccaagcgtggtggcacagcctgtagttgcagttacttgggagtctgaggtgg

SEQ ID NO: 96621 - DNA, 121 bp, Homo sapiens
gagattgcgccactgcactccagcctgggcgacaagagcgaaactccgtctcaaagaaaaagaaaaagagaaacagtgaaaggtctacagcaccaagcaaatgcccaatcaagaaagctgc

SEQ ID NO: 96622 - DNA, 1012 bp, Homo sapiens
ctgtccacgccggacccgtcaatagggcggtcaccttgtctctctgtccgtcgtgtttgtccactcttgtttatcggggcctattttgcgctcttcttcttcattatccctcccctcttccgctgcagttagctgttacgtcgtctctatgtgttacgtgtctcctctaggcgtgattgtcgttgcgggctgccttcctctctcactccctagcactctgcgcgtaccatcctggttcgtaggcttcactttacttctctcaccttcttctcgctttgtcgccgttgtgctttgttcttggtggtttccctgtattttgtatgtggccgcgctgtgtaaaaagatttgtctaggtagatcgatgctgctgcgtgcgcaactgttgtcttcgcgcggcgaggacgatgattctgcgtggtgggggtgacacccgccgtttgccctcgtccatggtttatatatatcccgctggggcgtgtataattaccttctgtgtgtgggggtggtggttccccctaattgttgtttccccgcccccccccggagtggggggtgtctcctccacagagagatccgccggcgcgtaggtgtgttttcctccccgtgttgttggtgcacccggccccgccccgttgcggttgttatattaagcagtcgcctctatgtgtggggggcgcggccttcttcttattaaaaaaaatggggggggggcggtgctgtagttgggggtgccccctcgctggagggagatgatgttagcgaggcgcggcgccgcccctcttctttttttttgtttttttttgttttttttttttttttcttttttttgttttttttttttttttttttttttttttttttttttatcttttttttttttttagaacaactcagcaaaataaaattcctgtttattgttggacaacattgtttcacacatacatcaaacaggccaaaaaaaataaacagcaacttcatagacaaaaaaggaaaaaaaaagaaacgagattat

SEQ ID NO: 96623 - DNA, 170 bp, Homo sapiens
gcacgagggacaacattgtttcacacatacatcaaacaggccaaaaactcagcaaaataaaattcctgtttattgttggacaacattgtttcacacatacatcaaacaggccaaaaaaaataaacagcaacttcatagacaaaaaaggaaaaaaaaagaaacgagattat

SEQ ID NO: 96624 - DNA, 561 bp, Homo sapiens
gctacaaagattttttaaaaactaagagcctccattttaaaggacctaataatatgaaggagttatttcccactgttgtgacaatgcaagaaaacagatgtttgggaatttctggtctcatcgaaaaaataaggcaaatccacaagaaacagtcaaatgaggtagaaatacactgtcaaaagagaggtatcaactaactattttatgaatcatcttttttaggatttttgtgacatttttaaaagacacttaagcagagagatagaattattatttttattaaaaataaaatatgaggccaggcacagtggctcacgcctgtaatcccagcactttgggaggccgaggctagtggatcatgaggtcaggagttcaagaccagcctggccaacatggtgaaaccccatctctactaaaaatacaaaaaaaaaattgggcagtggtggtggtcgcctgtaatcccagctactggggaggctgaggcaggagaatggcgtgaacctgggaggcggagcttgcagtgagccaagatcgcaccactgcactgcagcctgggtgaca

SEQ ID NO: 96625 - DNA, 320 bp, Homo sapiens
ttacttgtatttttctattttccgttgtgaattctttaacttatgagctatttaaaaatttaatttccaaacagagttcctctagttgatttggctgttgatttgtaattgcattttggttaggcagcctgtttgagtgtgatgccaattggtgtgtataatgccaactctttgaaatatgtttagactattaaaaatgtggtccattttaataatttttatttgtacatgaagagactatgtattgcctggtttttggtgcagttttatatatgttcattatgtagccttgttaattatgttgttcaaatctcatatct

SEQ ID NO: 96626 - DNA, 377 bp, Homo sapiens
gatagttcttaatattccgtcatatggatatgccacactttatctgctcactttcttaagaacaccttgcttccaagttttggccattatgaataaagctgctaataaaattcatgcataggtttttgtgtagatctaagtttttgactcatttgggtaaatacaaagcatgattactggttcatatgggagtatgtttagttttgtgagaaactgccaaactgttttccaaagcggttgtaccatttgacattctcaacagtagtgcatgagcattttagttgcacggtatccttgccaacactttggatggctagtcttttgtaatcttgtagttttggtttgcatatccatgatgactaatgatattgagcatc

SEQ ID NO: 96627 - DNA, 507 bp, Homo sapiens
catactttggagctcagattatccagtataattcacataatgatcccgtgaagttggtactaagattatagtattaccctcattttgtcaacaaggatgtaggttcagagaaattaattatcttgtctaagatcacacatattctttgcatattggactgtatgtgtttgtgtataggcattaatttcattctcagtgtagatctgtactttcttttccaaatatattatgaccacactgtaccttgtacatgtaatttttactcagaaactaacaacttgttggctttaaaaaatactcattgaaattgaacattgcttcagtttctgaaatgaaaataaccagttcctaagttagcagtgatatcagcgatggtgtgtccggaattggtgggtccttggtctcactgacttcaagaatgaagtcgcggaccctcgcggtgaatgttacagctcttaaggtggcgtgtctggagttctttctgatgttcggatgtgtttggagttt

SEQ ID NO: 96628 - DNA, 344 bp, Homo sapiens
aaactgaacacagtcacataaaccagcacccagatcaggaaatagaaaatcaccttggaaggtcccttatgttcttttccaggcagtagtttccactatcctgacttccaacagcacagaatagttttgcatgtttgagtactttatataaatgtaaccataaagtatatactattttgtgtctggcttctttcaacattatgtttaaaagatttaattatattactacatgtagttttagataattcattctcttttattttctttttctttctttttttttttgagatggagtttcacttttttttttgcccaggatgaagtgcaatggcgcaatcttggct

SEQ ID NO: 96629 - DNA, 799 bp, Homo sapiens
ttttagatggaatctcactctgttgccaggctggagtgcagtggtgcgatctcggctcactgcaacctccgactccctggttccagcgattttcctgcctcagcctcccgagtagctgttgggattacaagcatgtgccaccacacccagctaatttttgtatttttagtagaccctgcagcttgttactttctagggtgaaatttgacccttgttacttggaccaagtatattttggcatattgtgagatggcagtgacatctgttttattattttgcatagattatgaccatttgtaagtgtttctacaaatggtgtgtatttaaaacataaagtgtgcacaaataaaaatcccaagagatggggactcagttgttgtcataattcattggtgcttctggcatgttggccaagatggtcttgatctcctgacctcatgatccaccagcctcggcctcccaaagtgctgggattacaggcgtgatccaccgcgcctggcagcccctagacatttttatcggctcccaatatccttctagtaattcttttgctgcctaagtgaaccatagttgaaccattatagtttgcaaaggtctctgaaatgtgctctcaaatagagaagttaagtgttaatctgcctaatattgatgctccaagagttctgaaataagaaaggtcataagtgatgccacaaatctataattaatgtggtttactcccttccgattcttcttcccctagagggaaaagaaagtaggaaggagcgttttcggcgatagaattcgttggttggggagg

SEQ ID NO: 96630 - DNA, 736 bp, Homo sapiens
agcggaagcaacctgatgaaaccaacaaattgctcagggagctccagctcaatgagcatttgaacacctgaccccttcccaatatgatgtctcttggatccctcatacaaagaaatgcatcttgctgaacaggtgaccaataatcttaaagaacttgtacaacaagtaactccaggtgatatcgtaagcatgtgtggagttcaaaaagcaatggggatttccattccttcccctgtcatggaaaacaactttgtagatttaacagaagatcttgaagaacctaaaaagacacggagtggacctagtgggagttgaggccacctggtatttgattatgtattatgtacatacttttccattcttaacttaaaaacgctttcacaagatatcaaatatttgtaaattgtgcttttaattaaacttcggaacagtgaaaacaaacaaaaaacaccttcctggaactaattatagcaaggttacaggatacaaggttaacacacaaaagtcaatcatttttcagtatgtcaacaatgaacaagtggaatataaaaattaaaaaattcactaccatctatataagcaatcaaaaaataagataggtataaatctaacaacatatgttcaagatctatatgaagacaactataaaactcttctaaaaatgttctaagaagaactaaataaatgaatagatattccatgttcatggataggaagactcaatattgtgaacatg

SEQ ID NO: 96631 - DNA, 438 bp, Homo sapiens
tgattgagtcaattacacagcgctaactggggcagccctagggattgaagggcgccctggcatcctggcagaagctgtttctaccacaaatctgatcagaaacagcgactaggaggtgaaagggaggaggaggaggaagactacaacttctgaaaagacccaagagccaacacacgagataagaggaggccaacggaggcatctgggggcaagggagccccctggcacctttgaggcagcaccaagggacccacaaggaagtaagcttccttggggcaggggagcggggaggtgctggggcgaggcccccacgctgctgggcatgactgagtgggaattggaaactgagagtaacaagcttcgctgggtgccgtgcctgccccagctcggtgcaactaccgagccccccgggtgcctgtgcccgctgtggctccagcc

SEQ ID NO: 96632 - DNA, 951 bp, Homo sapiens
tgcccgggctggtcttgaactcctgagctcaagtgatcagcctcccaaagtgctgggattacaggcgtgagccactatgcccggcccgtaagtcagtttttgaaatataaaagtggtataggctagatgtgacaaaaaacagtcaaatgatacaagagcttataaagtcatatggcaagttcctccccaccaatcatgcagtgaagtgagggtcatgtgtgtccttggaagagtcacctccagttcttgcagggggatgttttcctaaaactttctgagcattgctcttctctgctcaagccacttcaatacacctcaggcagcaaagtctcagcttttgagccgtggtctctgagggtgttggatgtgaacgaaatcaaatcggtacaatgatgactgtggcaagtgcgatgaaggaacgaacctgcagggcgcagaagacgtgtcctggggccctgccttggtttggaagacaggcaggcatccctgaggctgatggggagatgaaccccgaagccagagtgcttatccgtcagatctctgcttcatgtttggagtttgctcacttaacacatcagaagtggctttgttccgtatggcagcaagttctgcagaagcctcatttgggtggggggagttttattaaaacagtttatcatggagaattccaactatacaaaagtagagcaaacagtaaaatggactctcatctatccatcaccaacccatgaccaatgtcttcagctgtcagagatttatcttatagctccttgcttcctcctcctctctctacctgtctgaattgtgtgaagcacatcctggccataagatcagttaacttcttagtatttcagtatgtttctctcaacgttgtaaatgccactattacacctaaagaaatcaacaatatcaaaaagaaacagcataccttaaaaaaagttttaaaacaca

SEQ ID NO: 96633 - DNA, 304 bp, Homo sapiens
tataaccacagtttgtgtatccatcccccagctgtgggacatttgagttgtttgcaggtttgtttgacacaaagaaagctgccataagcactcacacataggtttttattataaacactgatttttatttcactaaaaaagtaaatatctagaagtggaattgctgattggcatcttaaatgtatgtttgacctcataagaaactgccagagcaatattcttaagatggtggaaaaagaagaaaaacagaattagagactggctttaatacatatgaaaacaatgggagatttctgaaaaaaaa

SEQ ID NO: 96634 - DNA, 467 bp, Homo sapiens
ggcatggcggtgctgctggcccagacctcaggaaacagcctgcaaacttctcctaaaaagacaattttaaataagaaaaacatgaggaaagagtgaaggggatgacacctgtttagggacttagaaggcagcagatcttgggggagaatgagtgtcgtctgttagggcttgagtgccccatgtgggacccaccccctagtgcccacagggaaaagccagagaagaaccggaatgcctggtctgccacttcccttttaggctgcttgttgtgtgtttggggttgcggcgagacccatgcaggaggcagcaggcttggccaggtgttgggaacaagcatctccagggctaggcccacacccgaagtcccagctcttggtctggcttttggggtgggggactttaacctctccttccctcttgcatgctggggctgctgacgtgtgtcggctgagctctgacggggaggg

SEQ ID NO: 96635 - DNA, 444 bp, Homo sapiens
ccagacaaggagttccaaaatgaggactgtggacccagaagtaccataacttgctacataacaataggcaagtcatttaatatctctgcatctccacttcccaatgacaaaaaaaggaggaataataaaacctttaagcaccatataaaaacatgacatggacccagcacagtggctcgtgcctgtcatcccagaactttgggaggccgaggtgggtggatcacctgaggtcaaaagttcgagaccagcctggctgacatggtgaaaccccatctctactaaaaatacaaaaattagctgggtgtggtggcacacgcctgtagtcccagttactcaggagactgaggcaggagaatcgcttgaacccaggaggtggaggttgcagtgagccaagattgtgtcattgcaccccagcctgggcaacaagagcaaaaactccatctc

SEQ ID NO: 96636 - DNA, 391 bp, Homo sapiens
ggaggaaaggaaagcaaatccacagctggggagaaaacaaaactatagtctacactaactgcccacataaaagatttaaggtcttctgaagattttagatgagaagaccttattcaacaacttgactacaggctatacaaaggggtggtttacttttagaggacagaggagcataatggttcaaaagagaacaggttttagcatcattggaattatcatttactgaactctacgtgtcaggtgcttagccaagcactatgtctatattatctcacttaagaaaactaaggtttaagtgttaggtaacgtgtttaaattcacactgccataggcatggggatggaatgcaaatcaaggtctatctcagcagttctcaaccaagaattattct

SEQ ID NO: 96637 - DNA, 329 bp, Homo sapiens
gggaatgaggaacgtcactccagcaagaccattccagtcaactctacatttttctcctggagatttgggctgggacagcaggagagagtgctagaacttcaagcatgggaggatgatgtgactgaagcaactgagggaatatggttagatgtggattatgaggtgagctctgggttatccatctcccatctcctggaggttaaattgatttcgtggagcctgaagatggggtctgagaccctctgcattcagggctcagcttctgagtcccttgtattgaatcttcatacgtctaagtctgatcaaacctgacctgtgtcctcttgggg

SEQ ID NO: 96638 - DNA, 484 bp, Homo sapiens
catttcatcctcacagcacctggacggtaagtactgctgctagcctcaccctaaggacgagggaaatcaggcgcagagaagttaagtaacccactcagagtcacactgtgttaaggggtgagctaggtccagctctttctcactctgaagtctgtgcccatgacctccaactggagtctgcccctgcagaagccgttagagaggaaagcctccaactcctgcccctgtgtgggagccatcgtggcacagcccatgtctttgtggccgaaagtgaaatgtccccatctgtagcaccgcccctctgggtctacccacctgggccttgtctggttaacttcgcgcctctgctctcaggccctgctatgcccccttcttattcatgaaatctgcgtcttgcagaggacaccagggggatgggaacctgggggaaccctgggcccattaaaccatgttccccatcccagccttcacggctggagaaaat

SEQ ID NO: 96639 - DNA, 310 bp, Homo sapiens
catttcatcctcacagcacctggacggtaagtactgctgctagcctcaccctaaggacgagggaaatcaggcgcagagaagttaagtaacccactcagagtcacactgtgttaaggggtgagctaggtccagctctttctcactctgaagtctgtgcccatgacctccaactggagtctgcccctgcagaagccgttagagaggaaagcctccaactcctgcccctgtgtgggagccatcgtggcacagaggagttctccaagcaagaaacgtgaaggtccgaaggccaggaaccccaatcaggaaacca

SEQ ID NO: 96640 - DNA, 806 bp, Homo sapiens
ctgcttgagtgatggtgcgctaaaatctcagcaccactataggattcatccacgtaacgaaaaaacacttgcaaccccaaaagccattgaaatttaaagcaacggtgggacaaatcttctgaaagcttcctaatcaacatttttctgttaaaatgtactgcatatgcacatttatatattgggagcattttaaaggtttactttgctctgaaagaaatatttaatgtgtttcaaaataatttttgagattattctagttgtggttaagcttaaaggctgagaaattacttaactattcaaatagagcctgtgcaactatatgaaatgtcattatggagacactcattatgcttttcctgtagaacaaaacaagtagttgggtttatctgcaattagggttttttgaggaacgtgagggtggctggacaagttgggtagacctgcaaaagggccagcggctctctgcatggctctggccatccggcactttcccttgacttgcacaggctgccctgtgccttggagttgctgcagtgaccttgcctgtccttgcttgtgggtctgctgctgctgctttgctgctgatggctttagcacagagggggcccgtgctttttattgctcaccagaggcagatgcatctactgctgtgctgtctcgcacaccccctatgcagcatcattaggaaagctagacacaagtgattcagaatggcttaggggtttatctaagccaagtcagataacctcttgaactatctttttgtagccatgaaagcagagtatatttccagaggtataaagatg

SEQ ID NO: 96641 - DNA, 290 bp, Homo sapiens
tccagatcccacagaacaagaccctataaaggctccatcccgctgcatcctgacagccctgtggtagtcagattattggccccattttgtaaaagagaaaatggagacttccttgcccaaggtcccacagtaagtagcagggccaggctgagaatctgagtccatggcttcacagcttacgtttgggagaagccaagtctacagccttccaacacaggcgagagctgcgggcagcctctcagcacccaacaacacactggggccctctgcttggcctggctgggtatggc

SEQ ID NO: 96642 - DNA, 222 bp, Homo sapiens
gcaggaaggagatgaggggcgcagtggtgcaggcagcatcagtgaccactgaccacacccaacacagtgagtgtgccaggaagcatgaaggctgtgtctgggcatctcgggcaggaggttgggggctgggggggagacagggaagaggaaagtgagggacaaagttgggggatagacaaggaaccagaaagaggctgatagtgaagtaggacaagagatgct

SEQ ID NO: 96643 - DNA, 501 bp, Homo sapiens
tcccagaagacagttgctactcagtaagtatttgataaatgaataaaaatgggtactaattttctcacattctctcttctttgctttcaatctttttttaatgaaaatagatatctgttcaggcctttctacttttactattgtcaaatattgcctaatttataaatcttgcattgactttccttctctgcagggcaaaagaaggaaagaaaaattacccattgattttgtagaacttcttaatcaaatcttgtctctttgcaaaatctcattctcagtaaagatgcttatgaaaatccctcagaaaaatatcacatgcgtaataaaacacaactttttaaatggatttcagtctgcccttcctcaccacacttcttgttctgtcattactgaaatattcctgggaagtttcctcaccacaaataatgcccatgagaagcagcgtgataagagtcattcacgtcccaagaatgtgggtgtgttgacaaacttcaaaactgg

SEQ ID NO: 96644 - DNA, 756 bp, Homo sapiens
ttacgtgtaagtgaaatggggggctgggttttttactaagatatttgaaacctctcaggataagaatatcttcttacatagcaaccaaatatatctaacatataatattttaaaacatttatatttttgggttgcttcaagagtcagtttcatggagtttggaaattccaaatgaaaaaatgagaagttgaccatttattagaattgccaaatagaatacagggcacttgagtaatgctggaaacatatttacactactaattattacaggttgagtagccctaatctgaaaatctgaaatgtgaaatgcttcaaaatttgaaatgttttgagtgctgatgtgagggtcgaaggaaatgttcattggagcattctggattttggattttttaattagggatgctgaactacagttcagtgtacaacacaaaccttccaaaatccgaaaaaaaatctgacatcctaaacacatctggccccaaacatttcagataagggatacttgacctgtattcattgtttatctgaaattcaaatttagctgagtgttctggatttttatttgctaaatctggcccccctactgtacatgcgttctaagtggatgcagcgttcgccatattgggaatggagtgcattatgggaattctcgtccctctgaggcacatgtctgtgttccctactcagagaggagagaactgagcaatgaaaatctgaagtttttctttgagctataaatgatcatttagagctata

SEQ ID NO: 96645 - DNA, 494 bp, Homo sapiens
cttattaacaatactcataacatttagccattaatgattactgatagcttaaataagagtgtagtttctgtttctaatgtctattaattttaaccccatttaaagatatttcctacttatcatactcaaagttaatcagaagttaaataaatgatggtccttctggttctctggaaactgaaaagaagcttctgtttctttagggtatgcaggaattttttttcttcccagtgagctgaatccatcctttacgctgctatttgctaacctcagttgtttttctgctccattaaagttgaggccaccaaaaatagtagtaatatcacaactacaaaaccctgggtggatttgtacccattgcacatacacttcttgctgccaattcctaagagacttttgaaataatagtatattcccagctggacaatatattctacttgtggcctatgtatagtgttcaacaagtccaggagccctatgaaacggaatgtgtt

SEQ ID NO: 96646 - DNA, 357 bp, Homo sapiens
cggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggt

SEQ ID NO: 96647 - DNA, 801 bp, Homo sapiens
tatttttgagtcagggtgtcactttgttgtccaggctagagtgcagtggcaccattatggctcactgtagcctcgacctcgcaggcgcaagtgatcttcctatcttagcctctggagcagctgggaccacaggtgtgggccaccccatccagctaatttaaattttttttttttgtagagatgggggtctcactgtgttgcccaggctggtctcaaacttctgggctcaagatgtttccaccacagtctcacaaaatgctgggattcaggtgtgagccactgcacccggcttatatgtgctgctaatttaaaatagcactatcctatgttaatattatctaatgtttatgcccaaatttctcctggattgttacaaatgtcttttttacagttgatttcttctaatctggacttaaacattgtacatttgtatgcattatgtaaatggtgtgttttgagttgtatagctgtgtcttactatttttccactaagggctatgtcgccgcatgatgtctaactagcgagtaacgcagtcctctgtggtgtacagtcacatattgtacctgttcatctctgggcatagggcaactcagttccagctctctgtcattataaacaaggctgcagtgaacatgcttaagtatgtgccctaattctgtgtgagaatttggggggatataaaaccagaggtggaattgctgggtcatagagtatacgtagaactcacctgtctaagtagcactgaattctctggaaaagctgcaccagcatactcttccacctgtagcatatgaggggcc

SEQ ID NO: 96648 - DNA, 163 bp, Homo sapiens
tccaggtggtaggttgtcaaacttgaattaaatttttccaatgtggcttcatcattaggtctgaaatttaatgaatttcaagaaggcaatttaacctgtatttaaataaaagtgattatattctacatagattcattagccaaatataagtattttgggggga

SEQ ID NO: 96649 - DNA, 592 bp, Homo sapiens
aggcagtgctgaggccgccgtcccctctaccatcagtccagtccggcccgccctcctgcagccatgtcccggcccctgtcagaccaagagaaaagaaagcaaatcagtgtgcgtggcctggccggcgtggagaacgtgactgagctgaaaaagaacttcaaccggcccgagttcacgctacctgtgcacttctacggccatgtggagcacaccagccagggtgccaagtgggtggacacacaggtggtactggccatgccctacgatacgcccgtgcctggctatcgcaacaatgttgtcaacaccatgcgcctctggtctgccaaggctcccaatgacttcaacctcaaggacttcaatgtcggtggctacatccaggctgtgttggaccgaaacctggcggagaacatctctcgtgtcctgtaccccaatgataatttcttcgaagggaaggagctgcggctgaagcaggagtatttcgtggtggctgccaccctccaggacatcatccgtcgcttcaagtcttccaagttcggctgccgtgatcccgtgcgcacgaacttcgatgccttcccagataaggtaccatgcg

SEQ ID NO: 96650 - DNA, 475 bp, Homo sapiens
acaagaatgttccaacagatttattcaaaataggaaacagctttttgcaaaactggaaataactcaagtgtttatcaacagaaaaatggattaagacattgtagtaaatacataccatggaatactaagcaataatagagaaggacagatgactgatatgtgcaacaacatgcatgaatctcaaaaatattatattgagtcaaaaagtctgggctccacatggctccatttacatgaagctcaagaataggcaaaactattctagggtaacagaagtcagaaaagtggttatttttggagtaatattgaccagaaagagatgcaggggcactggaaatatatttaatctaggtggtagttacatgagtatatacatatgtaaaatgtattaagctgtacatttaagatttgtagactattgtatgtatgttttagttaaatgaagaagattaaaaaatggaaaaatgactatatg

SEQ ID NO: 96651 - DNA, 351 bp, Homo sapiens
tgactctttcccgcctatcttatgcccgtttctaatacaggtgcacagtgcctgcagtgtctttgcatagtaagagtgactttactccatttcccaacaaattcctcatctccctctgagaccacctccgcctggaccttattgtccatatcactattaacattttggtcaaagccattcaacaagtctctaggaagttccaaactttcccacattttcctatcctcttctgagccttccaaactgttccagcctctccctgttacccatttccaaagttgcttccacattttcgggtatctttacagcagcagcccactctactggtatcaacttattgtattagtctgt

SEQ ID NO: 96652 - DNA, 660 bp, Homo sapiens
agcgtaggctccactgagccgagattgcaccattgcactccagcctgggtgacagagtgagaccctgtctcaaacaaaacaaaacaaaacaaaaacccagttagactgctggaatagtccaaataagaaatcaggaggccttgaaacgtgtcagtgggattaaagaggagagaggtggaattgaaggttatctggtaggtgctatcaacagacttagtggtttaaaacagtgagtgagaggttatagtcaggttgggactatgtattaatcctttatttttttaatttactgtactgtactatgtattattgttaatatcctttatttcagattgacatatacccttaaatattcttaagatcatatccttaaggtcttaatagtctctgaataaatattggtataagctgcttcctaaatgatttcccatttatttactggtgtttttatatatctatttagagactgagtctcactatgttgcccaggctagagtgcaggagcatgatcatagcttactgtaacctcacactcttgggttcaagtgattctcctgcctcagcttcccaagcagctaggactacaagtgtgtgccaccacacctggctcattttttaatttttgcagagacagactcttgctatgttgctcagactggt

SEQ ID NO: 96653 - DNA, 546 bp, Homo sapiens
caaggttaaagactaaattagtgatttgggagatcaagccaatgggcttgtctaaaacctagtcaaaaaggtcaaagtgataaaaattatgaaataaaatttgatatttggaggctcaagctaagaaagctgctctgtctaaaggaaatacagaggacatggaaggtaagaaagaaatgataaaaagaaaaaaaaaactccaaagttaaggaaaatcttaagccttcaagtagaagggttctatcaagtgctttctaggattattgtgggaaaaagatgttacctagacatatcatggtgaggttggtaaactccagtggtaaagagaaattgctaccctctttcagaggaacaaaagaggttaactacaaagcaactgtaagtaggcatcagacttctcatctattatcataaaaagtagggtaaggtctacaaaatactgtaaaggagtattttgaatttagaatttcttatagagctaagctatggctcgctcatatgtcagggcaaaaaatcatccaggctgaaagtttgtcaaaaaaaaaa

SEQ ID NO: 96654 - DNA, 464 bp, Homo sapiens
cctggatccgcacccaggtgagaaggccccattgcctttgctcttaacactttgctacagtgtctctgtaaaggtcttgatcaaaagatttagagattttcataaaagcccctaagcagttgtagattacttggttatatattcataaagttcatagtctcttgtcctttcacttacacaaactaacagtgtttatacccaaacctatgtttattatcagttttatgtcaaataaatttaacagtatttgtacagcacacataaccagctcctagtaataaggcagctggcaggctttctgggctaagtcaacagattcagggtggagttcactggagaaaatagctagtggtccaggtgtcctgtttgagacgtggagggacgatgaatttgtagtcaaaacacttagcaactcttcccaaaatagcattctatttccttgtagtgaatggcaaaggacacat

SEQ ID NO: 96655 - DNA, 674 bp, Homo sapiens
tgtgtatttgagtaacaacaaagcatcaaaatataactgcaagtggaagtagatgaatcaattataacatgtggaggcttcaacacccctctcagaaatgaacagattcagcaggcataaaatcataaggatatagttaaacttaacagaacccatcaattacatgaatctaattgacatctagagactacttcatccaagagcaggttacatattctccagctcacatgaaatattccccaaggtagaccacattctgggccataaaacatacttccacaagtataaaagaatagaaaaagtagaaatcatacaaagcatgtagcattttcattaaagatattagtaaaattgataaacctttagtcaggctaatcaagaaaaaagaataaagacacaaattactaatattagaataaaagaagagtgatcaatattgaccccagggatgtttaaatgaaatttaaagagtaataaaggaatattttaaacaactctatgcctataaattggataacctaggtaaaatggactaatttattgaaagaatcatgcaaggatgatctgagaaggtctacatctgttttaaaaattgaatccctaattaataaccttccagaacagaaagtaccaggtgcagttggtgtcactgttaaattctatcaaatatttaa

SEQ ID NO: 96656 - DNA, 527 bp, Homo sapiens
taacctggtatgaatgaattttatgtgttatctaatatggtaaaccatttatgctaatatataatgaaagatgcttttctctgttagaggaattgtccatgtcaagagcatgcaggagggaatatatactttgaagacataggacgcttaaaaattacccatccatggcttctcttttccgggtagatggtaccagggtgcttggcctggctctaatgaggcctcttaccagcattctgagatagtgaacctgtagtacaatactacttgcaggtctccctcaagattttaatcactcttctcccttttcttaaactctctgagctataatgtttgcctgccttccttaatcttaacctagctttcctttccgtgtctctctgcgtcaagacttctatatgggccgggcgcggtgctcacgcttgtaatcccagcactttgggaggccgaggcgggcggatcacgaggtcaggagatcgagaccatcctggctaacacggtggggccccgtctctactaaaaataca

SEQ ID NO: 96657 - DNA, 467 bp, Homo sapiens
acaaaaatgacattcacttcctacaagtctttctttggtctctatcacgtcccaaattcaattcctgttcagcactctaaaaaagcagtccactttcaactacttggacaggaataatccaggtatatccattcttagaccttacatcagccaggtccaaacaaatcaaacagtggctgccccagcatttccagagagtgggctgcagcaggagaacaaaactgcaaccaacaggtaactcagagctcgacagttgcatttctgtgtgtttgtagccgatattttcgcaaacagtagaaatcttgatccaatatgtttcttcatacaattgtgataacatagataattcaactactagcagtagaacttgttcccatgagaaatcctctgaaagaagagctctgtggggattatgggtatgtgtttcaacagaacttgggtggttgcctttaaagagtacccacagt

SEQ ID NO: 96658 - DNA, 447 bp, Homo sapiens
cttctctgagttttatttgggctatgacattccaagggccggctctgaggccagccagcctgcagacctctggtgacaggaccccaaggtcccgcctggctctcctgcctggctctctcctccaccctctcctagttcgctgggctgcctggtgagtaagcctcctgctccgtccctgcttacttcattgcaaaatgagggtggtaaaaacatttactaacctcaacaggatgttgtggcaattagtggataaataattatagagcacactcacatgtaatgctcctgataaagctacatttatttttaggagctcacaaaaggaagattttccttctgagcgtccaggggtgactcttggcgtggcctgtgatttggcctctggttgggtgtgcctccatcctcctagggacagaattctgaacatcccaactacaggcccatttc

SEQ ID NO: 96659 - DNA, 394 bp, Homo sapiens
aactggcctctagccatgctcacagctgtctcaagacctttgcccttgctttcgcttctaccctttggaatgtaattcgtttacctgagggtcctgtgttttctgttgctgtatccccagaacacgtgagcacccagtaaatatgtgaatgaatgaaagaatgaatgaatatttcactagattctaagtttcccaaggacaaggatcatttgctgctcaattattagaatctaaagcaatgcctgggcacacagtaggagagtgtgtaaatgtctgtggaataaaagaaggaataatgggctgggcgtggtggctcacacctgtaatcccagcactttgggaaggccgaggtgggcagatcacttgaggtcaggagttcaacaccagcctggcc

SEQ ID NO: 96660 - DNA, 333 bp, Homo sapiens
ccaccacgcccggctaattttgtatttttagtagagggggtttcaccatgttggtcaggctggtctcaaactcctgacctcaagtggtcgcccgactcagcctcccaaagtgttgagattacaggtgtgagccactgcgctcggccccagtgggttctttctgcgggctgcccagatagagttgatttgtcagggcaggggagttgccatggagaaggtttagttcacgcagagccggttgaaagggagactagactagaggttttttttttttttttgaggcggagtctcactttgtcccccagggtggagtgcagtgatgagatctcagct

SEQ ID NO: 96661 - DNA, 559 bp, Homo sapiens
tgtcaactgcctgagctggagaagcccacttataaggaacgttgtcatgtgtctccaggggagccaggaccgtccgtggggttggctggcccttcacaatgtgaccccacttccatgggctccctctttcctcctgcacagccctggggtgcagggctccctctggaaggcaacagcttccagcgactcaaaggcctgcagggtcgtgtgatcccagcatcacaggtctacccatagaaccagcaattttatcagtagtattaattatcctctgcaaaaagagacactgaaaacaaagttccctttctcaaagaactctgatgagaaattaaaaaatatatttgaccttggaggattcgttgttttggaagccacagagacctgcctcatgcaactcaaaagaaggattacatctgtgatgtgtgggacgggcacgaggggcctctacaaccaatctaccctgtgtcttgacttctctgagagttgcattgggttcaacagtgattccatttcctcccaaagggccactgggagataagcagcatcgagcttatatcca

SEQ ID NO: 96662 - DNA, 391 bp, Homo sapiens
atccgctacactgatccccttatcaaggtgaatgataccattcagattgatttggagactggcaagattactgatttcatcaaattcgacactggtcacctgtgtatggtgactggaggtgctaacctgggaagaattggtgtgatcaccaacagagagaggcaccctggatcttttgacattgttcacatggaagatgccaatggcaacagctttgccactcaactttccaacatttttgttattggcaagggcaacaaactatggatttctcttccctgaggaaagggtatccgcctcaccattgctgaagagagagacaaaagactgccaaacagagcagtgggtgaaatggtcccagggtgacatgttagatctttgtacgtaattg

SEQ ID NO: 96663 - DNA, 424 bp, Homo sapiens
ggccatttgtaaaacccccaagggggactaaaatgacaggcttcaaatgacagttcttacaccatgtcctgaataggagcaaactgagaaagctcccaggccacaccatgcctgggagttccaaaagtgagtatcttatactttcacagacatgtcccaaaaatccaattaattcatctcatctaattaaaggagttcattggaaatgcaatatggtatttttatcgtgctgctgcttgaatctccaagtcagtgaactagaagaaagaaatttttattttgtggagaagatacaagaaaactttgggaaaagaaaggagaggatacactccccccaccccccaaaaaagccctttataaaacagccccttgatgcttggcagaaaacaatatacaccacatgctccagaaaaattcccagcaa

SEQ ID NO: 96664 - DNA, 452 bp, Homo sapiens
taaacccaaacccaacagaaggaaagaaacagcaaagaccagagcagaactaaataaaattgaaaccaaaaaaatacaaaagataaatgaaacaaaaagctggttatttgaaaagataaccaaaattgatatatcattagcgagattaaccaagaaaagaagatgatgcaaataagctcaattagaaaggaaacaggaaatatgacaaccgatatcacagaaatgcaaaagatcattcaaggctactatgaatacctttatgtgcacaaactataaaatctagaggaggtggataaattcctggaaatatacaaccctcctagaataaaccaggaagaaatagaaactctgaatagaccaataacaagcagtgagagtaaatcagtaataaaaaaattaccaagaaaaaatgtctaagaccatgtggattcacagctgaattctatcagaca

SEQ ID NO: 96665 - DNA, 112 bp, Homo sapiens
gagcccaggtctcggtgcctctgcatgggctgcaccttgtacaacactccccgctccaggttcatttctaaatacagaactccaaacccttaatttctagaatcccatctga

SEQ ID NO: 96666 - DNA, 130 bp, Homo sapiens
ttcaactagatatcagctgtatttactttagtgtctacctttaacacttttagcactattagaaatcaaaacaagtttcattacatagatgtgtgacgtgaggccaggtgcagtggctcacgcctgtaat

SEQ ID NO: 96667 - DNA, 458 bp, Homo sapiens
aagtgttcttatccaaaaaaactgcttggctgagagtaattcttctgtaaatgttagtcattatcattctgctaaaccacagaacatcagtttaggaatcactgggctgggcgcagtggctcacacctgtaatcacagcactttggaggctaaggagtttgagaccagcctggccaacatggcaagagcccatccctactaaagatacaaaaattagaatggtgtggtggcacgtgcctgtaattccagctactcaggagcctgaggcatgagaattgcttgaatccaggaggcagggattgtagtgagccgaaatcacgccactgtacaccaacctggcgacagagactctccgtctccaaaaaaaaacaaaaaactgttctttgaaaaagcttccttcccaccttaggggcttagcacaggcttggtgttctgtctggaatgttcttgtctcacac

SEQ ID NO: 96668 - DNA, 403 bp, Homo sapiens
ccgtcgcgctgactcttgaggatcccttcgactgtgggactcatgagtgtaggaacacggagaagggaacacgataaagtcacacatccacactgttgacaggggtttggcttccagggaacacacctctgtggcctcagggctatgtcctgaattctaaaacggggctctcacggctgacccgatgtcactgggtccccgtttgctgcttgagtctcttcggagcccagtgttgactcccgctcttcgtggctgccccggctatctggccatgaggagctgaccacgcacctggccggactcacatccgctccgctagggaagacctgggggcggaggtcggtctctgaccagccagcgtccctgcaggggactgcgagtaggaggcgggtattgcccacgc

SEQ ID NO: 96669 - DNA, 369 bp, Homo sapiens
tgtagtcctccttttttggagtgtcttttatttggttttggtattaaagtaatattggcttaagagaatgaattatggctaactctttctgcctttactctgcttctatttttctgaagaggttgtagagaattggtataatttcttctttgatgtctagtagaattcacaagcaaaatcatctggatctagtgctttcctttttggaaggttgttaacaattcctttagtagatataggcctactgagattatttctctttgtgtgggttttgctagcttgtgtctttcaaggaattggtctcttttatttaaggtataaaatgtgttggcataaagctgtttctagtcttcctttaatacttatgga

SEQ ID NO: 96670 - DNA, 518 bp, Homo sapiens
aaagccgggcatacaatggcaacctcagcccctccatgggcagcacctgctccctgggcctcccccagtggccccattatcctgcacctgctgaccaccgcccccccaacctgcttcccagcccaagctccctccccagggcaggccctgcccatcctcaggcccacctgccttctctgagagccagccaagagggctggggaaccaggagggatagcagggaaggccctgggcagggaccgagggtccagctgccaagccagctctgcctggccagcagtgtgtgtgcctgcaaaacaaggctttgctccaggacctcagtctgctcacctgaaaactgggagcatccaatcctgccttcagggtctgcaagggccagtttctctctgcttggagggagggctgaggccaggttgggaagagaacagacgggggtatcttgggtcatattttcagggccgcatctgttggaccacatggagacctgagtccttactgtacacttcagagtcactgct

SEQ ID NO: 96671 - DNA, 167 bp, Homo sapiens
tgtgtcttaattttttttcaattgttttcctcttttttcccccctctcctccgagtaaggagactgtctggttcccaggaggcagttgtttgtcttttttagtctagctttctttgaaacttactttctgttcatgcagtggtatgccgttcatgtttgttttctgg

SEQ ID NO: 96672 - DNA, 2857 bp, Homo sapiens
atttcaagggatccgtagactgaaagaattaattctaagctccaacaaaattacttatctgcacaataaaacatttcacccagttcccaatctccgcaatctggacctctcctacaataagcttcagacattgcaatctgaacaatttaaaggccttcggaaactcatcattttgcacttgagatctaactcactaaagactgtgcccataagagtttttcaagactgtcggaatcttgattttttggatttgggttacaatcgtcttcgaagcttgtcccgaaatgcatttgctggcctcttgaagttaaaggagctccacctggagcacaaccagttttccaagatcaactttgctcattttccacgtctcttcaacctccgctcaatttacttacaatggaacaggattcgctccattagccaaggtttgacatggacttggagttccttacacaacttggatttatcagggaatgacatccaaggaattgagccgggcacatttaaatgcctccccaatttacaaaaattgaatttggattccaacaagctcaccaatatctcacaggaaactgtcaatgcgtggatatcattaatatccatcacattgtctggaaatatgtgggaatgcagtcggagcatttgtcctttattttattggcttaagaatttcaaaggaaataaggaaagcaccatgatatgtgcgggacctaagcacatccagggtgaaaaggttagtgatgcagtggaaacatataatatctgttctgaagtccaggtggtcaacacagaaagatcacacctggtgccccaaactccccagaaacctctgattatccctagacctaccatcttcaaacctgacgtcacccaatccacctttgaaacaccaagcccttccccagggtttcagattcctggcgcagagcaagagtatgagcatgtttcatttcacaaaattattgccgggagtgtggctctctttctctcagtggccatgatcctcttggtgatctatgtgtcttggaaacgctacccagccagcatgaaacaactccagcaacactctcttatgaagaggcggcggaaaaaggccagagagtctgaaagacaaatgaattcccctttacaggagtattatgtggactacaagcctacaaactctgagaccatggatatatcggttaatggatctgggccctgcacatataccatctctggctccagggaatgtgaggtatgaaccatgatcctcctaaaagcatttctactgcggggaaggagaggtaaatgtttgaagccctagaggtgtctctaatcactagaaagattaatgacccttttgcttttgggttttgctcagtgtgaaaggttacttaattaaattacaaccaccaggaaattgactgctttttttttttttaaatggttgaaacttgaaggaagttcattcaaggataagttggaataaagcactatgttaaaacatctgctttttaacaatttgtatacaggggttggacttaaaaacacacatacaaacaaaactcttttcattctgaaatttctgtctggttcttggtgtttgactgttgtaatggagtaaagaagagggccagcttaatttaaaaataaagtgagtttaccaaaattccagaaggtaatgaagatttaaaccaaagagcaattttcccaagggttgattttgttgtaaatttttagttttaatgaaagcatgcaacagggatctcacacccatgttacttgccatttagttattataccagcatagagaatgtcagaggcctactgtgtaattgtatcaggctcctaaggcttctttcttttttttttttgtttccttctttcctactttctttcactccttcctttccttcctttctcttccttctttttttgtttgtttgtttgttttttaattactgggatatagatccgatttcaaaggtttttatgcactggctatttgtgtttaatcagaatgaaacttcaattccatgctttggctttgtccctggtaactaaaatcaggtcacaattttgtggatgatttagcaataataaaatggcagtcataacagggactgtttgtcagtattgctgtcatccccaaaagaaatgatatgtattcttgttaaacttattaaaaaataagtgatacaaatatttataaataaaaggagagaggtttgagttctgggtatcctccctttctgtaacagcctcaaataaaggtgtaccttccatgttatattatttttgtttttataagaataaatttggacccggtttctgattatttaatttaaaagatcacttacaggatcatgttagtgagcagacaaatagtcacaaatttcaaacttgtcaataagtaatgctggatgtaaattgttcttttcttggtaatgttgatcattatgtgcaaagactgactactaaggccttgttgctggaagaaactagtgaagagaggttaaattctggcaatataatgttttagtatctgattttagatgatcactctttcaaaagacagttttaatgagtaattaaagatgttgccctttctaatgctagttaacagttggaaaatataattgctctttgatagcatatactccaatttttccatagtcctaactacaaatgctaatgaaaatgttttctgacaaagcactgaatttgaaataatctctaactcagtacaatttggactattgaactgttcttcaaagaattcattttcttcttttttgtgtatcattgaaaataagagaagtaatcccagataataaattcctaaaaggaaactgtataagcaattgccctt

SEQ ID NO: 96673 - DNA, 2959 bp, Homo sapiens
atttcaagggatccgtagactgaaagaattaattctaagctccaacaaaattacttatctgcacaataaaacatttcacccagttcccaatctccgcaatctggacctctcctacaataagcttcagacattgcaatctgaacaatttaaaggccttcggaaactcatcattttgcacttgagatctaactcactaaagactgtgcccataagagtttttcaagactgtcggaatcttgattttttggatttgggttacaatcgtcttcgaagcttgtcccgaaatgcatttgctggcctcttgaagttaaaggagctccacctggagcacaaccagttttccaagatcaactttgctcattttccacgtctcttcaacctccgctcaatttacttacaatggaacaggattcgctccattagccaaggtttgacatggacttggagttccttacacaacttggatttatcagggaatgacatccaaggaattgagccgggcacatttaaatgcctccccaatttacaaaaattgaatttggattccaacaagctcaccaatatctcacaggaaactgtcaatgcgtggatatcattaatatccatcacattgtctggaaatatgtgggaatgcagtcggagcatttgtcctttattttattggcttaagaatttcaaaggaaataaggaaagcaccatgatatgtgcgggacctaagcacatccagggtgaaaaggttagtgatgcagtggaaacatataatatctgttctgaagtccaggtggtcaacacagaaagatcacacctggtgccccaaactccccagaaacctctgattatccctagacctaccatcttcaaacctgacgtcacccaatccacctttgaaacaccaagcccttccccagggtttcagattcctggcgcagagcaagagtatgagcatgtttcatttcacaaaattattgccgggagtgtggctctctttctctcagtggccatgatcctcttggtgatctatgtgtcttggaaacgctacccagccagcatgaaacaactccagcaacactctcttatgaagaggcggcggaaaaaggccagagagtctgaaagacaaatgaattcccctttacaggagtattatgtggactacaagcctacaaactctgagaccatggatatatcggttaatggatctgggccctgcacatataccatctctggctccagggaatgtgaggtatgaaccatgatcctcctaaaagcatttctactgcggggaaggagaggtaaatgtttgaagccctagaggtgtctctaatcactagaaagattaatgacccttttgcttttgggttttgctcagtgtgaaaggttacttaattaaattacaaccaccaggaaattgactgctttttttttttttaaatggttgaaacttgaaggaagttcattcaaggataagttggaataaagcactatgttaaaacatctgctttttaacaatttgtatacaggggttggacttaaaaacacacatacaaacaaaactcttttcattctgaaatttctgtctggttcttggtgtttgactgttgtaatggagtaaagaagagggccagcttaatttaaaaataaagtgagtttaccaaaattccagaaggtaatgaagatttaaaccaaagagcaattttcccaagggttgattttgttgtaaatttttagttttaatgaaagcatgcaacagggatctcacacccatgttacttgccatttagttattataccagcatagagaatgtcagaggcctactgtgtaattgtatcaggctcctaaggcttctttcttttttttttttgtttccttctttcctactttctttcactccttcctttccttcctttctcttccttctttttttgtttgtttgtttgttttttaattactgggatatagatccgatttcaaaggtttttatgcactggctatttgtgtttaatcagaatgaaacttcaattccatgctttggctttgtccctggtaactaaaatcaggtcacaattttgtggatgatttagcaataataaaatggcagtcataacagggactgtttgtcagtattgctgtcatccccaaaagaaatgatatgtattcttgttaaacttattaaaaaataagtgatacaaatatttataaataaaaggagagaggtttgagttctgggtatcctccctttctgtaacagcctcaaataaaggtgtaccttccatgttatattatttttgtttttataagaataaatttggacccggtttctgattatttaatttaaaagatcacttacaggatcatgttagtgagcagacaaatagtcacaaatttcaaacttgtcaataagtaatgctggatgtaaattgttcttttcttggtaatgttgatcattatgtgcaaagactgactactaaggccttgttgctggaagaaactagtgaagagaggttaaattctggcaatataatgttttagtatctgattttagatgatcactctttcaaaagacagttttaatgagtaattaaagatgttgccctttctaatgctagttaacagttggaaaatataattgctctttgatagcatatactccaatttttccatagtcctaactacaaatgctaatgaaaatgttttctgacaaagcactgaatttgaaataatctctaactcagtacattgggctatgacggtctcaagattcatctctcctttcggtttatgacatagagaggtatccgaaaaaaatgctaaggaagttagcatgccttaaattaagaatagattttagcaaaaaaagggggtaaataccggggccaggagggcagttgaaggccagagggaaaggaggggaaggggaagcgttggacttggatggcacaaggaagaggctgggtaaaaaag

SEQ ID NO: 96674 - DNA, 460 bp, Homo sapiens
gcaagaccctgtctctacaaaaaataaattacctgggcatggtggcactgcttgtagccctagctatgtgggaggcttaggtgggaggatcccttgagccccggagttcgaggctacagtgagccatgatcatgccactgcattctggcctgatcagcagagtgagactgtctcaaaaaagacatccctcaattttctcccatcacttctttgttagtacatctacagagtataatttaaagataaaaagagttaatgcgatagaatcagactcagcatatcctgatggtttagaatttcttttcttaccttggcctaacagattaactgatcaaagcagtttaatccataggaatatggattttgcctgcataataaaatccatgctatgttcttaaagaatattttgaacattacaacaaggactaatttgggttgaactttttagatttaaaaaaaa

SEQ ID NO: 96675 - DNA, 504 bp, Homo sapiens
tgaggagccaaatggtgccctgcccctcccaatttcagcccatgtgacagagctggcctcccctccttcttccccacctggcatggaaggcctcccagcccagcttctccctgctctgtccagcactggcactaccctggacaactcaaagagatcaaaatgacttccagatccctatctgtgagctcccatctctccttttaaagatcaattaaagtcttggcaatgattcaccttgcagtctggatggtggctttgatgtccgctccagacatgagacctctgtttttccaaatctagaaactgctaccaaatggtgagggtagggtccctccctggggccagagcagctcctgctttgcagagatgccagccccgaggtcttaccctttctggcagggggtgccaggtcctgactggggggcatggggaaacgggccatgaatatcaggaattccttccacaaaggacaactgggaaagcaatgcatctctgcttcccttg

SEQ ID NO: 96676 - DNA, 158 bp, Homo sapiens
tacaaggcacttccaggtagttgaggacatttaaagtcgccactggatgaggcctgcggaggtgctgacagtgagggctccagcaggtgagaggaggtggctcccagacactgcctcctgctcacaagaggcgacattggaacctggggagatagagg

SEQ ID NO: 96677 - DNA, 351 bp, Homo sapiens
caagtttctgaattcggataaagtattactcagttgcttatttaaaagagtcacttattctgaaagtattcttttggtttatatgcagtcagcctcttattttcaaaagtaaaaatctaaaattcttggaacctggcatcatcagctgtttctaacctcttggtcaccttgatgactcttagctgaaacccttccaagtcccgtggagtcccctgtgcagttctggaaagggattgacttatacagaagacaatggaggattgccccaaagagtgtccagaactgctgttggcccatggtcaggccaaattcagtcttttagagattaccacatctgatctcagtaggtag

SEQ ID NO: 96678 - DNA, 179 bp, Homo sapiens
agactgctgccttgctctgtaaaatctctgggaggaataggacttagaggtgatgggtatggcatgtggtaagagtaagacatgggactgaaaacagaagggttaactgaaagtttatatctggaagcattaatcctgtactctatttatgcaaaattccaacagccaagtacctcccc

SEQ ID NO: 96679 - DNA, 781 bp, Homo sapiens
  misc_feature (550)..(550): n is a, c, g, or t
agcggagtagtgaatcgtagcatgttagagttagaaggttcagtgttgatggagttattgaagaaatgatggagtaagagactcttttctaagcaactcaagtttgcagtgattcaggcctacttctgaagagacagccttttatctcaatgaatgacacagaaaaaccagcagatactccctctgaggaagaggactttggtgatccaaggacatatgacccagatttcaaggggcctgttgccaacaggagttgtacagatgttctgtgctgtatgatcttcctactgtgtattattggctacattgttttaggacttgtggcctgggtacatggggaccccagaagagcagcctatcctacagacagccagggccacttttgtggccagaagggcactcccaatgagaacaagaccatttcgttttactttaacctgttacgctgtaccagtccctccgtattgctaaacctacagtgccctaccacacagatctgtgtctccaagtgcccagaaaaatttttaacctatgtggaaatgcaactttngtacacaaaagacaaaagctactgggaagactaccgtcagttctgtaagaccactgctaagcctgtgaagtctctcacacagcttttactgggatgatgattgtccaacagcgatttttcccagcaaaccttttctccagagatgtttccctgacttctctaccaaaaaatggccactttaacaataggacagtacgatgatgttccacgatgcgcctggccggacccgaa

SEQ ID NO: 96680 - DNA, 939 bp, Homo sapiens
  misc_feature (708)..(708): n is a, c, g, or t
agcggagtagtgaatcgtagcatgttagagttagaaggttcagtgttgatggagttattgaagaaatgatggagtaagagactcttttctaagcaactcaagtttgcagtgattcaggcctacttctgaagagacagccttttatctcaatgaatgacacagggtctgagattactgacatgcttcctgctatacccggcactgattccaaatgggactgggtctgcagaaaaaccagcagatactccctctgaggaagaggactttggtgatccaaggacatatgacccagatttcaaggggcctgttgccaacagactaaactgggaactccgtgagagaaagcatctcatctgtgtggttcaccaacgtttcatagcatctgccacagtatccggcacaaaataggagttgtacagatgttctgtgctgtatgatcttcctactgtgtattattggctacattgttttaggacttgtggcctgggtacatggggaccccagaagagcagcctatcctacagacagccagggccacttttgtggccagaagggcactcccaatgagaacaagaccatttcgttttactttaacctgttacgctgtaccagtccctccgtattgctaaacctacagtgccctaccacacagatctgtgtctccaagtgcccagaaaaatttttaacctatgtggaaatgcaactttngtacacaaaagacaaaagctactgggaagactaccgtcagttctgtaagaccactgctaagcctgtgaagtctctcacacagcttttactgggatgatgattgtccaacagcgatttttcccagcaaaccttttctccagagatgtttccctgacttctctaccaaaaaatggccactttaacaataggacagtacgatgatgttccacgatgcgcctggccggacccgaa

SEQ ID NO: 96681 - DNA, 311 bp, Homo sapiens
ggccaggaggctgagaccgcagcaagaaagggagagtgtgatggcatcttcttcaagggagctggggatgtttggggtggaaaaaagaacaatggtctgggagggaatatgggaagtttttttttttttttttttttttttttttgagatggagtttcgctgttgtcatccaggctggattgcaatgttgcaatcttggctcactgcaacttctgccttccaggttcaagtgattctcctgtctcagcttcccgagtagctgagattacaggcacacaccaccacgcctggcttacttttgtatttttagt

SEQ ID NO: 96682 - DNA, 734 bp, Homo sapiens
agtagggactgtgacatatcactgggcctataacctaggtaatgtgactctccttttcttcctgtgttctgtcccagtgaagattatgacaaatttctgggccagtcaggtggtttggtgactctcaaaccatgattcagcagacctgtgaggctgtgagttccctatcagaacacaatctgcagatggagtcttgctctgttgcccaggctggaatgcaatgatgcaatctcagctcactgcaacctccatctcccagattcaagtggttctcctgcctcagcctcccaagtagttgggactacaggtgctgccttcaggagggattatgacatatgcctggaccaaacacctggatgacgtgacactcctgcatgagccttgccctaaggggatatttttacatgttggtgaactcagcatctaggtgatgtgactctactcttctgcctgggccctgcccacagagggcattggaacatttcacttggctcagcaccaagaagatgttactctcctacctggacctctcccacaggggacacctagatgatatgatttttcttcctggttcctgcccagacttcaaattgtgatgtatatctgggcccaaaacacaggtaaggtaataactctcatagctagaccaagacaatagagagattttgacttttgtagctaggcttagaacaatgggtacatattcctggcccagctcccaggtgatatgaccc

SEQ ID NO: 96683 - DNA, 781 bp, Homo sapiens
gtgggcacttcagcataggtttcgggtgctactgtgacatacagctcaaagcatcctaatacccctgagtctgagtaacatgttctcagaataggggctccatcaatcaatcatatcaacccattaacagcaagaggaaaatgatgaagtatatagccaagagaaaaactggattctgatgacagttgaaatgtgatgaagattctgtgaagcagagataatgtaagaaagatgcctgtgtggaaattaaatgtaaaaatgccaatggatggaaattttctccaaatgtactaggcctcccctataattttaaaatggagctaaaccactttatgatgggaatattactaggcatccatgcaggagaagtcttcccaaaaacagactactggttctgaaaatttggcatggtatcaatcatacacttctgaatcttcaagatccctccaatagtttttaaaatgtggctggctacatttgaagaatgtttgtttgccttcatagccagccattcttgttagattttggaaactcaataagctctgactgttcacaatttaatattttagtgacacatttttaggtttctaaatcagttttatgaggcatgcgataaaaataaaatcaaagtcggctgaacacttatggtgctcagtcaactctgaatatgacctgtagaaacacagcagaaacaaaacgacactaagtcatttttacttcaattttattaaaagaaagagaatgattaaaccagtggaaaacataacaagttattaattta

SEQ ID NO: 96684 - DNA, 1253 bp, Homo sapiens
catctgtgcatggatgagtggccgactttggagcccaggctgttacttcctggtctggtggtgaatcctccatagtctgagagtaagatccttgatactggctcagcatggaacatctggcacacagtatgcactgaggaaatacttgttggaataatcagtgaatcatagatgaaaacttaaccttggaattaattatgagactgctcagaggaagagaatgggagacaaaggacctggtgattagacccccaagacactgggctgtctgcttgtgtctcgggtggaacaggcccagcgagagtctttagggccagaactcaagaatttattgagcccttgttctaggcacttgggattcaccagtatacaatggagacaaaaatccctgccctggagcagcttacattctagcatggcaaacaggcagtaaacagcccattctggctgctgtattgagaagagaatgtggtggacagatatagaagcatggaaacctgatagggctattgcaatcactcagaaaagaggcgatggcagcttggacctgttggaagcagtagagtgcttccagggaggagaaaggacctgaaggttaatttgatcaccaatggccaatgatgtaatcagttatgcctatgtaatgaagcttccgtaaaaaccaaaaggattgggtttgattgagcttctggatagctaaacatgtggaagttcctggaggatggtggtcctaaacagggttaccagaaaatttaaagttacgccagtcactcccattctattgctgagagaaaatacagagcggtgaagagcttacagtcggaccgcgctgcacgccggcggcagccatggcggatgtgtcagagaggacactgcagttgtccgtgctagtagccttcgcttctggagtactcctgggctggcaggcgaaccgactgcggaggcgctacttggactggaggaaaaggaggctgcaggacaagctggcggcgacgcagaagaagctggacctggcctgagactctgcgccttccgccccattctgtccccctcatggccaccttgccatgtccgcgccggagccccggtccgccggcgcccagaaccaggcttgccacacagtccccgcctgccatggccggctcttcctggagtgttgcttgttgaagatgcatatagactaccggaaagaaatgacttcttcttgcactttatgaatcaattttatttttaaaataaaaaaattaaacatc

SEQ ID NO: 96685 - DNA, 1670 bp, Homo sapiens
catctgtgcatggatgagtggccgactttggagcccaggctgttacttcctggtctggtggtgaatcctccatagtctgagagtaagatccttgatactggctcagcatggaacatctggcacacagtatgcactgaggaaatacttgttggaataatcagtgaatcatagatgaaaacttaaccttggaattaattatgagactgctcagaggaagagaatgggagacaaaggacctggtgattagacccccaagacactgggctgtctgcttgtgtctcgggtggaacaggcccagcgagagtctttagggccagaactcaagaatttattgagcccttgttctaggcacttgggattcaccagtatacaatggagacaaaaatccctgccctggagcagcttacattctagcatggcaaacaggcagtaaacagcccattctggctgctgtattgagaagagaatgtggtggacagatatagaagcatggaaacctgatagggctattgcaatcactcagaaaagaggcgatggcagcttggacctgttggaagcagtagagtgcttccagggaggagaaaggacctgaaggttaatttgatcaccaatggccaatgatgtaatcagttatgcctatgtaatgaagcttccgtaaaaaccaaaaggattgggtttgattgagcttctggatagctaaacatgtggaagttcctggaggatggtggtcctaaacagggttaccagaaaatttaaagttacgccagtcactcccattctattgctgagagaaaatacagagcggtgaagagcttacagtcggaccgcgctgcacgccggcggcagccatggcggatgtgtcagagaggacactgcagttgtccgtgctagtagccttcgcttctggagtactcctgggctggcaggcgaaccgactgcggaggcgctacttggactggaggaaaaggaggctgcaggacaagctggcggcgacgcagaagaagctggacctggcctgagactctgcgccttccgccccattctgtccccctcatggccaccttgccatgtccgcgccggagccccggtccgccggcgcccagaaccaggcttgccacacagtccccgcctgccatggccggctcttcctggagtgttgcttgttgaagatgcatatagactaccggaaagaaatgacttcttcttgcactttatgaatcaattttatttttaaaataaaaaaattaaacatcaaaaaaaaaaaaaaaaacaaaaaaaaaaaaaaggaaaaaagaaaaaaaaaaaaaaaaagaaacaagacaaaaacagagagcggcaaaaaaagaacacagagaggagacacacaaagacgaacaaaccacgagaaagagcgaccaagaagcgcacaaaaaaaagaaaagaggaggcacagaaacaaccgcgaggaaaaagaacaacagcagaccgagagcgcccggagcgggaaaacacacacgaagtgaggacagagaagacgacagccggacacaaacaaaaagaaaggaaaagagacacgagcggagggcgacacaaaaaacaaaagacagaacaaacgacgcgaagacacccgagacaaaagcgaccaggagagagaagcgaacgagcgcccaccccgacaacacaagacaaga

SEQ ID NO: 96686 - DNA, 1081 bp, Homo sapiens
catctgtgcatggatgagtggccgactttggagcccaggctgttacttcctggtctggtggtgaatcctccatagtctgagagtaagatccttgatactggctcagcatggaacatctggcacacagtatgcactgaggaaatacttgttggaataatcagtgaatcatagatgaaaacttaaccttggaattaattatgagactgctcagaggaagagaatgggagacaaaggacctggtgattagacccccaagacactgggctgtctgcttgtgtctcgggtggaacaggcccagcgagagtctttagggccagaactcaagaatttattgagcccttgttctaggcacttgggattcaccagtatacaatggagacaaaaatccctgccctggagcagcttacattctagcatggcaaacaggcagtaaacagcccattctggctgctgtattgagaagagaatgtggtggacagatatagaagcatggaaacctgatagggctattgcaatcactcagaaaagaggcgatggcagcttggacctgttggaagcagtagagtggttaccagaaaatttaaagttacgccagtcactcccattctattgctgagagaaaatacagagcggtgaagagcttacagtcggaccgcgctgcacgccggcggcagccatggcggatgtgtcagagaggacactgcagttgtccgtgctagtagccttcgcttctggagtactcctgggctggcaggcgaaccgactgcggaggcgctacttggactggaggaaaaggaggctgcaggacaagctggcggcgacgcagaagaagctggacctggcctgagactctgcgccttccgccccattctgtccccctcatggccaccttgccatgtccgcgccggagccccggtccgccggcgcccagaaccaggcttgccacacagtccccgcctgccatggccggctcttcctggagtgttgcttgttgaagatgcatatagactaccggaaagaaatgacttcttcttgcactttatgaatcaattttatttttaaaataaaaaaattaaacatc

SEQ ID NO: 96687 - DNA, 1218 bp, Homo sapiens
catctgtgcatggatgagtggccgactttggagcccaggctgttacttcctggtctggtggtgaatcctccatagtctgagagtaagatccttgatactggctcagcatggaacatctggcacacagtatgcactgaggaaatacttgttggaataatcagtgaatcatagatgaaaacttaaccttggaattaattatgagactgctcagaggaagagaatgggagacaaaggacctggtgattagacccccaagacactgggctgtctgcttgtgtctcgggtggaacaggcccagcgagagtctttagggccagaactcaagaatttattgagcccttgttctaggcacttgggattcaccagtatacaatggagacaaaaatccctgccctggagcagcttacattctagcatggcaaacaggcagtaaacagcccattctggctgctgtattgagaagagaatgtggtggacagatatagaagcatggaaacctgatagggctattgcaatcactcagaaaagaggcgatggcagcttggacctgttggaagcagtagagtgcttccagggaggagaaaggacctgaaggttaatttgatcaccaatggccaatgatgtaatcagttatgcctatgtaatgaagcttccgtaaaaaccaaaaggattgggtttgattgagcttctggatagctaaacatgtggaagttcctggaggatggtggtcctaaacagggttaccagaaaatttaaagttacgccagtcactcccattctattgctgagagaaaatacagagcggtgaagagcttacagtcggaccgcgctgcacgccggcggcagccatggcggatgtgtcagagaggacactgcagttgtccgtgctagtagccttcgcttctggagtactcctgggctggcaggcgaaccgactgcggaggcgctacttggactggaggaaaaggaggctgcaggacaagctggcggcgacgcagaagaagctggacctggcctgagactctgcgccttccgccccattctgagccccggtccgccggcgcccagaaccaggcttgccacacagtccccgcctgccatggccggctcttcctggagtgttgcttgttgaagatgcatatagactaccggaaagaaatgacttcttcttgcactttatgaatcaattttatttttaaaataaaaaaattaaacatc

SEQ ID NO: 96688 - DNA, 745 bp, Homo sapiens
catctgtgcatggatgagtggccgactttggagcccaggctgttacttcctggtctggtggtgaatcctccatagtctgagagtaagatccttgatactggctcagcatggaacatctggcacacagtatgcactgaggaaatacttgttggaataatcagtgaatcatagatgaaaacttaaccttggaattaattatgagactgctcagaggaagagaatgggagacaaaggacctggtgattagacccccaagacactgggctgtctgcttgtgtctcgggtggaacaggcccagcgagagtctttagggccagaactcaagaatttattgagcccttgttctaggcacttgggattcaccagtatacaatggagacaaaaatccctgccctggagcagcttacattctagcatggcaaacaggcagtaaacagcccattctggctgctgtattgagaagagaatgtggtggacagatatagaagcatggaaacctgatagggctattgcaatcactcagaaaagaggcgatggcagcttggacctgttggaagcagtagagtggttaccagaaaatttaaagttacgccagtcactcccattctattgctgagagaaaatacagagcggtgaagagcttacagtcggcttgttgaagatgcatatagactaccggaaagaaatgacttcttcttgcactttatgaatcaattttatttttaaaataaaaaaattaaacatc

SEQ ID NO: 96689 - DNA, 701 bp, Homo sapiens
catctgtgcatggatgagtggccgactttggagcccaggctgttacttcctggtctggtggtgaatcctccatagtctgagagtaagatccttgatactggctcagcatggaacatctggcacacagtatgcactgaggaaatacttgttggaataatcagtgaatcatagatgaaaacttaaccttggaattaattatgagactgctcagaggaagagaatgggagacaaaggacctggtgattagacccccaagacactgggctgtctgcttgtgtctcgggtggaacaggcccagcgagagtctttagggccagaactcaagaatttattgaggcccattctggctgctgtattgagaagagaatgtggtggacagatatagaagcatggaaacctgatagggctattgcaatcactcagaaaagaggcgatggcagcttggacctgttggaagcagtagagtgcttccagggaggagaaaggacctgaaggttaatttgatcaccaatggccaatgatgtaatcagttatgcctatgtaatgaagcttccgtaaaaaccaaaaggattgggtttgattgagcttctggatagctaaacatgtggaagttcctggaggatggtggtcctaaacagggtatggaagctccatgccctttcctatatgccttacactatccatctattccacctggctgt

SEQ ID NO: 96690 - DNA, 920 bp, Homo sapiens
atttcacttatctttagagacacatttatatcagaaaatttaacttgatgattaaaaaaattggtgaaatacgtgtagacttttgtaactggattatagtttcatctaagaactcactaaaaatatattgaacttcaggaagagatttttaaatggctttggtaagccatttaaaagccttattttcccaaacgaattagtgttggtgtgtggatgaggaactttgctgttattctgtgagcattacctgataagaactaatcagatgacagatggaatctgaagcttgttctgatgaatttttgaggctggaatgcaatggcgtgattatagctcaatgcatcttcatctccctgggctcaagcaatcttccaagctcagcctcccaagtagctggaactacaggtaggaccaactccactttgaactaggtcctgttgaaaaggctgttcataaaccttaccagccagtagctcctgtcctttcttgatggatgcagaagatgaaacatcctggctagaaaacaaaatggccatgattttgaagagatgaagtttcaggacaactctgcactctgaaacattctgaaacagaaatggaaggtgtgtgtgctgcatcagagcaatgagctagagcaacattagagaattagcaacatagagaagtgaggtgaggtgtaaaggaaggacagtcatctttgatcagctgttcttggcccaaacctgccatatcctaacctctggttttcataaatgtgtgaagtttgaaggcattttggcaaaaatctcaactcccgtaatcacatgaaatgctgtttcttctccaagggcaggaaattcaaaggctacatatgtagggttgcccagtgggaatctgagactctagaaactacatcctgcttttgcatatatcaagattat

SEQ ID NO: 96691 - DNA, 590 bp, Homo sapiens
ccatccttctaccctctatctccatgagtttacttgtcttagtattttagctcccagaaataagtgagaacatactaagtctgtctttctgtgcctggcttatttcacttaacataatgatttcaggttctaactatgttgttgcaaatgacaggatctcattcttctatatggctgaatagtactccattgtatatatgtgtcacattttctttatccattcatgtgttgacagacacttaggttgcttccaaatttatggtaacttctattttttgataaatgactataattattattaacacattttctacaaattttctatttcattttaacacaataacagattaaacctttgtgggttagcctggaaacttagccatcgtgaataaaaccactctatgggggaaaaaaatctgagctgtaaaaaattaaactaaaactaatttatagattctatttggagatgcttgccaattcctgaggaaacaacagatagactgagtgggatgttactgatagcctccagggatcatgcggataagaaatacagtctaaagtccaccaaggttgagtacctcaggagcctt

SEQ ID NO: 96692 - DNA, 524 bp, Homo sapiens
tacacacggtcatcagcttggcccacaaaggggacttcgtcaccacctggggagcctccgtggtggctactaactcaggagtcctgcctcccagacccccagattctcccaggaatgtccccttggctcttggtcatgtctgggggatcctggctcccagctagaatttggttcacggtcatcttcccttcttccatggttctttgtgaagaaggatccaggagggcttgagataaagaatgtgagggccagcgtggtggctcacacctgtaatcccagcactttgagaggctgaggcgggcggatcacctgaggtcaggagctcaagaccagcctagccaacatggtaaaaccccatctctactaaaaatacaaaaatttagctgggcatggtgtaatccccgctactcgggaggctgaggcaggagaatcacttgaacccgggaggcagaagctgcagtgagctgagatcatgccactgcactccaacctgggcgacggagtgagactccgtctcaaaaaaa

SEQ ID NO: 96693 - DNA, 464 bp, Homo sapiens
gcttatacagtattcaattcactgaaaaataatgtggttgtgtaaacactcagaaggaagtgtggtgtgaccggtgatcacagcttctgccagaatatctagaacaggatgcattctgcgatgaaagagatgactacaatagctgtagctatttattttataaaaaaaaattcttagccctagttcatggcctacttcttccaagcagtacaggtcaagcatccctaatctgaaaagctccaaaatgtgaaactttttgagcaccaacatcatgccacaagtgaaaaatgccacactcgggtacttaacacaaagtttgcttcaggtgcaaaattatttaaaatattgtataaaattaccttcaagctatgtgtaaaggggtgtctgtgaaacataaataaactttatgtttagacttgggtttcatccccaaaatatctcagtgtgcatgtacaaatattcca

SEQ ID NO: 96694 - DNA, 247 bp, Homo sapiens
gaataaaactaggtttcaaaatagaacagctgtaaaactatagcttaaaaagccaggaaagaatcttaagtacatgccgaaaagaaaaataattcactctattcaggatctctggttaactggaatttagaaactatttgattaaattgtatgcaaaagagtaaatcgctaagtagctttcttcagttcaaagtttgtgtataatttttgaaactgtagaggtaataaaacagaaaacacttgaaaa

SEQ ID NO: 96695 - DNA, 300 bp, Homo sapiens
ttgtttttaaaaatctctttggctgggtgtggttgctcacacgtgtgggaggctgaggtggaaggatcacttgaacctaggagtttgagaccagcctggcaacacagtgagaccccatctctataaacaaacaaatgaacaaatcactttgaagtgtgttccagttggttgcctgtctttaccctctagttgttttactagtgtctttgaccgtataattttcattgttttaaatttcaaacctgtatctattatgctaacctaatctcgaaatatttctaatgccattttctttctact

SEQ ID NO: 96696 - DNA, 244 bp, Homo sapiens
aacagctctccactcacccagagaagtaacctgaatccaacttgatactatcaaacctgatggactctcagcttggtcctatacaacttcaaatggaaaacaagctgccatattaatactatgaaactaaataatccctacattatatgcaaaaatgaattcaaaatgaatcaaagacccaaatgtaaaagccagaattattatatttttggaaaaaaacttagatgcaaatctccatcacccc

SEQ ID NO: 96697 - DNA, 230 bp, Homo sapiens
agttgttttatttagaaggtagtattgtacatgggctaggcctttttatgtgatgaaggcagaaaaaagtttattaagaggcatttttatggaaatagaaaagcaaatattaatgttggaaactatttggatgttaaagtacttttagttatagaggaggaaggcagtagtaatttgacgttttctttgtctgtgttataaggaataagctttagtttgtaaagcctcag

SEQ ID NO: 96698 - DNA, 115 bp, Homo sapiens
ggtcgtctctgaggatcccccattgagcccctgatgctattaactgagatgggaatgactgtggaggaagcagattggagattgggcatgttatgttttgaaatgcctgttagac

SEQ ID NO: 96699 - DNA, 409 bp, Homo sapiens
gtatagaaccacaaaggagtcaaataaagactatataaaggattcaatgaggaaaaataaaattggcaaaagacaggcatttctcaaaaatgttttcagttcaccaataacatagaaaagtgctgaaatcaaggaaaaattcaaattgaacccacaatgagataccccctactcactcaccagaatggctaagttaaaaaggtcaacaacatcaagtgtttgtgaggatgtggaagaacaggaaatctgataccctacatgtagtccatgtaggactataaattgatagcactttgaaaaactgtttagtaatatctaccaaagttggaagatactcatcccctaagacctaggcaacaggttccaagactgttgatagtgcaattattcataatacctaaaaactgga

SEQ ID NO: 96700 - DNA, 754 bp, Homo sapiens
acgcccggctaattttatgtatttttagtagagacagggtttcaccatctctatctcctgacctcttgatctgcccgcctccgcctcccaaagtgctgggattacaggcgtgagccacagcgcccggcccaaaaatccattcttaatggctttctcttctgatgcaaaatcctgattgccttcaaatattactattagatagaaatctccccacctttagctgaaagagataaggaggttttgcactgaggaaacaaacaaacaaacaagcaaacaacattcatcaatttttaaaaaaagtatgtattgaactatagtcaggttcaatgaggaaatgcattacattgtcactaaactggccttagttggagaaagaacactggcagattaattaaagttattagcgcttatggtaggaaactgcatgatatatgtgaaagatcttttagggactggaaacacagtgtaaattcaaactcctcccaaaactttaacaaggctggatgaaatgaaaggaatactgtgatttctacaattgacaacagtgtcaggcatgcaggaaacaaacaaaaccttttgatgaaggaaaagtaacttctggacaaagtataattggttacaggtaaacagatatgtcatccaggcagatatgacagtttataggaaaaatataatgttatgatctaaaaaatgcaagccacaaacctattgcctgggcaataattagcctgaagttgggctactaaggagctgg

SEQ ID NO: 96701 - DNA, 183 bp, Homo sapiens
tagctgggattacaggcatgcgccaccaggcccggaaggatggagagttatatctaactgtctcaggcagcagcccagtaggccagggagttcagtccagggcatacccactgtcttcatggggctggatcagcactgggccacaccccagctggcactgcccaggagcacagggtgcagtct

SEQ ID NO: 96702 - DNA, 396 bp, Homo sapiens
aaataagtataaataagaataactgcattgaaaaaaaaggcaaacaggatagattccatcactgaaccatcaaatgattccatttgaaccatcaatgaacttctggaagatgctatgcagacagaatcagattgaaggcgaaatccatgagaccaagaagtcccaaaacacaacccagtggaaagaggaaatgacaccgttctcctcccttatgaaagggaggtgatgtggagtaaacaccagccccaacatatgatgacacaatctaaatcttcaaaatattaacttgatttccagaaggggaagcagatgtattttgttttctcctcagtccttctgtgattctacaagttgagcaatatctacatgtgaaaatgactttgactgtttctttta

SEQ ID NO: 96703 - DNA, 281 bp, Homo sapiens
gaccaggcctgaactctattcaagaaagctgcctgccagtttatagcaggggttagcaaaccttttccatgaagagccagttaggaaatgtttgaggctttgcagaacatgtggtctcttgcaactactcaactcactaaagcaacaatggacaacacatccgtgaagaagcatggccgtgttctggtaaaacaaaacttggctgcagtttgcccatgcccagcctagagtttgtagcctcttcccagagagagggaatctgacagattcccaaatctgtc

SEQ ID NO: 96704 - DNA, 722 bp, Homo sapiens
gaatgtaaaaatgaatggggaaaatggtgcaaggagtcatggaacaagaattttgcagaaaaaacatatatggccagtcatcacataaaaaacatgtatgttgaagaagctgtagagctacaatatctctgatacattgctgctggcaaaagttgtaaattggtacaacactcgggaaaacagtttggctttccaccaggcgtggtggctcacgcctgtaatcccagcactttgggaggccaaggccggtggaacacctgaggtcaggagttcgagaccagcctggccaacctggtgaaaccctgtctctactaaaaatataaaaattagccaggcgtggtggcacacacctgtaatcccagctactcggaaagctgaggcaggaaaagtgcttgaacctgggaagtggaggttgcagtgtccgagatggtgccactgcactccagcctggacgacgagtgaaattctgtccccccacaaaaaaagatgaacaatcacatagtcataacccagtaattctacttgtaaaaatatactcgagaaattcttgcaaatgtacaacaggacttatgcatgagactattccaataacaaaaacttggaaacaacacaaatttattgaatgaataactgtggtacattcgcatgaaggaatatatacagtagctaaaactaaaccccagtaacatgaagcaacgtaggtaaatcttagcaatataaga

SEQ ID NO: 96705 - DNA, 405 bp, Homo sapiens
tttaagcatatgggttgctgccaaagattaaaatcattctgtgcttaatatcattctctttctttgtgttcctctgaggtttcgtattttcttttggcagagaaataaaaaggttgaagccagagatcccaaattcccaatagtatctttctatcatttcatactgtgttggtgagcattttccactagggtttctatcactgtctttaaagactagtgccctccctttcaacagtccagggaacaaatctgcacaaaggtagttcttaaaaactattaacaaactgaactgagaagggaatttgtcccagacagtgctccccacagctggacagagcgtgattttcaccaaaacagagtataattcacaggcagcaccagagataggcagggatggggccctct

SEQ ID NO: 96706 - DNA, 172 bp, Homo sapiens
atgcaaagggaagatgaaaaaaggagctaatgatcattctacatttacttgtgtctacgggcaccttatgaaaattacttttagacagatgctatgtctttcccctaaactagtggttctacaacattacagaatgccctggaaggcttgctaacatacagatggctgggac

SEQ ID NO: 96707 - DNA, 472 bp, Homo sapiens
ggtatctgtggatgcccacgtgttcagttctcctttactgactggacttggcgggtgaccaggctgggggacttggttaaaataatgaaactcaggaatccctggccagggaaggcattttcgaggtcatgtggttcccgggtctatgtgtctcttccacaggttgactgctgtatgcagggtcttcaacacatggtctttataatagtattccattgttcctggctctgcgcttggcggggtgtggagctaatgcacccccacccctggttctctgacagcttaaagtctggtgggagagactgagggagaacctgcatgcaccctgaaatgttctgtagagacatgtgataagtctgtgcaagaaggtgttgtgacaggaggagtcatttccaccaagtggaaggggctagccagaaaggcatctggaggagggacacacccaaggcttgaaagaagaaataggtggcaa

SEQ ID NO: 96708 - DNA, 522 bp, Homo sapiens
agaaatttaagaaattcacaggtcaaaagcaaaatgaatacagaaacccagagagataaggtaggactcaagctgccttttccagggatttgtgcaaaatcctctttctttaccctgagctcaatttgcacattgagggaggtgacaaagtctaaagcctaccgaagaatctaatgatacctctgttgtaaagagatctgtacccaaatggctttaccagcacgtttggggtgaactagaaataaacctgtctcacaaaaggggacaacaagaaacactgacagaaacaactttctctaggccatgggacagcaaactataacccctgggccagatctgcctactgcctgtttttgtacaacccatgagctaagaatggtatatatatctggagtgcagtggcgcgatctccactcactgcaagctccgcctcccgggttcacgccattcttctgcctcagcctccccagtagctggtacgacaggcgcctgccaccacgcccggctaagttttttgtattt

SEQ ID NO: 96709 - DNA, 387 bp, Homo sapiens
agaaatttaagaaattcacaggtcaaaagcaaaatgaatacagaaacccagagagataaggtaggactcaagctgccttttccagggatttgtgcaaaatcctctttctttaccctgagctcaatttgcacattgagggaggtgacaaagtctaaagcctaccgaagaatctaatgatacctctgttgtaaagagatctgtacccaaatggctttaccagcacgtttggggtgaactagaaataaacctgtctcacaaaaggggacaacaagaaacactgacagaaacaactttctctaggccatgggacagcaaactataacccctgggccagatctgcctactgcactccagcctgggcaacaaagcgagactccgtctcaaata

SEQ ID NO: 96710 - DNA, 833 bp, Homo sapiens
cactttgtcaggctaacaaacccaaacaaagccaacagccagaagttaaaataaacagatcattaggttgaaaatagaactgtcaaaacaggcccaattgacttcatttagtgattgcaaagaacatcaggcaagacacaggtatgctcatcataacatttatcacatgcttaattgcacatgtttgactaagaaaaacacaaagtatttaagctcatctgtagttcaaagtgcctatccatgtatttatctattcatcctgatgtatttattgagcaactcttttgtgccaggcactgtgctgtgttgcgggaagtcagggaccccaaacggagggaccagctgaagccatgacagaagaacgtggattatgaagattttatggacatttattagttccccaaattaatacttttgtaatttcttatgcctgcctttactgcaatctctaaacataaattgtaaagatttcatggacacttatcacttccccaatcaatacccttgtgatttcctatgcctgtcattactttaatctcttaatcctgtcagtcgagaaggatgtatatcgtctcaggacctgtaataattgcgttaagtacacaaattgtacagcatgtgtgtttgagcaatatgaaatgtgggcaccctgaaaaaagaaccggataacagcaattgttcagggaataagagagataaccttaaactctgaccgcccggtgagccgggcagaacagaaccatatttctcttctttcaaaagcaaatgggagaaatatcgttgaattccttttctcagcatggaacgtccctgagaaagagaatgcgcaccta

SEQ ID NO: 96711 - DNA, 477 bp, Homo sapiens
ttccggccgatcgaggtttattggtcacggtgctgcaagccgtacaggaagtatggaggcatctgcttctggggaggcctcgggaagcttccagtcatggcagaaggtgaagggggagcaggtgtctcacacggcgagagcgggggcaagagcgcgaggtgggaggtgtgccaccggatctcacgagaactcactcactatcgtgagaacagcaccaaggggatagcgctgagctgttcatataaatccaccctcaagatccagtcgcttcccaccaggccccacttccaacgacggggtgacagttcgacaggagattggtggggagaccccaactcctcaacattgcttctactgtttgctatttgctcactcagccactggccacaggtgctgctgcagtagacacgtctgttcatcgccttcacctacggttcaaagctagaagctctggttgcacggcaagcccctcctttc

SEQ ID NO: 96712 - DNA, 476 bp, Homo sapiens
catattttaaagtgggtgtgcttttgcagcgtcgcatagtctgcttgggacacgtgtgtacatatgtgggcatcagtgtctgtgtttgtcagatgacatgacttgtatttcctgttttctccatatcgcgatctcttccggaggcttcttccccctcaaccctccacattccccatggtctgctcatatctagactccccccagcccttagcccctgtgggtgtccctgctgggggtcctggcacctgtatcctctaggttcccaaacttgtgctcggtggttccactttcttgccagccactgctcctgctgctgcttccttcctgatgtccctggaatccactgactcttttcagttgtgacttcctggtgcctgggacctataaggccctgactagaaatgttctggtctctacttcccttccagccttcttgagcacagagggtagatcattctttccacaagacacctttg

SEQ ID NO: 96713 - DNA, 454 bp, Homo sapiens
gagactaagtcttgctgtcgcccaggctggagtgcagtggcgcgatctcggctcactgcaggctccgccccccggggttcacgccattcttctgcctcagcctcctgagtagttgggactacaggcacccgccacctcgcccggctaattttttgtatttttagtagagacggggtttcactgtgttagccaggatggtctcgatctcctgacctcgtgatccacccgcctcagcctcccaaagtgctgggattacaggcgtgagccaccgcgtccggcctccaaaaatagttttgtcttaacatatgatcccgcaattgcactgctaggtatttagccaattgaatttaaaagctgtctacacaaaaacacgcacatgaatcttcatagccactttactaataattgccaaaaactggaagcaaccaagatgttcttctatagatgagcagat

SEQ ID NO: 96714 - DNA, 192 bp, Homo sapiens
ctcgaactcctggtctcaagccatcctcccgcctcagcctcaggactacaggcgtgtgccaccgtgcaggctataatgttgaaatttttaaactcttcctccatcctgcttaatcattaggcattctgaatgaggtcctctgataactgacaagatcgattcagtgtgcctaccccagaagtagtgaaacta

SEQ ID NO: 96715 - DNA, 302 bp, Homo sapiens
gcttagacccaggtgtcagatggtcttcaggaaattatttggacaagggtgatgataaatcaccttccattctgtttgggccataatccctggaacccatggtgggcatatttgaaatgatttgacttaaatgtttaaagctttagtctttcattgggtaatgtcttagagaagacaatttcttagtaatatgaattgttcccaaactgaagtccatcccctttttaggaaactggcagcccaatccaggccctcctgctcccctttggagggtctttgttcctccttgagttagcaatttt

SEQ ID NO: 96716 - DNA, 270 bp, Homo sapiens
acttttgtactccttagcacgctctttcattccttatagtagttaagagtaggtcttactagttaacaattcttcacatgaaatgttcacactactggcaatgtttctctcctggttgatacagtgtttatagcaacatgttttataatagaaacatattgaaaagaataaagtattcctcaacattagaatatataattaaactgcgctatacatatgtaaaatgacgtatatagcaatgaaaatgtaaaaaccacaaccatatacata

SEQ ID NO: 96717 - DNA, 262 bp, Homo sapiens
aggtctcactatactgcccaggctgttctcaaactcccaggctcaagcaatcctcccagctgggcctcccaaagtaatgggattgcaggtgttagccactacacctggcttgatattctattataaggggattactgcattgtaataacaggaaaaaatttccaaatcaggagaagtctggttaaaacatcttgcaataaactttgattattcatcattagataccataatcaaagcctcacttagttatgggccattagac

SEQ ID NO: 96718 - DNA, 278 bp, Homo sapiens
gtagagacggggttttaccatgttggtcaggctggtctcgaacttgtgacctcgttatccgcccacctcggcctcctaaagtgctgggattacaggcgtgagccaccgtgcccggccaggcaaattatatgtacaggcaattcataaaagtcatatggatgtccaatatatagaaagaagttgctgacaccaattattatcagtgcaaataaatagagtggggaagaattctttcacctatcagattggcgaaaattaaaaagatcagtaacggtatg

SEQ ID NO: 96719 - DNA, 400 bp, Homo sapiens
cagcacagaaaaagcctagatttccttgaacacattagtaaaactacggatgttaaaagactctacttgtgaggtctcagaaggaagaggggagcatagcaggaaaaaaaaccattgcctgggagaacacctaactgggcacgaacactgctggcactgctggggagggtgcagaaggatgtcacgagcatgggattggaaactggagcaaagtggatcctgtaacacagtggtagaaagcttggctgaatcgcgtcctgcagttatgtgaaaagcagagcttctaaacactgaaactggacccagctgaggacatttcccagcacagtgttgaaggcaaggcccggtttctcctgctgcttcctcctccagagcaggacaggcccgagggcagtgttaa

SEQ ID NO: 96720 - DNA, 399 bp, Homo sapiens
ctagagtttgttgctggctgttgttgctgctgtttatttagtaacttttctgaacaaattcttaaactctgtgttctctgtcatgtggcccctgaaatctctgctcagttagctagtggtcagctgattagacagagagttccttaaatgcctagaacaaccaagtctcctggtcttttccaaagagcaaagggctcttgtgtctttaggggcacactttccacactcagctaggcagtttactaccctgccttaggcattgcttcctgcttgcatagagcctcaaggtcagctgttaagcgatagcttagtgactttctgggtttttcccttgcacagcgctatgcatgtgcattgccttctagatttctaggaatatgctggagcttttcttttctt

SEQ ID NO: 96721 - DNA, 516 bp, Homo sapiens
tgagatggtgttggcattctgtcttttttattaccaagattcactggtatcaatgatttgggcatattctgcaagtgagtgatttaaattcatggttaatcatagcatcatgaaattttgttacaatgagaaatattcattgtcttctaatccagggatcaacagacaatggccttaatccagaactagccaaccacctatttttgttcggcgtggagctaagaataatttttaaggcagggcgcagtggctcacgcctgtaatcccagcactttgggagaccgaggcgggtggatcaggagggcaggagatctagaccatcttggctaacacggtgaaaccccgtctctgctaaaaatacaaaaaaattagccgggtgtggtggcgggcgcctgtagtcccagttactccggaggctgaggcaggagaatggtgtgaacccgggaggcggagcttgcagtgagccgagatcgcgccattgcgctcctgcctgcgcgacagagcgagactctatct

SEQ ID NO: 96722 - DNA, 345 bp, Homo sapiens
ctctttcccagcacacacaatccagttgtcaataaattttagtagtttttttctctgaaataataattttttgtcccccccacccttaagaatgtgtgcctatttgaaaatggcagaaaagcatgaagaaaatgtcgtcttttttattttttgagaaggagtctcgctctgctgcccaggctggagtgcattggtgcaacctcggctcactgcaatctccgcgtcccgggttcatgccattctcctgcctcagcatcctgagtagctgggactacaggtgcccgccaccatgccctgctaattttttgtatttttagtagagacggggtttcaccgtgttggcca

SEQ ID NO: 96723 - DNA, 146 bp, Homo sapiens
gagtccccattatagctgcccaggtgaaaggctgctgcctcctcagtgaggctactcctggggattggcagggttggaaggcagcacggtagagtgtgctagtgggggcagctgactgaatgcccactcctcctctgggggctggg

SEQ ID NO: 96724 - DNA, 549 bp, Homo sapiens
gactctatgttagtgtttgccctgtttatcaggcagcctttaggcatagctatagtacagaccaagttctggcatagagtcctggggggctgcaggcattaccgaaggccttctgaacctctcctgaagtcgcggttatgtcctctctagttgggaatgtttgactgtcactttttggccactggcattcccttccttcctagtcagtctcaggagccgtaggcacacaggacctcaggtccctgacccaccctgtgggatggccaggaagggagcagccacagtgctcccctcacggtgggccaggggaggggaggtggtctcagtgggcagccctccctacccttccaacaaaggacttttccctactccaggcagtaaattcagtgaatcctgattcaaaatgaatgttcttcttttcccatcatgtgggtctaagctttcattatctttacattcgaaatgcaagggcctggggatctcaggactcacctagcccttggattggtcactaggccccacctggcaccctgaaggcagtgggcaaag

SEQ ID NO: 96725 - DNA, 450 bp, Homo sapiens
ggtgatctagaggatcctggctcccactggttgccaggcaggagtgctgagcccaggaggtttaggctggcatgagccatgatggccacttgcactctggcttgggcaacagagtgagactctatctcaacaaaaagaaattttgctgatcactgatctgtctcatcaccctgctggtgacatcattatttgaattaatatagacccagctttgttatacagtggtcctctccttgtctccctgttaactgctgtgttctgagcagcatggggtacatagtaggtgctcattaaaaatggttgattgagtcattgtgacactgtctgggccccagggagcgtctagactaatgggagaaacaggctcatatctagtgccctccagacaaggaagtaggggctccaaggaggatcaagggctcattttagccactgtaggcaggtgggtga

SEQ ID NO: 96726 - DNA, 223 bp, Homo sapiens
ggtcacacagctagttggtagaggagctcttccataagatagcaaggccacatcacctgcagggcagtgcctgctctgggaggtggcacaatgtgcccagtgatgacgatgacaataactatgaaaggattttatatttgcacagcatttggttgcctgatcttcgatgaggaagagctcctgccgatgtctgctgaattgtgcagtaaaatattcaggatgg

SEQ ID NO: 96727 - DNA, 1680 bp, Homo sapiens
ataagccagaacgagaaaggaaaagactcatatcaacactgtgatcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgtgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttccgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaa

SEQ ID NO: 96728 - DNA, 414 bp, Homo sapiens
gtgtatgcgtggtgtagcgggatgaaggagcaggctacacttctaatgcccattctaaaataaactttgaagatgatctagtttagccttcccctcttctcaatctacacatgggaaaccaagactcagagcgaagatacaacttaaacagggtcacaaagctattagcggtggaatggggcatttggcgcaggtttcatgatctcctgatatgcttactcctttctccctagctggggtagaatacagaggctaggggaacaggcaaccaaaggcaagcgacagcacccaggggaaaacgctttggggctgagcagtctactggcagggggtcagggaggcaagggcaatttgaccctccatgctctgcctggcaatcacaggcgaattcccggaagtgaaaggacggcggtc

SEQ ID NO: 96729 - DNA, 413 bp, Homo sapiens
taaagagacggggtctttcttttttgcccaggctggagtgcagtggcataatcatagctcactatagcctccaactcctggtctcaagtgatcctcctgtcacagcctcctgagtagttaggattacaggtgagtgtcatcccaggcacctaatttttatttttttagtttgttttgtagagacgaggtctcactatgttgcccaggctggtctcgaattcctggcctcaagtgattctcctgcctttggcttcccaaagtgctgggatcacagacgtgagccaccacgctggcaaaactctttaataactctctctttctaattgtggcaaaattcacacaacataaactttaccatcttaaccatttttaagtgcacaggttagtagattaagtggtcatgtggttgtaca

SEQ ID NO: 96730 - DNA, 1112 bp, Homo sapiens
tcataatgtaagttcttatcaataacagttttactaatggttgagtatcgtatccataaaagtttattaatgggtgctaagaaataaaaagccagaatacagtatcatagcccatgtttcacagatgttatcagaacagtctacaaaatagactctcttattgagttgtatgtaaggtcacatttgcgaagaggttttagggaagagttagtaaccatacagaggctttgccctggaaaccaatgttgttcacagctgctgctgaatgaaaggaccttattcataggattacagtctttggacagagttagaagcttctggctttatagtggttttataccaacaggatttttactatgtttcagtttagcaaaggactgttaacaaaacagttggtgtacttacataataaattgagttcattttacagtttggaagtcttaacagtgatttaccatttagacttacattgtaagatttttggtttggtttggtatttaaataacaatgggggaaataacttggagagggattcggtcacatttttgggagttaaaatattttcatagctagtttttttgtttgttttgggagactgactcttgctctgtctcccaggctggagtgcggtggcacaatctcggcccattgaaagctctgcctccgggttcaaacgattctcctgcctcagcctcctgaatagccgggattacaggcgcatgccacccacgcctggctaatttttacatttttagtagagacgttttcaccatgttggccaggctggtctcaaactcctgacctcaaatgatccacctgcttcggcctcccacattgctgggattacaggtgtgagccaccacgcctggcccatagctagttttaaaatatcttatttgcagctcaaaaaatatggacagtaattcagggaaaatgtgacaaaagtacattttagttcatgcatttaaaattcactctgggccaggtgcagtgcctcatgcctgtaatcccagcactctttgagaggctgaggcagaaggattgcttgagcccagaagtttgagatcagcctgggcaacacagcaagacctagtctccatttaaaaaaaaaa

SEQ ID NO: 96731 - DNA, 540 bp, Homo sapiens
caggcgtgcgctcgaaccttctcccgaatggccctgctccacaagcaccaagagtcgggctgctcagggggccctcgctgaccctagaggctccctcttcctctccctaccagacaccctgcccccgccaaccaacagcctccccagtttcagccatggggccttcgaaggcggtggctgacaccaggacgtgtcagagcctaagatgctctgggcctgagcagctatttcagcttcctgtttggtgtggttggcacctgtttcccaggcaatttaacaatgtctcaagagggactgtaagtaatggttgtcacttgtcggtggcctaagtggggtgctctggtctgcccaatgtatctcccagaactattttgggaacccaacaggtaggcctgggaggaagatgtttacatttttaaaagtacattggtacttatatttcatacattttgtatcaaggaaacgttttgtatagttaatgtgtgcagtttattgatatccaataaagcaatttgtgtattttttaaaaagagtattcaa

SEQ ID NO: 96732 - DNA, 252 bp, Homo sapiens
aggagcataggttttggagtcagattggggtttgtacctcagctctgttagctgtgttatcttgggtaaatcatttaaactctctgagccacagtttcttcatctgtacagtagtgaaggcaatggtaccagctcatagggttgttttgatgattaagtaagataatttatacaaagttgcatagcagagtgcctcacaaaatacatagatattgttagctcagtgtatctcgctcttagcatagagccagc

SEQ ID NO: 96733 - DNA, 177 bp, Homo sapiens
attaatctgctcttataatggagactttaataccccattatcagaaatggacagatgtagcgggcagaaaaccagtaaaaacatagatgaattcaacagtgctgtcaaacaacttgatataattgacatctatagactacttcatccaacaacagcacaatacacattcttctcaag

SEQ ID NO: 96734 - DNA, 724 bp, Homo sapiens
gtcttgctatgttgcccaggctggtcttgaactcttgggctgaagttatcctcctgcctcagcctcccaaagtattgggattataggcatgggccaccatgcccagctctcctatctttctttgtcatcaccttttctccccggcagagctccagcctcaggtatccctcttgtggatgctcctgtttttccatgggtccatgttgtgattatgctgagccaaccacactatgtctccctcctcataacccaaggcacaggcaagtctgtaggaccatctggcaggagagagccaaggcctggacaagcagccagccgtgggccccatcttggctcactgcaacctcccacctcctgagtacaagtgattctcctgcctcagcttcccgagtagctgggactataggctcttgctaccatgcctggctaatttttgtatttttagtagagatggggtttcgccatgttggccagtctcgtcttgaactcctgacctcaggtgatccaccggcctcggcctcccaaagtactgggattacaggcctgagccacaacactcggccccatcattactttattcttaccagctgcactcactggtactagcagttcatgatttgcctgagtcaataatgatatcacaacatcagattccactgatcaaaaaaggacctcgtcagtctagcactcagtggcaaaaaaaaaatgtttaagttattattgc

SEQ ID NO: 96735 - DNA, 347 bp, Homo sapiens
gaaagtatttgtgtgattgagtcacacgctgaatcaatcttcatataatgccatttttgcttaaaagaatgccagacttgggcattaggctgacattttcttgaaaacagtgaggctttgctttagggaaaatagtggtagtatttatggtcgatgataaagttcctagattttaagcaaaaattttagaaagcttgtatcagctgctgtaagtatataatgaaatctgtcattatttgattatctgcataactgagtcagtatttccaaatgatcaatgcatagtattataaaaatcatacatgggtaagaaatctttacaaagtgtcagctagaccaatggattt

SEQ ID NO: 96736 - DNA, 590 bp, Homo sapiens
ctgccttgtttctgcccagcctcatttcttctccaggactcatcatggagtgtgaagcattaaacatatgcttctcctcaggcgacctgctcctctttgatttcaaggccattggcacatattttgcaattattctgtttaccagtttttgttccagtttgaagagattcatgtctaatatataataatatcagaaaatccacagtctccatcctcacttcagtttaagctttctaagggactcctcattgcttctaaacagattctgattttgtctttctaaacaacatcagaagagtcagtaatccatccggcaaatatttattgagtgacaagtcacaaccctggctctcaaggtgtttatgttgttattgaaaatatagtcaatttaaaaggcaatggatcagagcagggttagaggggatggaggggagagggcaggcaacagaactacaaactttgtacacagatggccttgggttccagtcccgggtctgccagatgctagtagtgacacctggagcaagtcactggtcttctctaagcatcggattcctctcatctttaaaaacagagatgaaagtacctac

SEQ ID NO: 96737 - DNA, 469 bp, Homo sapiens
tgtcatattcagggcaatctgtttcttttcttctgaattagatttgctgtatcttccttcctagatgctgtccacttgctgtatctcccttcctagatgctgtccacttgctgtatctcccttcctagatgctgtccacttgctgtatctcccttcctagatgctgttcacttgctgtatctgtcttcctagatgctgtctacttcctgtatctccttcctagatgctgtccacttgctgtatctcccttcctagatgctgtccacttcctgtatctccttcctagatgctgtccacttcctgtatctcccttcctagatgctgtccacttgctgtatctctcttcctagatgctgtccacttgctgtatctgtcttcctagatgctgtccacttgctgtatctcccttcctagatgctgtccacttgctgtatctctcttcctagatgctgtccacttcctgtatctc

SEQ ID NO: 96738 - DNA, 446 bp, Homo sapiens
tactgtcatctcaaaaacagtgactaaggagcccatcttttgcagctatctttgtactacaatacaaatacaacatttacacttacataaatagcttttcagggcagaaaatacagcaagatgaatctgtcatttttatttcctaatacattccaggatattgttttgctaaattatagtcactaaagcccacaaaatatgcaaacttcctactttcccccctcaaggtacactatctgaaggaaaccattacataaatagtgcctctgctaattaattactgctggtcatactcatttttccaaactaagaaatgaaaccaaatagtgtaatttacatttttttctccaactctagttaaaagtaaaaagacagggataaattcagctgcagaatgctgcttacaatgcttccttttttttctaattactcaaatcaatgagtat

SEQ ID NO: 96739 - DNA, 813 bp, Homo sapiens
ggtagtcccagctgctcaggaggctgagacggaaggatcccttgaagctggagtgcactggcatgatcttagctcactgcaccctcgaccacctgggccctagcaagcctcctgccttagcctccccagtagctgggactacaggcacatgccaccatggtcagctttagtctaatttttaaaagaatccatggcagttccctgagttgcagttgcagaaaaagagaaacactactaagatcagagaagaagcaggaattggcaagactggcagccaagagctttataatatcactttgtggaacctagggatatatatgagcattgcaaatccaatttttagtctctaagcagcttcctgcattcgtgcttgaaaagaaactgaaggagcagcactggaaggctagtctgtttattccaaggagaaaaagaaaaaacaaaaaaaaaaaacaccagaggcctgcagtctggtttgaagtctaggcttagtttttagactgaatggtacaatagtattaggaggtgtattttaagctggaaagaattgtggtggtgaagctaatgagaagtgcaaaagcctggaaaagggtaagttagaatcagtggaacctaaggtgtttatttttctggctgaaaattcttcagttaacaccacttgggagcttaaaagttctgtactggaaattataaagatatttttattttggttttatttttaaattaattattttaagatttcacgttgccgtgagaaagtagataattttatttttagattattgctcttagtcttctttttcctagtttgtgtgt

SEQ ID NO: 96740 - DNA, 134 bp, Homo sapiens
agggcccactcgagctgggactgcactagccaggaaggctgccgccttcctcctgcgggagctccaggcacagtctgtaccacccggatacagccgccccaaagttaccggccttgggaaacgtccacagaacc

SEQ ID NO: 96741 - DNA, 700 bp, Homo sapiens
agatcactgaagcagagaactaacaaattctggacttaaactcgatacttgaacaactgaacctaataaacatctacagaatactccacctaacaaccatagaatatacattgttctcaggtgcacatgtaacatattcaaagatcaaccacatgctgagtcttaaagcaagtttcagtaaattcaaaaaaaaaattgaaataattccaaacacactctcagaccacggtgcaataaaaacagaaattgataaagaagatttctcaaaaataacacaaaaacatagaaattaaacaacctgcttctgaatgaaccattgttcattatatgaacaatgaaatcaggacagaaataaaaattctttgcaattaacaaaagcagagacacaacttataaaaatctttgggaggcagctaaagtgatgttaagaggaaagtttatagcactaaatgccttcatcaagaggtcggaaagatctcaagaatctaacatcacacctagaggaactaaaaaacaaaacaaaacaaaaattcaactctaaagctggtagaagaaataattaaaatcaaataagaattgaataaaattgagacacaattaacaacaacaaaaaacagaagatccaaataagcacaatcggaagtgacaaagatattacaacctatcccacagaaatataaaagattggagacgattatga

SEQ ID NO: 96742 - DNA, 309 bp, Homo sapiens
aacattttagaaaattaaaatttaagaaacatgaaaatatcaaattctatgaagaaacttttttcttttcatagttttactgcggctattactttttaaaaataagtgcatgtagcaaccccagaaagatgtgaagaaatggtttaatgtaatgtcaaagatctatttgatgaaagttaataattgatagctttaaagttgaaatcggatagttttttttcccccttgtgtgttaaatgtgcttttcttttttcattttaaaatcacaaaggctttggcagagatgaatttatggaggtaagtctcaag

SEQ ID NO: 96743 - DNA, 192 bp, Homo sapiens
ggcctggtatccacagggttctttacatatgagagaccgaagatatctcaattggccccatctctctggcttccctggtcctttcctgagagagtagactctgttatctatatgcctcacctctatacagcttggatcaaatgaataaaaatacacaaaaagctaatatccttactatgtagtacctggtaa

SEQ ID NO: 96744 - DNA, 696 bp, Homo sapiens
gactgcattgcttgaagagctgtcacatttggcctttgaatttcccaaatgccaaactcgaattagactagagtcccttgggagctttgtccttaaatggtcttgatgttctcggcttatgagaaacctaaagagaacatttaattatttttatgaatgtatttaattacgtttggaaatgcctggttccttttaaccctagcaacctgattgacacagccgcagaccaattatttgtcccatgtaatatttgtttatttgtttaaattgtcataagcatttaaaattggaaagatttcatgtaaatatccaaattgctggctttctctgaaaaaaaaaaatgaagatctgggaacactggcccagtatttccacctatcaacggtggtctgaaaccaagagacaactactccatttagctggagcaaatgcatttgagaatgccatagtctccactactcccgattgcccagtactttgtccacttcactcttacgttacctgcctggccgccgtaaggatggcagttataatcccttagaatcttctccatatcaaagattctttaaaaaaatgtttttaaacatggggtcttgatatgttgcccaggctggtcttgaatttctaggctcaagcaatccacccacctcaacctcccaaagtgctgggattatgggcatgagccactgcatccag

SEQ ID NO: 96745 - DNA, 752 bp, Homo sapiens
agcggcatggaatcaaccttaattctgtgtatttactaatgtaaatgcattcttacgttacaaaattgtgctttaagctggaaaatagtgctttgaccctgtttccttgctgtctgtgttttagatttactgaggaaatggagactgcttacttaaagcctgtatcatgctttagttattcttttccattttacaaatcaggagggagaatttcctgggcaaaaaataattcatgaagtagtggtgccatttttcacaaaaattgatcctgagatgaatattaattgtgtagtctacaaagagttaattttatttctccattgatagtttggacctttgaagtgaagaaattctaaccgaactcctttctgacccttaagcctttttgtttccatgcaaaagaaatctgttaataatctagcatcttgccaaagattctgtctcatttctctatagctgatttgagtattccattttaattcactgcctgtggaattagtaattatatgatttttgtagtgactccaatcttaaataatgatatccttctaataaggcttgttctatttatagggcttaaagagaaattagattgttaagaagaaacaacagaaatactagaaataactattaaaatatactcaaatctattttgtggcctgttttctcatgctttatttatatttctggccaaaagaacaggagtacaaatgatgagcatgtgaggcccttgccctggctcctcccaccca

SEQ ID NO: 96746 - DNA, 425 bp, Homo sapiens
tggggaggccacaggctactgcgcatgggcaaacgaacacagcagtactgatggagcttaaggatttgggtgacagggagggtcagaagcacatccggacgcaggaacttaatggggctgaggttcaaaagagtggctcaggctggtggttcaaatgagcctgaaccctaggacctggctgcagcttctgtggtttcctttaatctgggaagagcagcttgattctccagaggggaacaagccatctcctacatcctgtcttgatagaattttcaatcaacgtgcctgcccccaaagccaaggagtggcacatgacccaagtgaggcaacaggataccccctctccctggattctgaatcggaatcaggaggaacccagggccagtgctccttcctcctggtacccaagggatgtctgctagacc

SEQ ID NO: 96747 - DNA, 685 bp, Homo sapiens
aaacagctggatgtagccgatccaaggagccgcagcccgtggctcagtttaacccccttgactttccctctttgcctccggagaggcagaatttgcagcctgattattcgtagaaataatttttcaaatcttgcctttccggtacggttcacaaggtggcaatttccatgtcactgaacatgaagcctgggtcttaaatatagccaggatgtgaatgccctgcaggcggtgacagtggcaatgtgacatcactgccaagcaacttctttttattttggagcctgggaggggaacaacaggaagctgggcagaggggagatattcttggcagcagcagcagcgatgcagtttaaagagagacaactgtcaaggctagtgactgagcaaaccagagttcgctgaattcgtactggtgccaaacatagccgaagcaaagatgtgtgagactcgtacctgctgctgctcagtccagcctgggcaacagagcaagaccctgtctctgaatgaatgaatggcacatcctttatttttagctgtacagagggtgatgacatcttccaaaatatcgtctaattcagagccttccatgttggtacccactctggatctcttggccggtcttgtgtacagtctggaggcccctggggagatccccccatgttttttctttctctcacgctccctc

SEQ ID NO: 96748 - DNA, 536 bp, Homo sapiens
atataagtcaacaaatagtcctggcataaagcaagttctctatcaatggtatgtggattcggccttctggaaggatgtgaatcagagctccttagccatcaatccttgggaagagaacaaatctttactcagctaaaaaattcagggcctggccaccaccagggcattaatgtggtgcctgcaccagggcaaccaaccagtctctggtcttccatgctgagatccagtggcaaacaaatcagggcacacttcattgttccaagtggtttgggaaatcatcctgtaaaatccaaatatgtggacagagctgatgagttcattcaaattcctttgctgccagcttaaaagaactgggtgcaccaaactgcctatatttaatgtgaagatgtaaatgcagttgtctaacctagggcagaacgtctcatgccccaaagactccagtgaccatagccatttgcagctcacccaggggaggggctggttcccaatgggacatgacccaaaacacacaaactacattagtgagcactattatt

SEQ ID NO: 96749 - DNA, 894 bp, Homo sapiens
taatttttctctcctcagttgggaacatctatcatgctggaggactactgtgatggggctttacattttactgttttgttgctagcttattgtttcatacttgggaatcagtcatgtttctgattgtggtataaagtttgcttaagtgccccttagttaaagctgttcaatgaatgtaagcacacacacacctacacacatattttgaatagtcgtgtgttcatgcctgttctcagtcttgtcccctttaccgtttctcatgcaggttatttcttgcttttttttttttcctcttttttaaccggagaagcaacaaattacgtagttttttttgtgtttctttgattactagtgagcttgagtacttttaatattttattggatatgtttgtgactgactttaatttcttgtttgtgtgtgctgtggctgcccgatccagcacctacttccttctcccaccataccacccccacccccacccctgcaaacaattgtgcatgtggtttgggtggcattgtcacaccctcggctttctagattaacccagttaccttttagcagtgccccacttccccagtagcaatggttcaggggtaggcacctgacccagaccagactactgagataaagatgtttgcctaggctttttcaggagcaattgaagacatcttgttggagatagtgtgctgggaggagtcacattctgaacttgctgcagctcgtttttctaatataaaggaaccagcctgaggcagtaccagggtgagagggagtctattggagcccttgggaacttctggatcaaattggacctgaattgagatctatttctcagctttcacttatgtgagccaataaattccttttttgttgaaggcaaaattgacttggat

SEQ ID NO: 96750 - DNA, 183 bp, Homo sapiens
ttacctgtgcaaatcatccaatgttcatatgcccagtatttgtatccttctttaataaagtatcctctggtgttacacagatatacacatatcaataacagtgcatataagcctttattaagtatactttagattttacataaagaatttctattatctcattctgcattttttatgctttat

SEQ ID NO: 96751 - DNA, 167 bp, Homo sapiens
agtctaatccctgagaacaaggttatcttttatatcctttatattccccgaataattattagaatgttctgaatactgggtaaaataataagaatgcaaagattagttaaggcaagttaatttttcaattacattttttgatgtgaagtgtattattggttgttatc

SEQ ID NO: 96752 - DNA, 257 bp, Homo sapiens
gcttgcccactgctcaccttctgctgtgcggccaggttcctaacaggctgggctgtggaccattactcttaccagtctgtggcccaggagttggggacccctgagctaaggagtttcttcttagggtgatgaaaatgttctaaaactgactgtggtgatagatatacaattatgcaaatatgctaaaagccagtgaattgtacaatttaaatgggtgaattgtatactatgtgaattatgtctcaataaagatgttt

SEQ ID NO: 96753 - DNA, 432 bp, Homo sapiens
aacattttctttttatagaagaaattatttgtgtgaaatcatattattgagactttttcacatgcttatatgcacagtcattaatttttataactgtcaaacctaaaggacacttgtgacattttctttctttctttttttgagatggagtcttgctctatcacccaggctggagtgcagtggcacgatcttggctcactgcaacctccacctcctgggttcaagtgattctcctgcctcagcctcccaagtagatgagattacaggtacatgccaccaaacccagctaatttttgtatttttagtagagacggggtttcaccacgttggccaggctggtctccaactcctgacttcgagttatctgcccattttggcctcccaaagtcctgagattacaggcgtgacaacctcacccagccacctgtgact

SEQ ID NO: 96754 - DNA, 188 bp, Homo sapiens
tgtagtttttttttgttgtatcctttcttggatttattattagtttaatactagcttttagactgatttagggaggatttcttctttctctatcttttggaatagtttcagtaggattggtaccaattctttgaatgtctggtagaattcagctgtgaatccacctggtctgggacttttttgttgtt

SEQ ID NO: 96755 - DNA, 289 bp, Homo sapiens
tgtgtttgtgcatgtgtgcgtgtcataggagaagccttccttgtgtccccaggctcttattcatgaagccacagtgatcatcagcagtatctgctgtgatgaacgccccatgctcagggtgtcagttctggctgaagtttacttttaaagagagtttagtcttctacgtgatggcttcgtgtgattgtttcagaaaggccgcagcatgcagaggaaccagcataagctttgaaatgaggcggacttgggctcaaagtccccagtcacttgagacctgcatgatcacgag

SEQ ID NO: 96756 - DNA, 258 bp, Homo sapiens
agagggttggccttatttccattctgggcttatcagtagctcaacttcagtaagctttccagctaccactgctgcaacacgaaagtcctacttattttgctgtcatttctcacattcttaggcagaaaattgttacctctcagcgtttcttatcttcctaagcacaggcagtcacaggcctacaaaggcaccataaacacaaacgattccaaacacattgtccatctcaacctcgctgccagaagccctgacttcttt

SEQ ID NO: 96757 - DNA, 537 bp, Homo sapiens
gcacatagatgaccagcctaccaggtcttttatgcagttcgacatacaaggtgacagcaaggtttcaggacatccagaacaatcaggatcaagttacaggttcgggccactgcaatgatcgacgacctctacctttcccatccctggcaccttcaataatacctgggagatccaggagctggattttggcacctttgtatctgatgacaccaggcacagtgctcagagtagtgaattcataggctgccacctcagaatatacccctgccaggttactaagcagtgtcgacttccccacaaatggaaaaccaacaaatccaattcaagcatcacctgtctcggccacatcaaaaccttcttctgcacctccaccaccaccaccaccctttggagtagtgagttctcgacgaagcttagcaagacgagccttaagcagccccaggtggtgtgctgtggccttgttgagtccaagccatctcctcttctgtctccgcgatcttagctagggtgctgctcatcgtggcgagtaccctgtgg

SEQ ID NO: 96758 - DNA, 406 bp, Homo sapiens
gtgacagccctgctaaacctccctagaaaactacaaatccatgatgtcaactggtcgttaaactccattactccaggctctcttttcttgacaaaatttaatttaggccagtaggtggcgataattaaacagctgattaaacagggcttcttctaatcatgagagaatgcattaaaagcaatctggaaggttgcttctgggagcaagaggaggaacctttctgtgaatccagtgctgattgaggtgcaattagcagatccactaacgggatgcctctcctgactcttaaggatctcctaggctcccaccgtgatcacttttttttttgagccatggtcttactctgtcacccaggctggagtggcagtggtgtgataacggcttactgcagccttgacctcccaga

SEQ ID NO: 96759 - DNA, 457 bp, Homo sapiens
cagctcctccaaaaagctttcctgctgcactcaccctatacacaggcataaacaacaaactcgtgtaccaaatatgaatggacaatgttcctttgtgcttaccttacctatgaaactataatgtaatgtggagatgttttggtcttcctctgtcatcaaagtgaaaggtcttgaggataggaaacgatttgtaactctttgactttccatagcccttagcacaaggtctagactagggcataaagaagaactcaataaatgttagatgaataaatgaagttcagagaaacagtcattcttaagtacttcaaagaccttggctgggcacggtgcctcacgcctgtaatcccagcactttggaaggctgaggcaagaggatcacttgaactcaggagtttgaggccagcctgggcaaaacagtaagaccccatctctacaataaataaataaatttttt

SEQ ID NO: 96760 - DNA, 802 bp, Homo sapiens
agcggggcgggctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacagctaccctatagttggctgcctggcttcagagctttttttgaacttggaagacttcaagccccaactgaggaatccttgatgctctgttgttttgtcttgctaaaatgtacaagaaacttgcacagctctgtccttcaggcttaaaatcatcccagggaggtcactctaattccttttaatgtgtgctgaagaaagggcagcacagctgaagcctgatttaaaatctgatcttctccctaatgtcacaaggacatcctgagacaatggctgaggagctatgcaccagtacccagctggatccctgatacttacattggcagatgcattatcaacagagacatcgatttagagtgaattaaaggaattacaaagatcaagatgaattcagtgaagcttcccataggactgttcaaagatctccaggcctgccattcatgcattcatgtgagagagacactttgggcctaagaaatgaagg

SEQ ID NO: 96761 - DNA, 353 bp, Homo sapiens
tcacttagctgtctggccccagggtgttctgagatcggttcaggtgtcagtcagggacagatggcacgtgctagagctagagaactcagaaggtcacccttgatcttcactaagttcccgtgtttattccaaaacaatctgtgttgtatttatgtagttttatgactagttgattatctccagtgccgacccctcttcttattccagaccattagatcagttttcagggttcttcttctctctcaacttattcatctttccatgtggttttcaatgtttttactgtctccagttcatgcctttgcagttctaacaaacttgtttcttataacctacttaaaataccaagctcc

SEQ ID NO: 96762 - DNA, 537 bp, Homo sapiens
ataccgaatggggctacaattttaggtctgtgaaattataaatatcagcattctgactaagtatccagaggcagatgaacttttaggatcataattttcctgtgctatatggattttaatttttccctagtcttcactttctgttcagtaattttatagccctttggaagagctttatttgagaggctgtgtcttatgttgaaactgtcttcatcgtgcaaatatgaccgtgtttcctgtggagtcttcataggtgactatgacaagtacctttcccatcaaagcaccttctcaattgcccgaagagctgtagcatcagcttatgtgtttgctaaccctctggtctttagttccattatttctggcatttgggtgttcctttttttgtgaatgcacttaacattttgtcactgaagatgtataggctggtgtgaaggtcgtgagttatctcagttgattgttcacagtcagttacagatcaaactccttgttctactctttcaccccttctcactactgtagttggctagtcttaaa

SEQ ID NO: 96763 - DNA, 530 bp, Homo sapiens
tgcagcacagtttatacaatttggcagatgggaatggaactctccagttaccctctgaaagccctatatgctgaatctggtattttgcaactgagaaaaatccaattttgcttgggagtctcaaattcaaattcattccaagaggagaagaatcaaaaccttcaggcaatcaaagtagggcaattccttaaaaataaaatcctccttggaggatgatgaattattgagttgtaggaatatgttttatttttaaatttaacagccatcaatattgcctttctaatatcttttaaaaatgcatcaacaaccacatttttaaacctaggtgagccccaacattttaagggatttttttctaaaagatgttatcaagttgctgtaaatcaaaatttattttaaaagcctcagagaagtactattcagaagagaatgcatacaatcctatttggaaggacaatcattttctaatttagtttccatgtaaacttgagttttcctggattatacctgtttacagcacctttgtgaaa

SEQ ID NO: 96764 - DNA, 318 bp, Homo sapiens
atctctttttaataccaagtttatcagttatcagcattgaatagttgttcctccattttttattcatttatccaacatgtcttgagtgactaatattctgcactaatatgtgcagaagatttttttaaacacatctaaatattttttgctttgccacaattaaaaacagtgactattagctgtcctgtctctttcttacctttgacctcttacctctctccagcaaagatctcttctttacaaaaacttgtacctgaccctgctattctcactttattttattttccctattatacccataagaaaactgaggcttag

SEQ ID NO: 96765 - DNA, 1932 bp, Homo sapiens
ggagatattatgaggctgttgtcattagggcgattgcggtggaatcgctgaatcttgactcggcggtggttggctctccctctcctctctccctctccctctccctctctgtctcgggttctctctctgcgcgcgcgcaccgggccgctctcctacctccctctctatgtggctgcgcgggtgtgtgtgtgtgtggatgtgtgtggggtgtgggtgtcccttacgcccttcctcctctccctcctcctcctgctcccccctcctttccttctcctcctcccccctctcctctccctcctcctggtcctcatcgcccctctcctcctcttcctcccctctctcttcctctccctgaattttctcctctcctctcaggtcagtccatggtattccgctcccccctagacctctattcctcccacttcttgttgccaaacttcgccgattctcaccaccgctccatacttctggcgagtagcggcggcgggaacggtgcgggaggcggcggcggcgcgggaggcggcagcggcggcgggaacggtgcgggaggcggcggtgctggcggagcaggcggcggcggcggcggcggctccagggcccccccggaagagttgtccatgttccagctgcccaccctcaacttctcgccggagcaggtggccagcgtctgtgagacgctggaggagacgggcgacatcgagcggctgggccgcttcctctggtcgctgcccgtggcccccggggcgtgcgaggccatcaacaaacacgagtcgatcctgcgcgcgcgcgccgtggtcgccttccacacgggcaacttccgcgacctctaccacatccttgagaaccacaagttcaccaaggagtctcacggcaagctgcaggccatgtggctcgaggcgcactaccaggaggccgagaagctgcgcggccgcccactcggcccggtggacaagtaccgcgtgcgcaagaagttcccgctgccacgcaccatctgggacggcgagcagaagacgcattgcttcaaggagcggactcggagcctgttgcgggagtggtacctacaggacccctaccccaaccccagcaagaaacgcgaactggcgcaggccaccggcctcactcccacacaagtaggcaactggtttaagaaccggcggcagcgcgaccgcgccgcggcggccaagaacaggctccagcaccaggccattggaccgagcggcatgcgctcgctggccgagcccggctgccccacgcacggctcggcagagtcgccgtccacggcggccagcccgaccaccagcgtgtccagcctgacggagcgcgcggacaccggcacctccatcctctcggtaacctccagcgactcggaatgtgatgtatgatagccaaggccgccctcctccctctccttcccctcctcccccactccttcccctccgcctcctagccctcctcctcttcctcctcttccttctcctcctccatccccagaacaaaccgaaatcaggatacccaaccatacacacatacaagtccacacacactcccaccccagccaaaaatatataaaaaacaagaaaataacaaattaaccgcaaactatcaacaacccccaaccaccatctaccactacggccaccccaaaggaccccgacgccaacagacagtcaaacgctgatgttgcgggcagaaaacataaaagaggtgacaattgtatactttctaggacaagcacggcttctcctttcggttcccatggacccggcaccccacctgcatgacgatttatttgtatctgggaaaatattctctctagttaaaaatgatttaaagagtcgactatacaaaaatcaatcaccaccacgaggacaagagggcaaaagcaaaacagacaaaaagaaaaaaaatcgccgtctccgttccgaatttgtt

SEQ ID NO: 96766 - DNA, 367 bp, Homo sapiens
ttgtccttccagcttctagcaaggtgctttgtgcacagtaaacaacccaggcctccatctaccactacggccaccccaaaggaccccgacgccaacagacagtcaaacgctgatgttgcgggcagaaaacataaaagaggtgacaattgtatactttctaggacaagcacggcttctcctttcggttcccatggacccggcaccccacctgcatgacgatttatttgtatctgggaaaatattctctctagttaaaaatgatttaaagagtcgactatacaaaaatcaatcaccaccacgaggacaagagggcaaaagcaaaacagacaaaaagaaaaaaaatcgccgtctccgttccgaatttgtt

SEQ ID NO: 96767 - DNA, 1710 bp, Homo sapiens
ggagatattatgaggctgttgtcattagggcgattgcggtggaatcgctgaatcttgactcggcggtggttggctctccctctcctctctccctctccctctccctctctgtctcgggttctctctctgcgcgcgcgcaccgggccgctctcctacctccctctctatgtggctgcgcgggtgtgtgtgtgtgtggatgtgtgtggggtgtgggtgtcccttacgcccttcctcctctccctcctcctcctgctcccccctcctttccttctcctcctcccccctctcctctccctcctcctggtcctcatcgcccctctcctcctcttcctcccctctctcttcctctccctgaattttctcctctcctctcaggtcagtccatggtattccgctcccccctagacctctattcctcccacttcttgttgccaaacttcgccgattctcaccaccgctccatacttctggcgagtagcggcggcgggaacggtgcgggaggcggcggcggcgcgggaggcggcagcggcggcgggaacggtgcgggaggcggcggtgctggcggagcaggcggcggcggcggcggcggctccagggcccccccggaagagttgtccatgttccagctgcccaccctcaacttctcgccggagcaggtggccagcgtctgtgagacgctggaggagacgggcgacatcgagcggctgggccgcttcctctggtcgctgcccgtggcccccggggcgtgcgaggccatcaacaaacacgagtcgatcctgcgcgcgcgcgccgtggtcgccttccacacgggcaacttccgcgacctctaccacatccttgagaaccacaagttcaccaaggagtctcacggcaagctgcaggccatgtggctcgaggcgcactaccaggaggccgagaagctgcgcggccgcccactcggcccggtggacaagtaccgcgtgcgcaagaagttcccgctgccacgcaccatctgggacggcgagcagaagacgcattgcttcaaggagcggactcggagcctgttgcgggagtggtacctacaggacccctaccccaaccccagcaagaaacgcgaactggcgcaggccaccggcctcactcccacacaagtaggcaactggtttaagaaccggcggcagcgcgaccgcgccgcggcggccaagaacaggttagtggcggggcccgcggcctggctacagcctcagaggcctgggaaggggagaggggttgagatggggctagcggagcggccgctgagagccagggaagccgtgactcctggccagtcggagaaagtttccgcttgtccgggacgcgcggaagagggggccgggctggctgtgggtgtattgattgctttgaccaagaggggctttcgtcagggcagagagtgtgtgcttgcgacccgagtacccgcagcccctgggagacttagccctgcgctgcacccgtgcctgcctcctcagccctgccgccagctcggcgatcctctggagcctagagacagggagggaaggaaagcactctttgccatctggttcttatttctgtgcgttgcaaaaccccgagagaaatccactagcgtcagagagaggaaagtgaacctgggtccctatcacaaggggaaaaggccagaggccactgcgcagcgggcctgtttccccgcaacgctgcacgttgcctgaccgg

SEQ ID NO: 96768 - DNA, 1701 bp, Homo sapiens
  misc_feature (2)..(2): n is a, c, g, or t
  misc_feature (5)..(5): n is a, c, g, or t
gnccnggagagaacgccggtggcggggctggtagcccggcagccgcaggtggggccacgagcgctggctgagggaccgagccggagagccccggagcccccgtaacccgcgcggggagcgcccaggatgccgcgcggggactcggagcaggtgcgctactgcgcgcgcttctcctacctctggctcaagttttcacttatcatctattccaccgtgttctggctgattggggccctggtcctgtctgtgggcatctatgcagaggttgagcggcagaaatataaaacccttgaaagtgccttcctggctccagccatcatcctcatcctcctgggcgtcgtcatgttcatggtctccttcattggtgtgctggcgtccctccgtgacaacctgtaccttctccaagcattcatgtacatccttgggatctgcctcatcatggagctcattggtggcgtggtggccttgaccttccggaaccagaccattgacttcctgaacgacaacattcgaagaggaattgagaactactatgatgatctggacttcaaaaacatcatggactttgttcagaaaaagttcaagtgctgtggcggggaggactaccgagattggagcaagaatcagtaccacgactgcagtgcccctggacccctggcctgtggggtgccctacacctgctgcatcaggaacacgacagaagttgtcaacaccatgtgtggctacaaaactatcgacaaggagcgtttcagtgtgcaggatgtcatctacgtgcggggctgcaccaacgccgtgatcatctggttcatggacaactacaccatcatggcgggcatcctcctgggcatcctgcttccccagttcctgggggtgctgctgacgctgctgtacatcacccgggtggaggacatcatcatggagcactctgtcactgatgggctcctggggcccggtgccaagcccagcgtggaggcggcaggcacgggatgctgcttgtgctaccccaattagggcccagcctgccatggcagctccaacaaggaccgtctgggatagcacctctcagtcaacatcgtggggctggacagggctgcggcccctctgcccacactcagtactgaccaaagccagggctgtgtgtgcctgtgtgtaggtcccacggcctctgcctccccagggagcagagcctgggcctcccctaagaggctttccccgaggcagctctggaatctgtgcccacctggggcctggggaacaaggccctcctttctccaggcctgggctacaggggagggagagcctgaggctctgctcagggcccatttcatctctggcagtgccttggcggtggtattcaaggcagttttgtagcacctgtaattggggagagggagtgtgcccctcggggcaggagggaagggcatctggggaagggcaggagggaagagctgtccatgcagccacgcccatggccaggttggcctcttctcagcctcccaggtgccttgagccctcttgcaagggcggctgcttccttgagcctagtttttttacgtgatttttgtaacattcatttttttgtacagataacaggagtttctgactaatcaaagctggtatttccccgcatgtcttattcttgcccttcccccaaccagtttgttaatcaaacaataaaaacatgttttgtttttttttttt

SEQ ID NO: 96769 - DNA, 830 bp, Homo sapiens
  misc_feature (2)..(2): n is a, c, g, or t
  misc_feature (5)..(5): n is a, c, g, or t
gnccnggagagaacgccggtggcggggctggtagcccggcagccgcaggtggggccacgagcgctggctgagggaccgagccggagagccccggagcccccgtaacccgcgcggggagcgcccaggatgccgcgcggggactcggagcaggtgcgctactgcgcgcgcttctcctacctctggctcaagttttcacttatcatctattccaccgtgttctggctgattggggccctggtcctgtctgtgggcatctatgcagaggttgagcggcagaaatataaaacccttgaaagtgccttcctggctccagccatcatcctcatcctcctgggcgtcgtcatgttcatggtctccttcattggtgtgctggcgtccctccgtgacaacctgtaccttctccaagcagtgagtggaccacaccacccctcagccgggactccccaggagagctggggcgcctgcccctgtgcccttgggcagctcagtttcttttgtccctgcctcaaaccacctcctttagagagctccttagatcagcccatctgaccacactggcccaagaatgcccaggccacctcccctcctgcatgtaaaagctgatttgaatactgttcttacttaaactctgtgttcatctggatgctcagttgcgagtaggaaaaaccacactcaaatgagagcaagcaaagacaaaaaaaggagatggtagtgagtcattagctcatgcaaccagcaaacccacactgggtccaggggtttagatggcgccactgggcagggttgggcaatctccccagcccctgccagccggggctgctccctttgca

SEQ ID NO: 96770 - DNA, 1306 bp, Homo sapiens
ctgccatgttcctcccggcaggattgtcccagccctagccgagggggaccgagtgctgcagtgatgaggagaacagcccatgagggagaccattgacttcctgaacgacaacattcgaagaggaattgagaactactatgatgatctggacttcaaaaacatcatggactttgttcagaaaaagttcaagtgctgtggcggggaggactaccgagattggagcaagaatcagtaccacgactgcagtgcccctggacccctggcctgtggggtgccctacacctgctgcatcaggaacacgacagaagttgtcaacaccatgtgtggctacaaaactatcgacaaggagcgtttcagtgtgcaggatgtcatctacgtgcggggctgcaccaacgccgtgatcatctggttcatggacaactacaccatcatggcgggcatcctcctgggcatcctgcttccccagttcctgggggtgctgctgacgctgctgtacatcacccgggtggaggacatcatcatggagcactctgtcactgatgggctcctggggcccggtgccaagcccagcgtggaggcggcaggcacgggatgctgcttgtgctaccccaattagggcccagcctgccatggcagctccaacaaggaccgtctgggatagcacctctcagtcaacatcgtggggctggacagggctgcggcccctctgcccacactcagtactgaccaaagccagggctgtgtgtgcctgtgtgtaggtcccacggcctctgcctccccagggagcagagcctgggcctcccctaagaggctttccccgaggcagctctggaatctgtgcccacctggggcctggggaacaaggccctcctttctccaggcctgggctacaggggagggagagcctgaggctctgctcagggcccatttcatctctggcagtgccttggcggtggtattcaaggcagttttgtagcacctgtaattggggagagggagtgtgcccctcggggcaggagggaagggcatctggggaagggcaggagggaagagctgtccatgcagccacgcccatggccaggttggcctcttctcagcctcccaggtgccttgagccctcttgcaagggcggctgcttccttgagcctagtttttttacgtgatttttgtaacattcatttttttgtacagataacaggagtttctgactaatcaaagctggtatttccccgcatgtcttattcttgcccttcccccaaccagtttgttaatcaaacaataaaaacatgttttgtttttttttttt

SEQ ID NO: 96771 - DNA, 2070 bp, Homo sapiens
  misc_feature (2)..(2): n is a, c, g, or t
  misc_feature (5)..(5): n is a, c, g, or t
gnccnggagagaacgccggtggcggggctggtagcccggcagccgcaggtggggccacgagcgctggctgagggaccgagccggagagccccggagcccccgtaacccgcgcggggagcgcccaggatgccgcgcggggactcggagcaggtgcgctactgcgcgcgcttctcctacctctggctcaagttttcacttatcatctattccaccgtgttctggctgattggggccctggtcctgtctgtgggcatctatgcagaggttgagcggcagaaatataaaacccttgaaagtgccttcctggctccagccatcatcctcatcctcctgggcgtcgtcatgttcatggtctccttcattggtgtgctggcgtccctccgtgacaacctgtaccttctccaagcattcatgtacatccttgggatctgcctcatcatggagctcattggtggcgtggtggccttgaccttccggaaccagaccattgacttcctgaacgacaacattcgaagaggaattgagaactactatgatgatctggacttcaaaaacatcatggactttgttcagaaaaagttcaagtgctgtggcggggaggactaccgagattggagcaagaatcagtaccacgactgcagtgcccctggacccctggcctgtggggtgccctacacctgctgcatcaggaacacgacagaagttgtcaacaccatgtgtggctacaaaactatcgacaaggagcgtttcagtgtgcaggatgtcatctacgtgcggggctgcaccaacgccgtgatcatctggttcatggacaactacaccatcatggcgggcatcctcctgggcatcctgcttccccagttcctgggggtgctgctgacgctgctgtacatcacccgggtggaggacatcatcatggagcactctgtcactgatgggctcctggggcccggtgccaagcccagcgtggaggcggcaggcacgggatgctgcttgtgctaccccaattagggcccagcctgccatggcagctccaacaaggaccgtctgggatagcacctctcagtcaacatcgtggggctggacagggctgcggcccctctgcccacactcagtactgaccaaagccagggctgtgtgtgcctgtgtgtaggtcccacggcctctgcctccccagggagcagagcctgggcctcccctaagaggctttccccgaggcagctctggaatctgtgcccacctggggcctggggaacaaggccctcctttctccaggcctgggctacaggggagggagagcctgaggctctgctcagggcccatttcatctctggcagtgccttggcggtggtattcaaggcagttttgtagcacctgtaattggggagagggagtgtgcccctcggggcaggagggaagggcatctggggaagggcaggagggaagagctgtccatgcagccacgcccatggccaggttggcctcttctcagcctcccaggtgccttgagccctcttgcaagggcggctgcttccttgagcctagtttttttacgtgatttttgtaacattcatttttttgtacagataacaggagtttctgactaatcaaagctggtatttccccgcatgtcttattcttgcccttcccccaaccagtttgttaatcaaacaataaaaacatgttttgttttttttttttaaaaaaaaaaaaaaaaaaaaaaaaaaaaaaaaaatggcgggggcgttatttatgtgcggggggcgggaaaaagaggggtgtaagaaaaggggccagaggggcccaaagaggggtttctcggagacaccacgtcttttctgggctaacaagagggggcgaacaactcgcgcggggtctcctcccatattagaggggagaggcgttaacataacttccgcgcgtaaagagagccgcggtgtgcacacccgcgggtctaatgaggcaccccgcgggccaacaacggggcgaggaaaacaggagaaagcaagcgggagagacgaaacagcgacgagaaggggggagaaaaacacaacagcgagcgaagagggc

SEQ ID NO: 96772 - DNA, 1728 bp, Homo sapiens
  misc_feature (2)..(2): n is a, c, g, or t
  misc_feature (5)..(5): n is a, c, g, or t
gnccnggagagaacgccggtggcggggctggtagcccggcagccgcaggtggggccacgagcgctggctgagggaccgagccggagagccccggagcccccgtaacccgcgcggggagcgcccaggatgccgcgcggggactcggagcaggtgcgctactgcgcgcgcttctcctacctctggctcaagttttcacttatcatctattccaccgtgttctggctgattggggccctggtcctgtctgtgggcatctatgcagaggttgagcggcagaaatataaaacccttgaaagtgccttcctggctccagccatcatcctcatcctcctgggcgtcgtcatgttcatggtctccttcattggtgtgctggcgtccctccgtgacaacctgtaccttctccaagcattcatgtacatccttgggatctgcctcatcatggagctcattggtggcgtggtggccttgaccttccggaaccagaccattgacttcctgaacgacaacattcgaagaggaattgagaactactatgatgatctggacttcaaaaacatcatggactttgttcagaaaaagttcaagtgctgtggcggggaggactaccgagattggagcaagaatcagtaccacgactgcagtgcccctggacccctggcctgtggggtgccctacacctgctgcatcaggaacacgacagaagttgtcaacaccatgtgtggctacaaaactatcgacaaggagcgtttcagtgtgcaggatgtcatctacgtgcggggctgcaccaacgccgtgatcatctggttcatggacaactacaccatcatggcgggcatcctcctgggcatcctgcttccccagttcctgggggtgctgctgacgctgctgtacatcacccgggtggaggacatcatcatggagcactctgtcactgatgggctcctggggcccggtgccaagcccagcgtggaggcggcaggcacgggatgctgcttgtgctaccccaattagggcccagcctgccatggcagctccaacaaggaccgtctgggatagcacctctcagtcaacatcgtggggctggacagggctgcggcccctctgcccacactcagtactgaccaaagccagggctgtgtgtgcctgtgtgtaggtcccacggcctctgcctccccagggagcagagcctgggcctcccctaagaggctttccccgaggcagctctggaatctgtgcccacctggggcctggggaacaaggccctcctttctccaggcctgggctacaggggagggagagcctgaggctctgctcagggcccatttcatctctggcagtgccttggcggtggtattcaaggcagttttgtagcacctgtaattggggagagggagtgtgcccctcggggcaggagggaagggcatctggggaagggcaggagggaagagctgtccatgcagccacgcccatggccaggttggcctcttctcagcctcccaggtgccttgagccctcttgcaagggcggctgcttccttgagcctagtttttttacgtgatttttgtaacattcatttttttgtacagataacaggagtttctgactaatcaaagctggtatttccccgcatgtcttattcttgcccttcccccaaccagtttgttaatcaaacaataaaaacatgttttgttttttttttttaaaatttgcatttttaaaaaaaaaaaa

SEQ ID NO: 96773 - DNA, 1113 bp, Homo sapiens
cagaatctagggtcaccttctcatgctgcatatgggaaactgaggatcacagcggttgagggactagcctggaccttgtgtacatggcagagtcggggctgtggctcctgccagccgaggtcctctgctgggctgacccagctccttcccatgcagcgtttcagtgtgcaggatgtcatctacgtgcggggctgcaccaacgccgtgatcatctggttcatggacaactacaccatcatggcgggcatcctcctgggcatcctgcttccccagttcctgggggtgctgctgacgctgctgtacatcacccgggtggaggacatcatcatggagcactctgtcactgatgggctcctggggcccggtgccaagcccagcgtggaggcggcaggcacgggatgctgcttgtgctaccccaattagggcccagcctgccatggcagctccaacaaggaccgtctgggatagcacctctcagtcaacatcgtggggctggacagggctgcggcccctctgcccacactcagtactgaccaaagccagggctgtgtgtgcctgtgtgtaggtcccacggcctctgcctccccagggagcagagcctgggcctcccctaagaggctttccccgaggcagctctggaatctgtgcccacctggggcctggggaacaaggccctcctttctccaggcctgggctacaggggagggagagcctgaggctctgctcagggcccatttcatctctggcagtgccttggcggtggtattcaaggcagttttgtagcacctgtaattggggagagggagtgtgcccctcggggcaggagggaagggcatctggggaagggcaggagggaagagctgtccatgcagccacgcccatggccaggttggcctcttctcagcctcccaggtgccttgagccctcttgcaagggcggctgcttccttgagcctagtttttttacgtgatttttgtaacattcatttttttgtacagataacaggagtttctgactaatcaaagctggtatttccccgcatgtcttattcttgcccttcccccaaccagtttgttaatcaaacaataaaaacatgttttgtttttttttttt

SEQ ID NO: 96774 - DNA, 865 bp, Homo sapiens
caccagccctgccccttcttctcagttcctgggggtgctgctgacgctgctgtacatcacccgggtggaggacatcatcatggagcactctgtcactgatgggctcctggggcccggtgccaagcccagcgtggaggcggcaggcacgggatgctgcttgtgctaccccaattagggcccagcctgccatggcagctccaacaaggaccgtctgggatagcacctctcagtcaacatcgtggggctggacagggctgcggcccctctgcccacactcagtactgaccaaagccagggctgtgtgtgcctgtgtgtaggtcccacggcctctgcctccccagggagcagagcctgggcctcccctaagaggctttccccgaggcagctctggaatctgtgcccacctggggcctggggaacaaggccctcctttctccaggcctgggctacaggggagggagagcctgaggctctgctcagggcccatttcatctctggcagtgccttggcggtggtattcaaggcagttttgtagcacctgtaattggggagagggagtgtgcccctcggggcaggagggaagggcatctggggaagggcaggagggaagagctgtccatgcagccacgcccatggccaggttggcctcttctcagcctcccaggtgccttgagccctcttgcaagggcggctgcttccttgagcctagtttttttacgtgatttttgtaacattcatttttttgtacagataacaggagtttctgactaatcaaagctggtatttccccgcatgtcttattcttgcccttcccccaaccagtttgttaatcaaacaataaaaacatgttttgtttttttttttt

SEQ ID NO: 96775 - DNA, 976 bp, Homo sapiens
  misc_feature (2)..(2): n is a, c, g, or t
  misc_feature (5)..(5): n is a, c, g, or t
gnccnggagagaacgccggtggcggggctggtagcccggcagccgcaggtggggccacgagcgctggctgagggaccgagccggagagccccggagcccccgtaacccgcgcggggagcgcccaggatgccgcgcggggactcggagcaggtgcgctactgcgcgcgcttctcctacctctggctcaagttttcacttatcatctattccaccgtgttctggctgattggggccctggtcctgtctgtgggcatctatgcagaggttgagcggcagaaatataaaacccttgaaagtgccttcctggctccagccatcatcctcatcctcctgggcgtcgtcatgttcatggtctccttcattggtgtgctggcgtccctccgtgacaacctgtaccttctccaagcattcatgtacatccttgggatctgcctcatcatggagctcattggtggcgtggtggccttgaccttccggaaccagaccattgacttcctgaacgacaacattcgaagaggaattgagaactactatgatgatctggacttcaaaaacatcatggactttgttcagaaaaagttcaagtgctgtggcggggaggactaccgagattggagcaagaatcagtaccacgactgcagtgcccctggacccctggcctgtggggtgccctacacctgctgcatcaggaacacgacagaagttgtcaacaccatgtgtggctacaaaactatcgacaaggagcgtttcagtgtgcaggatgtcatctacgtgcggggctgcaccaacgccgtgatcatctggttcatggacaactacaccatcatggcgggcatcctcctgggcatcctgcttccccagataacaggagtttctgactaatcaaagctggtatttccccgcatgtcttattcttgcccttcccccaaccagtttgttaatcaaacaataaaaacatgttttgtttttttttttt

SEQ ID NO: 96776 - DNA, 964 bp, Homo sapiens
  misc_feature (2)..(2): n is a, c, g, or t
  misc_feature (5)..(5): n is a, c, g, or t
gnccnggagagaacgccggtggcggggctggtagcccggcagccgcaggtggggccacgagcgctggctgagggaccgagccggagagccccggagcccccgtaacccgcgcggggagcgcccaggatgccgcgcggggactcggagcaggtgcgctactgcgcgcgcttctcctacctctggctcaagttttcacttatcatctattccaccgtgttctggctgattggggccctggtcctgtctgtgggcatctatgcagaggttgagcggcagaaatataaaacccttgaaagtgccttcctggctccagccatcatcctcatcctcctgggcgtcgtcatgttcatggtctccttcattggtgtgctggcgtccctccgtgacaacctgtaccttctccaagcattcatgtacatccttgggatctgcctcatcatggagctcattggtggcgtggtggccttgaccttccggaaccagaccattgacttcctgaacgacaacattcgaagaggaattgagaactactatgatgatctggacttcaaaaacatcatggactttgttcagaaaaagttcaagtgctgtggcggggaggactaccgagattggagcaagaatcagtaccacgactgcagtgcccctggacccctggcctgtggggtgccctacacctgctgcatcaggaacacgacagaagttgtcaacaccatgtgtggctacaaaactatcgacaaggagcgtttcagtgtgcaggatgtcatctacgtgcggggctgcaccaacgccgtgatcatctggttcatggacaactacaccatcatggcgggcatcctcctgggcatcctgcttccccagggtgggcaggccgtgggttcagagaaagtgtgacttggtgattgcagaagggcagagaaggtgcagaggggaagagcgaagaggcttttttcatagaagtcca

SEQ ID NO: 96777 - DNA, 828 bp, Homo sapiens
  misc_feature (2)..(2): n is a, c, g, or t
  misc_feature (5)..(5): n is a, c, g, or t
gnccnggagagaacgccggtggcggggctggtagcccggcagccgcaggtggggccacgagcgctggctgagggaccgagccggagagccccggagcccccgtaacccgcgcggggagcgcccaggatgccgcgcggggactcggagcaggtgcgctactgcgcgcgcttctcctacctctggctcaagttttcacttatcatctattccaccgtgttctggctgattggggccctggtcctgtctgtgggcatctatgcagaggttgagcggcagaaatataaaacccttgaaagtgccttcctggctccagccatcatcctcatcctcctgggcgtcgtcatgttcatggtctccttcattggtgtgctggcgtccctccgtgacaacctgtaccttctccaagcattcatgtacatccttgggatctgcctcatcatggagctcattggtggcgtggtggccttgaccttccggaaccagaccattgacttcctgaacgacaacattcgaagaggaattgagaactactatgatgatctggacttcaaaaacatcatggactttgttcagaaaaagttcaagtgctgtggcggggagcaccaccaatacaattggtggtgctctctggggtagctctcaagggccagtttctggatttctgcacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctatcc

SEQ ID NO: 96778 - DNA, 1400 bp, Homo sapiens
aggaaggcactttcaagggttttatatttctgggcgtcgtcatgttcatggtctccttcattggtgtgctggcgtccctccgtgacaacctgtaccttctccaagcattcatgtacatccttgggatctgcctcatcatggagctcattggtggcgtggtggccttgaccttccggaaccagaccattgacttcctgaacgacaacattcgaagaggaattgagaactactatgatgatctggacttcaaaaacatcatggactttgttcagaaaaagttcaagtgctgtggcggggaggactaccgagattggagcaagaatcagtaccacgactgcagtgcccctggacccctggcctgtggggtgccctacacctgctgcatcaggaacacgacagaagttgtcaacaccatgtgtggctacaaaactatcgacaaggagcgtttcagtgtgcaggatgtcatctacgtgcggggctgcaccaacgccgtgatcatctggttcatggacaactacaccatcatggcgggcatcctcctgggcatcctgcttccccagttcctgggggtgctgctgacgctgctgtacatcacccgggtggaggacatcatcatggagcactctgtcactgatgggctcctggggcccggtgccaagcccagcgtggaggcggcaggcacgggatgctgcttgtgctaccccaattagggcccagcctgccatggcagctccaacaaggaccgtctgggatagcacctctcagtcaacatcgtggggctggacagggctgcggcccctctgcccacactcagtactgaccaaagccagggctgtgtgtgcctgtgtgtaggtcccacggcctctgcctccccagggagcagagcctgggcctcccctaagaggctttccccgaggcagctctggaatctgtgcccacctggggcctggggaacaaggccctcctttctccaggcctgggctacaggggagggagagcctgaggctctgctcagggcccatttcatctctggcagtgccttggcggtggtattcaaggcagttttgtagcacctgtaattggggagagggagtgtgcccctcggggcaggagggaagggcatctggggaagggcaggagggaagagctgtccatgcagccacgcccatggccaggttggcctcttctcagcctcccaggtgccttgagccctcttgcaagggcggctgcttccttgagcctagtttttttacgtgatttttgtaacattcatttttttgtacagataacaggagtttctgactaatcaaagctggtatttccccgcatgtcttattcttgcccttcccccaaccagtttgttaatcaaacaataaaaacatgttttgtttttttttttt

SEQ ID NO: 96779 - DNA, 1520 bp, Homo sapiens
ctgccatgttcctcccggcaggattgtcccagccctagccgagggggaccgagtgctgcagtgatgaggagaacagcccatgagggaggtcaggagacctgaattccagtcctggcaagaccccacccagcctgctctgtgacctcactccctccccaagtctcgagctcctcatctgtaaaacaagaggctggatggtggaggagtgtggagaggggctctggagggcaaagggaagattccagcgtgggcccatccctgggcggtagaaagagcactgggcctggaaccaggacagccagaccattgacttcctgaacgacaacattcgaagaggaattgagaactactatgatgatctggacttcaaaaacatcatggactttgttcagaaaaagttcaagtgctgtggcggggaggactaccgagattggagcaagaatcagtaccacgactgcagtgcccctggacccctggcctgtggggtgccctacacctgctgcatcaggaacacgacagaagttgtcaacaccatgtgtggctacaaaactatcgacaaggagcgtttcagtgtgcaggatgtcatctacgtgcggggctgcaccaacgccgtgatcatctggttcatggacaactacaccatcatggcgggcatcctcctgggcatcctgcttccccagttcctgggggtgctgctgacgctgctgtacatcacccgggtggaggacatcatcatggagcactctgtcactgatgggctcctggggcccggtgccaagcccagcgtggaggcggcaggcacgggatgctgcttgtgctaccccaattagggcccagcctgccatggcagctccaacaaggaccgtctgggatagcacctctcagtcaacatcgtggggctggacagggctgcggcccctctgcccacactcagtactgaccaaagccagggctgtgtgtgcctgtgtgtaggtcccacggcctctgcctccccagggagcagagcctgggcctcccctaagaggctttccccgaggcagctctggaatctgtgcccacctggggcctggggaacaaggccctcctttctccaggcctgggctacaggggagggagagcctgaggctctgctcagggcccatttcatctctggcagtgccttggcggtggtattcaaggcagttttgtagcacctgtaattggggagagggagtgtgcccctcggggcaggagggaagggcatctggggaagggcaggagggaagagctgtccatgcagccacgcccatggccaggttggcctcttctcagcctcccaggtgccttgagccctcttgcaagggcggctgcttccttgagcctagtttttttacgtgatttttgtaacattcatttttttgtacagataacaggagtttctgactaatcaaagctggtatttccccgcatgtcttattcttgcccttcccccaaccagtttgttaatcaaacaataaaaacatgttttgtttttttttttt

SEQ ID NO: 96780 - DNA, 1746 bp, Homo sapiens
  misc_feature (2)..(2): n is a, c, g, or t
  misc_feature (5)..(5): n is a, c, g, or t
  misc_feature (1703)..(1703): n is a, c, g, or t
gnccnggagagaacgccggtggcggggctggtagcccggcagccgcaggtggggccacgagcgctggctgagggaccgagccggagagccccggagcccccgtaacccgcgcggggagcgcccaggatgccgcgcggggactcggagcaggtgcgctactgcgcgcgcttctcctacctctggctcaagttttcacttatcatctattccaccgtgttctggctgattggggccctggtcctgtctgtgggcatctatgcagaggttgagcggcagaaatataaaacccttgaaagtgccttcctggctccagccatcatcctcatcctcctgggcgtcgtcatgttcatggtctccttcattggtgtgctggcgtccctccgtgacaacctgtaccttctccaagcattcatgtacatccttgggatctgcctcatcatggagctcattggtggcgtggtggccttgaccttccggaaccagaccattgacttcctgaacgacaacattcgaagaggaattgagaactactatgatgatctggacttcaaaaacatcatggactttgttcagaaaaagttcaagtgctgtggcggggaggactaccgagattggagcaagaatcagtaccacgactgcagtgcccctggacccctggcctgtggggtgccctacacctgctgcatcaggaacacgacagaagttgtcaacaccatgtgtggctacaaaactatcgacaaggagcgtttcagtgtgcaggatgtcatctacgtgcggggctgcaccaacgccgtgatcatctggttcatggacaactacaccatcatggcgggcatcctcctgggcatcctgcttccccagttcctgggggtgctgctgacgctgctgtacatcacccgggtggaggacatcatcatggagcactctgtcactgatgggctcctggggcccggtgccaagcccagcgtggaggcggcaggcacgggatgctgcttgtgctaccccaattagggcccagcctgccatggcagctccaacaaggaccgtctgggatagcacctctcagtcaacatcgtggggctggacagggctgcggcccctctgcccacactcagtactgaccaaagccagggctgtgtgtgcctgtgtgtaggtcccacggcctctgcctccccagggagcagagcctgggcctcccctaagaggctttccccgaggcagctctggaatctgtgcccacctggggcctggggaacaaggccctcctttctccaggcctgggctacaggggagggagagcctgaggctctgctcagggcccatttcatctctggcagtgccttggcggtggtattcaaggcagttttgtagcacctgtaattggggagagggagtgtgcccctcggggcaggagggaagggcatctggggaagggcaggagggaagagctgtccatgcagccacgcccatggccaggttggcctcttctcagcctcccaggtgccttgagccctcttgcaagggcggctgcttccttgagcctagtttttttacgtgatttttgtaacattcatttttttgtacagataacaggagtttctgactaatcaaagctggtatttccccgcatgtcttattcttgcccttcccccaaccagtttgttaatcaaacaataaaaacatgttttgtttttttttttttnttttttttttttttttttttttttttttttttttttttttttt

SEQ ID NO: 96781 - DNA, 1788 bp, Homo sapiens
  misc_feature (2)..(2): n is a, c, g, or t
  misc_feature (5)..(5): n is a, c, g, or t
gnccnggagagaacgccggtggcggggctggtagcccggcagccgcaggtggggccacgagcgctggctgagggaccgagccggagagccccggagcccccgtaacccgcgcggggagcgcccaggatgccgcgcggggactcggagcaggtgcgctactgcgcgcgcttctcctacctctggctcaagttttcacttatcatctattccaccgtgttctggctgattggggccctggtcctgtctgtgggcatctatgcagaggttgagcggcagaaatataaaacccttgaaagtgccttcctggctccagccatcatcctcatcctcctgggcgtcgtcatgttcatggtctccttcattggtgtgctggcgtccctccgtgacaacctgtaccttctccaagcattcatgtacatccttgggatctgcctcatcatggagctcattggtggcgtggtggccttgaccttccggaaccagaccattgacttcctgaacgacaacattcgaagaggaattgagaactactatgatgatctggacttcaaaaacatcatggactttgttcagaaaaagttcaagtgctgtggcggggaggactaccgagattggagcaagaatcagtaccacgactgcagtgcccctggacccctggcctgtggggtgccctacacctgctgcatcaggaacacgacagaagttgtcaacaccatgtgtggctacaaaactatcgacaaggagcgtttcagtgtgcaggatgtcatctacgtgcggggctgcaccaacgccgtgatcatctggttcatggacaactacaccatcatggcgggcatcctcctgggcatcctgcttccccagttcctgggggtgctgctgacgctgctgtacatcacccgggtggaggacatcatcatggagcactctgtcactgatgggctcctggggcccggtgccaagcccagcgtggaggcggcaggcacgggatgctgcttgtgctaccccaattagggcccagcctgccatggcagctccaacaaggaccgtctgggatagcacctctcagtcaacatcgtggggctggacagggctgcggcccctctgcccacactcagtactgaccaaagccagggctgtgtgtgcctgtgtgtaggtcccacggcctctgcctccccagggagcagagcctgggcctcccctaagaggctttccccgaggcagctctggaatctgtgcccacctggggcctggggaacaaggccctcctttctccaggcctgggctacaggggagggagagcctgaggctctgctcagggcccatttcatctctggcagtgccttggcggtggtattcaaggcagttttgtagcacctgtaattggggagagggagtgtgcccctcggggcaggagggaagggcatctggggaagggcaggagggaagagctgtccatgcagccacgcccatggccaggttggcctcttctcagcctcccaggtgccttgagccctcttgcaagggcggctgcttccttgagcctagtttttttacgtgatttttgtaacattcatttttttgtacagataacaggagtttctgactaatcaaagctggtatttccccgcatgtcttattcttgcccttcccccaaccagtttgttaatcaaacaataaaaacatgttttgttttttttttttattatttattaaaaaaaccacagcaaatttttaacccaaaactaaggtccaaattaatagcaccaccaaaagcccctatcaaatttc

SEQ ID NO: 96782 - DNA, 975 bp, Homo sapiens
cggacgcgtgggtcgacccacgcgttcgccacgcgtcgcatctacgtgcggggctgcaccaacgccgtgatcatctggttcatggacaactacaccatcatggcgggcatcctcctgggcatcctgcttccccagttcctgggggtgctgctgacgctgctgtacatcacccgggtggaggacatcatcatggagcactctgtcactgatgggctcctggggcccggtgccaagcccagcgtggaggcggcaggcacgggatgctgcttgtgctaccccaattagggcccagcctgccatggcagctccaacaaggaccgtctgggatagcacctctcagtcaacatcgtggggctggacagggctgcggcccctctgcccacactcagtactgaccaaagccagggctgtgtgtgcctgtgtgtaggtcccacggcctctgcctccccagggagcagagcctgggcctcccctaagaggctttccccgaggcagctctggaatctgtgcccacctggggcctggggaacaaggccctcctttctccaggcctgggctacaggggagggagagcctgaggctctgctcagggcccatttcatctctggcagtgccttggcggtggtattcaaggcagttttgtagcacctgtaattggggagagggagtgtgcccctcggggcaggagggaagggcatctggggaagggcaggagggaagagctgtccatgcagccacgcccatggccaggttggcctcttctcagcctcccaggtgccttgagccctcttgcaagggcggctgcttccttgagcctagtttttttacgtgatttttgtaacattcatttttttgtacagataacaggagtttctgactaatcaaagctggtatttccccgcatgtcttattcttgcccttcccccaaccagtttgttaatcaaacaataaaaacatgttttgtttttttttttt

SEQ ID NO: 96783 - DNA, 1004 bp, Homo sapiens
  misc_feature (2)..(2): n is a, c, g, or t
  misc_feature (5)..(5): n is a, c, g, or t
gnccnggagagaacgccggtggcggggctggtagcccggcagccgcaggtggggccacgagcgctggctgagggaccgagccggagagccccggagcccccgtaacccgcgcggggagcgcccaggatgccgcgcggggactcggagcaggtgcgctactgcgcgcgcttctcctacctctggctcaagttttcacttatcatctattccaccgtgttctggctgattggggccctggtcctgtctgtgggcatctatgcagaggttgagcggcagaaatataaaacccttgaaagtgccttcctggctccagccatcatcctcatcctcctgggcgtcgtcatgttcatggtctccttcattggtgtgctggcgtccctccgtgacaacctgtaccttctccaagcattcatgtacatccttgggatctgcctcatcatggagctcattggtggcgtggtggccttgaccttccggaaccagaccattgacttcctgaacgacaacattcgaagaggaattgagaactactatgatgatctggacttcaaaaacatcatggactttgttcagaaaaagttcaagtgctgtggcggggaggactaccgagattggagcaagaatcagtaccacgactgcagtgcccctggacccctggcctgtggggtgccctacacctgtaattggggagagggagtgtgcccctcggggcaggagggaagggcatctggggaagggcaggagggaagagctgtccatgcagccacgcccatggccaggttggcctcttctcagcctcccaggtgccttgagccctcttgcaagggcggctgcttccttgagcctagtttttttacgtgatttttgtaacattcatttttttgtacagataacaggagtttctgactaatcaaagctggtatttccccgcatgtcttattcttgcccttcccccaaccagtttgttaatcaaacaataaaaacatgttttgtttttttttttt

SEQ ID NO: 96784 - DNA, 957 bp, Homo sapiens
attaaccttcaagtattctacacatcaaggaaaacatttagtggcatacaaatgtcacctaataagtgggtgaaacctgggcatgctggctcatgcctataattctagaaatttaggaggccaagtcagaacgatcatttgaggccaaaagtttgagactagccatgaaaatatatcaagaccctgtcttgtatagggtaatatatgtgcatacatacatacatataacaaaaaagtgtaaaaatattttctaatcacatatttggtaggtgttaatttccaaaagatataaacttctaaaattcaacaacaacaaaatgttaataacttgatttagaatggtaaatgtttgaaatgacctttctccaaagaagacatagaaatgactaggtatttaaaaggatactcgtccgagggcaggactatgggaggctgccctgtacggaaaataagaagaaatggcagtaaagagggcaaccatcattccacccagcccaaaaggaataagagaaaccctatctttcaggattctcaagacacagttttcatggagtgataatgaaaggagcagcagccgccttaatatcccagagagagcaggtggaccagaaggcaacttaaaccagattgttactgaacccaatgcaaactttccccagttcttgcatgaggggtatgtaccatgccaaggtctttactcccatatcaaccagaccttgaaggaggctcacttcaacagcctgcagcagtgagggcaagctccaacatgatgaattaggacttccttattccaacctaaactgtgtttataaaagtaattgcatacacaccaaaaaaaaagtctattggtttttaagtctaaattttaagtaacaagttaatgggcagttgtttaattggggttttacttcactgctgtacttttaaaggggctgtgaataaatgtttatgaaatta

SEQ ID NO: 96785 - DNA, 732 bp, Homo sapiens
agccggacgcgcggaggtgggcaatccgctccttcccttgagcagtccacgccttgtggcggctttgcggagctgctgctttggcgggagttggaagctggtgtgaggtttctgtggggagaaggagagtgccagaggtgactggttcgtggttcttctaggctctcatggccaccatgttggaaggcagatgccaaactcagccaaggagcagccccagtggccgagaggctagcctgtggtcgtcaggctttgggatgaagctggaggctgtcactccattcctggggaagtatcgcccctttgtgggtcgctgttgccagacctgcacccccaagagctgggagtccctcttccacagaagcataacggacctaggcttctgcaatgtgatcctggtgaaggaggagaacacaaggtttcggggctggctggttcggaggctctgctatttcctgtggtccctggagcagcacatccccctctggcaggatgtcccacagaagatcatggaaagcaccggggtgcagaacctcctctcagggagggtcccaggaggcactggggaaggccaggtgcctgaccttgtgaagaaggaggtacagcgcatcctgggtcacatccaggccccaccccgtcccttcctgctgttcagctgggcgctgctgaggttcctgaactgcctgttcctgaatgtgcagctccacaagggtcagatgaagatggtccaga

SEQ ID NO: 96786 - DNA, 757 bp, Homo sapiens
agccggacgcgcggaggtgggcaatccgctccttcccttgagcagtccacgccttgtggcggctttgcggagctgctgctttggcgggagttggaagctggtgtgaggtgagaggcgcggtggtcgctccccggcgaggccaggtttctgtggggagaaggagagtgccagaggtgactggttcgtggttcttctaggctctcatggccaccatgttggaaggcagatgccaaactcagccaaggagcagccccagtggccgagaggctagcctgtggtcgtcaggctttgggatgaagctggaggctgtcactccattcctggggaagtatcgcccctttgtgggtcgctgttgccagacctgcacccccaagagctgggagtccctcttccacagaagcataacggacctaggcttctgcaatgtgatcctggtgaaggaggagaacacaaggtttcggggctggctggttcggaggctctgctatttcctgtggtccctggagcagcacatccccctctggcaggatgtcccacagaagatcatggaaagcaccggggtgcagaacctcctctcagggagggtcccaggaggcactggggaaggccaggtgcctgaccttgtgaagaaggaggtacagcgcatcctgggtcacatccaggccccaccccgtcccttcctctttatgctgctctcccagggcctgggtgtgcttcgtgtggcctgggactcccgcgcctgctcccctgccctcag

SEQ ID NO: 96787 - DNA, 608 bp, Homo sapiens
tattgttctgtctagtacagtcgtgactagctacagttggcgattgagcagttgaaatgtaccttgtggtctgtggcacagttgccatttcccgggtaagatgtctgcagtctgtgtactgaggacctggagcaggaatgctgggcagctgatttgtttcactgttttccaacatgtagtaatgttcatgttttgaagccaaattatgtgtgtttctttgattatccttcattcaagtatagtcatccacataactttctgaaaacaattaatgctgtatgtggacagcttgttcagttcagattctcagacactgaagaagggattagaaaagtaactgttaatgttatgtaaaagaaggagatacagtgtctcagtttgataacatcggtaaagttcaaagtgataaagcttctgttaccatcgctagtccttatgatggagtcattgaaaactctagcatagtctagatgatattgcctatgtggggaagccattagtaaacatagaaacagaagctttaaagggtactgttaatttgttttaccaaattgattattgtccaccttttgtcattgggtctcaattaaaagtgaccttaaaaaaaa

SEQ ID NO: 96788 - DNA, 295 bp, Homo sapiens
tttcagacacaagacttcactcccccagcagaagacagagatggtgtcatagatggtatgtcttgcctaacatgtcaggattccagcagattgatgatcaaggacagtgatgaagaccagaacaaaagggaaaagaaaagactctaaacagccaaaacatgcatctaacacccgggcaattaagaattgttattttctggctactctacacacactgcctagaaggtagccttgctctataggagtcatggagctgtaaaactgcatccttaataaagctacttctacaaaaacg

SEQ ID NO: 96789 - DNA, 285 bp, Homo sapiens
ggtattcatttaattcatcaactttttattgagtttaggaccaaatgccagcaattcagccaagttctaaagacacacatttaaattaaacagttatcttcaaggagcttggtgtctgcagttcagtagacacttataacaccaacagtaccattcatttgctgtgccctctgccgggttgctcttctcccagtgtttcatatggctggctacttcttatcctttaagatctctttttaagattctttctttctttttttttttttttttttttgagacggagtc

SEQ ID NO: 96790 - DNA, 188 bp, Homo sapiens
gctccaagtcttagccttgtgggtattatggccatgcagcctggtgaagtcaacagtgacagcgacaggtcgggggcggtggctcacgcctgtaatcccagcactttgggaggccgaggtgggcggatcacctgaggtcaggagttcaagaccagcctggccaacgcggcgaaaccccatctctacta

SEQ ID NO: 96791 - DNA, 167 bp, Homo sapiens
aagtcataaaaattcctttgaggaggaggcctttccggtaccagggcaagaaaataacccttatctccagggactgggaactgccactgagctggacctgtacagataaacttacttaataaatccttatcttccactaggtttacatccccccataaatctcctag

SEQ ID NO: 96792 - DNA, 195 bp, Homo sapiens
aaaggccaggtgcagtggctcacctgtaatcccagcacctgggaagactgatgggaagactgctgaggccattagttcagtaccagcctgggcaacataacgagaccaaatctccacaaaaaatttgaaagaacaaattaggtgagatggcacatgcctgtactcccagctactagggaggctgatagggaggct

SEQ ID NO: 96793 - DNA, 447 bp, Homo sapiens
catttctctgatggccagtgatggtgagcattttttcatgtgttttttggctgcataaatgtcttcttttgagaagtgtctcttcatatccttcacccactttttgatggggttgtttgttttttcttgtaaatttgtttgagttcattgtagattctggatattagccctttgtcagatgagtaggttgcgaaaattttctcccattttgtaggtttatgcatcacttttcaactccagtccatttattttctaatattctactctgatctcttcccctacctcctctttacgctcaataattcatggatttgcccttttgaggctattttctagatcttgcaggcatgcctaatgtctttttattctttttgttgttgttgtttctcctctgactatgtattttcatatagcctgtcttcaagctcactgattcttctgcttgat

SEQ ID NO: 96794 - DNA, 755 bp, Homo sapiens
tgcccatggtcagctagcatgtaaatggtggaaagaagacttgagcccatatctgtctggccccagagtcctcctgcagcctatctgagtctgtgcagccccagcacctgtagtaggccctcggcaagactgtaatgaatgaatgagtgaacggatgaagtcaaagagccagaagctttcaagaacaacttcatggactgttttggaatatttgtacccctagatctctcagagggcaatagtctccaccgtgcttctcccaacatcaggaggaagacagtggagtggaacatagtagataggaaaatatgttatcaattcctccccgccctgcacacggctgcttactaatgtgactttgccactgttctgggcaagaggtggagtctgtttccctaccccttgaacctgggttcgcctgggactactttggccaatagaatgtggcagaagtgatgttatgcaaattctgacattaggccttaagagaccttgcagctttcacgtttactgtcctggaacacagtcctgagactgctatgtaaggaagccagcctactggaggatgaaagaaccaatgtgtccccgccgacagccaagaccaactgccagacatgtaaatgagccatcttggaccttccagtcagctgctcctccggtttaggctcagatgcgtgagtaagcccagacaaaatcagcagaggaatggcccagccaactggatttctctatcagtcatctagagctatgtaaaa

SEQ ID NO: 96795 - DNA, 501 bp, Homo sapiens
caactggacactggtcccccaggtctccgtgtggctactgcctcattcttcatgttagagctcagatgtcaccctcctcacggagacgtcccccgaccacctgagctaaagccgcccccaacatcttacgtcaccctgttggtgtacttcacctggttcatttaattctcagtaacttaatctcatggcaagtgctttttaaaccttcactagctctgcctctcccactggaatattagctctgtgaatgcaggaacccagctagtctgagttaactgttataaccagcgccagtgcctgacacgtagcagggcctcagtaagttttgctgaatcaatgaattcttgctttcaagagagctcttttcaaaacacgctggtgcttgtctgaagcagttaaggttataacaacacttgttcaaagagacctttcagaccacacttccttaagagtgtagaagtttaaatcaccttattcaccaccgacttctaagggccaatc

SEQ ID NO: 96796 - DNA, 239 bp, Homo sapiens
agtagggaagaaatgattgtagcagtgtgggacctgttaggtctatgagcaggactttaacccaaagggccatatgttactgatagtgacaggagacagctaaatgcctaggcagataagggagggtccctggtgaaataccacctccaagctgaagacagtttaaagcctgaaagccaagctacaacttaaatccttggactaaattgagaatttgccttcctatttggtccactttc

SEQ ID NO: 96797 - DNA, 2246 bp, Homo sapiens
gaacccccccagttgtccgccatgattaggggccaagatgcagagatgttaaggtacataaccaatttagaggtgaaggaactcagacaccctagaaccggttgcaagttcaagttcttctttagaagaaacccctacttcagaaacaagctgattgtcaaggaatatgaggtaagatcctccggccgagtggtgtctctttctactccaattatatggcgcagggggcatgaaccccagtccttcattcgcagaaaccaagacctcatctgcagcttcttcacttggttttcagaccacagccttccagagtccgacaaaattgctgagattattaaagaggatctgtggccaaatccactgcaatactacctgttgcgtgaaggagtccgtagagcccgacgtcgcccgctaagggagcctgtagagatccccaggccctttgggttccagtctggttaacatttgcccttgggaatactcctgcacaaggtctcctaccaccttctgctggacctgtgcttgggcatcagcaatgagtatgccttctattgtgctttgtttttgctgacttttctgcaccctgtttcctttggatattcagttctctcaacctcaagattgagacggtggtgggtatgcttctccacttccatatgaccttcatgctgttctggaatatcacatgctacgaggtcatccttcacactacttgtaagccaagcaaatgatactgtagattgtactgcctttatctgcactgcttggaccctgtttattcccagggcctctgaactggttgctgtcacttggatttctagctttgggagcctgttccacctactcagctctgcattgagcagtatgggcacatgccctgtggacagttactggacgttaatgaactcagaggagaaaagcagtgagccacttgttctgtgtgatttatggtacttcattgctcttccttcacctctagtcactttctattgctacctgccctacattggctcctgccaaggtccctctctctccctgttttccttttttttttttttttttctgagacggaggacggagtcttgctctgtcgcccaggttggagtgcagtggcgcgatctcggctcactgcaacctccacctcccgggttcaagcgattctcctgcctcagcctcccgagtagctgggactacaggcgcgcgccgccacgcccggctaatttttatatttttagtagagacggggtttcaccatgctggccaggctggtctcgaaccccgacctcgtgatccgccctccttagcctcccaatcctctcttaaaaaagtgatagctcagaaacatttgtaaaagcaaggtttttatttcattttggctctgtcattttcagaggcaaagaagttggcctgtaaaatagagtgctagagctcttacgcccctccccttcttcccaacttcctacttcctagcccttttatcaactcctagaatagttaaagagagacacatctagatgggatgaaaggtgccctaagcaggagaaactgaacaaaaggctagaggcatgggccaggtaaaaattgggcctagagtgaagactgtgctgtcgttaagagctttcgaggaaggagtacttactccccaatgatgatgaatggaaaaatacttttcagggagaattgaaggggttaaagtgttaaatatgttgcctagacaagggttctttaaagaaagacagcgcaactttgaatgctttcttacttgttttgtgacctaatttatgtggaagattgttatttcattaggatttagtaaaatttttttttctgattctaaacttattgtgaaaattgagctgtacagatattcttttgatttcaattgggaacatttggaagaacaacagtcttacttgcctgtacaatatagagacatatgaatagtcataacagttttcaacttgttcttgtttctgttaaactatattcctagaaacatagtttgaacaacttggtctttgttaggcttgtcaaattgccttcatggaaaaataatctacaaaagtatggtttaattgattgtcttacatgataattttccctggtaacaacttagtaagtgatatatcttttttcctaaattgcttaaatactgtgaaattgctctgacaaattggaagtgtaccattggcatatttgtcttcctttttatgcatgatggtaaaataaaagcatgttgttctgct

SEQ ID NO: 96798 - DNA, 1137 bp, Homo sapiens
gagggttcaccatcttggccgtgctggtcttgaactcctgaccttgcgattctcctgcctcagcctcccgagtagctgggactacaggcgcgcgccgccacgcccggctaatttttatatttttagtagagacggggtttcaccatgctggccaggctggtctcgaaccccgacctcgtgatccgccctccttagcctcccaatcctctcttaaaaaagtgatagctcagaaacatttgtaaaagcaaggtttttatttcattttggctctgtcattttcagaggcaaagaagttggcctgtaaaatagagtgctagagctcttacgcccctccccttcttcccaacttcctacttcctagcccttttatcaactcctagaatagttaaagagagacacatctagatgggatgaaaggtgccctaagcaggagaaactgaacaaaaggctagaggcatgggccaggtaaaaattgggcctagagtgaagactgtgctgtcgttaagagctttcgaggaaggagtacttactccccaatgatgatgaatggaaaaatacttttcagggagaattgaaggggttaaagtgttaaatatgttgcctagacaagggttctttaaagaaagacagcgcaactttgaatgctttcttacttgttttgtgacctaatttatgtggaagattgttatttcattaggatttagtaaaatttttttttctgattctaaacttattgtgaaaattgagctgtacagatattcttttgatttcaattgggaacatttggaagaacaacagtcttacttgcctgtacaatatagagacatatgaatagtcataacagttttcaacttgttcttgtttctgttaaactatattcctagaaacatagtttgaacaacttggtctttgttaggcttgtcaaattgccttcatggaaaaataatctacaaaagtatggtttaattgattgtcttacatgataattttccctggtaacaacttagtaagtgatatatcttttttcctaaattgcttaaatactgtgaaattgctctgacaaattggaagtgtaccattggcatatttgtcttcctttttatgcatgatggtaaaataaaagcatgttgttctgct

SEQ ID NO: 96799 - DNA, 471 bp, Homo sapiens
  misc_feature (14)..(14): n is a, c, g, or t
  misc_feature (45)..(45): n is a, c, g, or t
aaaaccctaactgnaccctcagggtggatctgccccccccttggnctcccccaaagtgcctggggattacaggccgtgagcccactgtaccgagctcaacattccttaaaggaaagaaattcccaaccccagaatttcatatctggcaaaactaatctttataagagaagaagaaacaggatcattctcagacaagcaaatgctgagggaattgttaccatcagacctgtcttataagagttcctgaaggaagcactaaatatagaaaggaaacaccaccaaagaaaataaatatatcctacttgaaatttactctatggacttacccactgctagaataaatgtatcaaatcttatttgtaaattctcaattttgatatatatatgtatatatgcatatacatatccacacttgtctgcaagaatattgattaaaattgctaaatttgtacttgttcaccagaaaaatgt

SEQ ID NO: 96800 - DNA, 5071 bp, Homo sapiens
  misc_feature (1115)..(1115): n is a, c, g, or t
  misc_feature (1967)..(1967): n is a, c, g, or t
  misc_feature (2031)..(2031): n is a, c, g, or t
  misc_feature (2513)..(2513): n is a, c, g, or t
  misc_feature (2570)..(2570): n is a, c, g, or t
ttccagacactgtgtatgaatttgcagtccgtatttcacagggtgaaagagatggcaaatggagtacgtcagtcttccaaagaacaccagaatctgcccctaccacagctcctgaaaacttgaacgtctggccagtcaatggcaaacctacagttgtcgctgcatcttgggatgcgctaccagagactgaggggaaagtgaaagaatacattctttcatacgccccggctctcaaaccatttggagcaaagtccctcacctatcctggagacactacttctgccctggtggatggtctgcagcctggggaacgctatcttttcaaaatccgggccacaaacaggagaggcctgggacctcactccaaagccttcattgtcgctatgccaacaaccagtaaggcggatgttcagcagaacacggaggacaatgggaaacccgaaaaacctgagccttcctcaccttctcccagagctccagcttcctcccaacacccctctgtgcctgcttctccccaagggagaaatgccaaggaccttcttcttgacttgaagaacaaaatattggctaatggtggggcgccccgaaaaccccagcttcgcgccaagaaggcagaggagctggatcttcagtcgacagaaatcactggggaggaggagctgggttcccgggaggactcgcccatgtcaccctcagacacccaagaccagaaacggaccctgaggccgccaagtagacacggccactcggtggttgctcccggcaggactgcagtgagggcccggatgccagcgctgccccgaagggaaggcgtagataagcctggcttttccctggccacgcagccccgcccaggggcgcccccctcggcttcggcctctcctgcccaccacgcgtccacccagggcacctctcatcgtccttccctgcctgccagcttgaatgacaacgacttggtggactcagacgaagatgagcgcgctgtgggctccctccaccccaagggcgccttcgcccagccccggccagccctgtcccccagccgccagtccccgtccagcgttctccgcgacagaagctctgtgcaccccggcgcaaagccagcctcgccggcncggaggaccccccattcaggggccgcagaggaagattccagtgcctcagccccaccctcaagactttctccaccccatgggggatcatctcggctgctgcccacccagccacacctgagctctccactttccaagggcgggaaggatggtgaggacgccccagccaccaactccaatgcgccatcacggtccaccatgtcctcctccgtctcttctcatctctcgtccaggacgcaggtctctgagggagcggaggcttctgatggtgaaagccacggtgacggcgatagggaagacggcggaaggcaggcggaggccacggcccagacgctgcgggcccggcctgcctctggacacttccatttgctcagacacaaaccctttgctgccaacgggaggtctccaagcaggttcagcattgggcggggacctcggctgcagccctccagctccccacagtcgactgtgccctcccgagcccaccccagggttccctctcactctgattcccaccctaagcttagctcaggtatccatggagacgaggaggatgagaagccgcttcctgccaccgttgtcaatgaccacgtgccttcctcctccaggcagcccatctcccggggctgggaggacttaaggagaagcccgcagagaggggccagcctgcatcggaaggaacccatcccagagaaccccaaatccacaggggcagatacacatcctcagggcaagtactcctccctggcctccaaggctcaggatgttcaacagagcacagacgcggacacggagggtcattctcccaaagcacagccagggtccacagaccgccacgcgtcccctgctcgtccncccgcagcacggtcacagcagcatcccagtgttcccagaaggatgacacccggccgggccccanaacagcagccccctcctcccgtcgccacgtcccagcaccacccgggaccccagagcagagacgcgggtcggtcaccttcccagcccaggctctcactgacccaggccgggcggccccgccccacgtcgcagggccgctcccactcctcctcggacccttacacggcgagctccagagggatgctccccacggccctccagaaccaggacgaggatgcccagggcagctacgacgacgacagcacagaagtcgaggcccaggatgtgcgggcccccgcgcacgccgcgcgcgccaaggaggcagctgcgtcccttcccaagcaccagcaggggcggcaaagacgccgatgggagcctcgccaaggaagagagggagcctgccatcgcgcttgcccctcgcggagggagcctggctcctgtgaagcgacctctccccccacctccaggcagctcccccagggcctcccacgtcccttcccgacngccgcctcgcagcgctgccaccgtgagccccgtcgcgggcacccacccctggccgcngtacaccacgcgcgccccacctggccacttctccaccaccccgatgctgtccttgcgccagaggatgatgcatgccagattccgtaaccctctctcccgacagcctgccagaccctcttacagacaaggttataatggcagaccaaatgtagaagggaaagtccttcctggtagtaatggaaaaccgaatggacagagaattatcaatggccctcaaggaacaaagtgggttgtggaccttgatcgtgggttagtattgaatgcagaaggaaggtacctccaagattcacatggaaatcctcttcggattaaactaggaggagatggtcgaaccattgtagatctggaagggacccccgtggtgagtcctgacggcctcccactctttgggcaggggcgacatggcacacctctggccaatgcccaagataagccaattttgagtcttggaggaaagccgctggtgggcttggaggtcatcaaaaaaaccacccatccccctaccactaccatgcagcccaccactactacgacgcccctgcctaccactacaaccccgaggcccaccactgccaccacccgccgcacgaccaccaggcgtccaacaaccacagtccgaaccactacgcggacaaccaccaccaccacccccaaacccaccactcccatccccacctgtccccctgggaccttggaacggcacgacgatgatggcaacctgataatgagctccaatgggatcccagagtgctacgctgaagaagatgagttctcaggcttggagactgacactgcagtacctacggaagaggcctacgttatatatgatgaagattatgaatttgagacgtcaaggccaccaaccaccactgagccttcgaccactgctaccacaccgagggtgatcccagaggaaggcgccatcagttcctttcctgaagaagaatttgatctggctggaaggaaacgatttgttgctccttacgtgacgtacctaaataaagacccatcagccccgtgctctctgactgatgcactggatcacttccaagtggacagcctggatgaaatcatccccaatgacctgaagaagagtgatctgcctccccagcatgctccccgcaacatcaccgtggtggccgtggaaggttgccactcatttgtcattgtggactgggacaaagccaccccaggagatgtggtcacaggttacttggtttacagtgcatcctatgaagacttcatcaggaacaagtggtccactcaagcttcatcagtaactcacttgcccattgagaacctaaagcccaacacgaggtattattttaaagtgcaagcacaaaatcctcatggctacggacctatcagcccttcggtctcatttgtcaccgaatcagataatcctctgcttgttgtgaggcccccaggcggtgagcctatctggatcccattcgctttcaaacatgatcccagctacacggactgccatggacggcaatatgtgaagcgcacgtggtatcgaaagttcgtgggagttgttctttgtaattcactgaggtataaaatctacctcagtgacaacctgaaagatacattctacagcattggagacagctggggaagaggtgaagaccattgccaatttgtggattcacaccttgatggaagaacagggcctcagtcctatgtagaagccctccctactattcaaggctactatcgccagtatcgtcaggagcctgtcaggtttgggaacatcggcttcggaaccccctactactatgtgggctggtacgagtgtggggtctccatccctggaaagtggtaatcacaggaccgtcatgctgcaagcttgccctgcccagccccaccaactaagtcgcactaggggctgtgagcaaagacagccagcatgctcagccccgctgccctaggtgccaggaaggtcacagatggacactggccattctggtcatctcagtctggaactcagtcccacttcttggcctggacaatgaacaggattcagttttgctgttaactttgcttctctacttttttttgtttgtttgtaatagcacatcccagagacatcagaaaccagcaactgattcagtgtgatttccagactttttaggcatgaaattcggacacttcagtatttccaggaatagcatatgcacgctgttcttgcttcatggaatgctacatgctttctgtttttctcattttggatttctccaaaactaactgaatttaagcttcaggtccctttgtatgcagtagaaaggaattattaaaaacaccaccaaagaaaataaatatatcctacttgaaatttactctatggacttacccactgctagaataaatgtatcaaatcttatttgtaaattctcaattttgatatatatatgtatatatgcatatacatatccacacttgtctgcaagaatattgattaaaattgctaaatttgtacttgttcaccagaaaaatgt

SEQ ID NO: 96801 - DNA, 4695 bp, Homo sapiens
  misc_feature (1115)..(1115): n is a, c, g, or t
  misc_feature (1967)..(1967): n is a, c, g, or t
  misc_feature (2031)..(2031): n is a, c, g, or t
  misc_feature (2513)..(2513): n is a, c, g, or t
  misc_feature (2570)..(2570): n is a, c, g, or t
ttccagacactgtgtatgaatttgcagtccgtatttcacagggtgaaagagatggcaaatggagtacgtcagtcttccaaagaacaccagaatctgcccctaccacagctcctgaaaacttgaacgtctggccagtcaatggcaaacctacagttgtcgctgcatcttgggatgcgctaccagagactgaggggaaagtgaaagaatacattctttcatacgccccggctctcaaaccatttggagcaaagtccctcacctatcctggagacactacttctgccctggtggatggtctgcagcctggggaacgctatcttttcaaaatccgggccacaaacaggagaggcctgggacctcactccaaagccttcattgtcgctatgccaacaaccagtaaggcggatgttcagcagaacacggaggacaatgggaaacccgaaaaacctgagccttcctcaccttctcccagagctccagcttcctcccaacacccctctgtgcctgcttctccccaagggagaaatgccaaggaccttcttcttgacttgaagaacaaaatattggctaatggtggggcgccccgaaaaccccagcttcgcgccaagaaggcagaggagctggatcttcagtcgacagaaatcactggggaggaggagctgggttcccgggaggactcgcccatgtcaccctcagacacccaagaccagaaacggaccctgaggccgccaagtagacacggccactcggtggttgctcccggcaggactgcagtgagggcccggatgccagcgctgccccgaagggaaggcgtagataagcctggcttttccctggccacgcagccccgcccaggggcgcccccctcggcttcggcctctcctgcccaccacgcgtccacccagggcacctctcatcgtccttccctgcctgccagcttgaatgacaacgacttggtggactcagacgaagatgagcgcgctgtgggctccctccaccccaagggcgccttcgcccagccccggccagccctgtcccccagccgccagtccccgtccagcgttctccgcgacagaagctctgtgcaccccggcgcaaagccagcctcgccggcncggaggaccccccattcaggggccgcagaggaagattccagtgcctcagccccaccctcaagactttctccaccccatgggggatcatctcggctgctgcccacccagccacacctgagctctccactttccaagggcgggaaggatggtgaggacgccccagccaccaactccaatgcgccatcacggtccaccatgtcctcctccgtctcttctcatctctcgtccaggacgcaggtctctgagggagcggaggcttctgatggtgaaagccacggtgacggcgatagggaagacggcggaaggcaggcggaggccacggcccagacgctgcgggcccggcctgcctctggacacttccatttgctcagacacaaaccctttgctgccaacgggaggtctccaagcaggttcagcattgggcggggacctcggctgcagccctccagctccccacagtcgactgtgccctcccgagcccaccccagggttccctctcactctgattcccaccctaagcttagctcaggtatccatggagacgaggaggatgagaagccgcttcctgccaccgttgtcaatgaccacgtgccttcctcctccaggcagcccatctcccggggctgggaggacttaaggagaagcccgcagagaggggccagcctgcatcggaaggaacccatcccagagaaccccaaatccacaggggcagatacacatcctcagggcaagtactcctccctggcctccaaggctcaggatgttcaacagagcacagacgcggacacggagggtcattctcccaaagcacagccagggtccacagaccgccacgcgtcccctgctcgtccncccgcagcacggtcacagcagcatcccagtgttcccagaaggatgacacccggccgggccccanaacagcagccccctcctcccgtcgccacgtcccagcaccacccgggaccccagagcagagacgcgggtcggtcaccttcccagcccaggctctcactgacccaggccgggcggccccgccccacgtcgcagggccgctcccactcctcctcggacccttacacggcgagctccagagggatgctccccacggccctccagaaccaggacgaggatgcccagggcagctacgacgacgacagcacagaagtcgaggcccaggatgtgcgggcccccgcgcacgccgcgcgcgccaaggaggcagctgcgtcccttcccaagcaccagcaggggcggcaaagacgccgatgggagcctcgccaaggaagagagggagcctgccatcgcgcttgcccctcgcggagggagcctggctcctgtgaagcgacctctccccccacctccaggcagctcccccagggcctcccacgtcccttcccgacngccgcctcgcagcgctgccaccgtgagccccgtcgcgggcacccacccctggccgcngtacaccacgcgcgccccacctggccacttctccaccaccccgatgctgtccttgcgccagaggatgatgcatgccagattccgtaaccctctctcccgacagcctgccagaccctcttacagacaaggttataatggcagaccaaatgtagaagggaaagtccttcctggtagtaatggaaaaccgaatggacagagaattatcaatggccctcaaggaacaaagtgggttgtggaccttgatcgtgggttagtattgaatgcagaaggaaggtacctccaagattcacatggaaatcctcttcggattaaactaggaggagatggtcgaaccattgtagatctggaagggacccccgtggtgagtcctgacggcctcccactctttgggcaggggcgacatggcacacctctggccaatgcccaagataagccaattttgagtcttggaggaaagccgctggtgggcttggaggtcatcaaaaaaaccacccatccccctaccactaccatgcagcccaccactactacgacgcccctgcctaccactacaaccccgaggcccaccactgccaccacccgccgcacgaccaccaggcgtccaacaaccacagtccgaaccactacgcggacaaccaccaccaccacccccaaacccaccactcccatccccacctgtccccctgggaccttggaacggcacgacgatgatggcaacctgataatgagctccaatgggatcccagagtgctacgctgaagaagatgagttctcaggcttggagactgacactgcagtacctacggaagaggcctacgttatatatgatgaagattatgaatttgagacgtcaaggccaccaaccaccactgagccttcgaccactgctaccacaccgagggtgatcccagaggaaggcgccatcagttcctttcctgaagaagaatttgatctggctggaaggaaacgatttgttgctccttacgtgacgtacctaaataaagacccatcagccccgtgctctctgactgatgcactggatcacttccaagtggacagcctggatgaaatcatccccaatgacctgaagaagagtgatctgcctccccagcatgctccccgcaacatcaccgtggtggccgtggaaggttgccactcatttgtcattgtggactgggacaaagccaccccaggagatgtggtcacaggttacttggtttacagtgcatcctatgaagacttcatcaggaacaagtggtccactcaagcttcatcagtaactcacttgcccattgagaacctaaagcccaacacgaggtattattttaaagtgcaagcacaaaatcctcatggctacggacctatcagcccttcggtctcatttgtcaccgaatcagataatcctctgcttgttgtgaggcccccaggcggtgagcctatctggatcccattcgctttcaaacatgatcccagctacacggactgccatggacggcaatatgtgaagcgcacgtggtatcgaaagttcgtgggagttgttctttgtaattcactgaggtataaaatctacctcagtgacaacctgaaagatacattctacagcattggagacagctggggaagaggtgaagaccattgccaatttgtggattcacaccttgatgggacgaagatgtccctcagtacctccaagcaagtagctttccacatttgtcacagaaatcagaggagagatggtgttgggagccctttggagaacgccagtctcccaggccccctgcatctatcgagtttgcaatgtcacaacctctctgatcttgtgctcagcatgattctttaatagaagttttattttttcgtgcactctgctaataatgtgggtgagccagtggaacagcgggagacctgcgctagttttacagattgcctccttatgacgcggctcaaaaggaaaccaagtggtcaggagttgtttctgacccactgatctctactaccacaaggaaaatagtttaggagaaaccagcttttactgtttctgaaaaattacagcttcatcctgtcaagtagacaaggaatgcctgtgccaataaagtttctccaacttgaagtctactcatgatgg

SEQ ID NO: 96802 - DNA, 473 bp, Homo sapiens
attatcttcttccatggggagagagagatcatgccatcctagctgtgtcacacatgtgtggggactggacgatctctacagatctgtttgggataaagaaatactttacacttagtcactgggttcctatggaggaggcctgagctggtccccagctccagcatggcccctgagttacagctgggctttcccaaaaggcataagagacaggtggggaagaccccaccccaggctggggttggggctgggcccgaggtcctggcccttccccagggctatggcaaccacacacaaaaatggttcagtttatttgaaagtagcgttttgtcacaagaacaacttatcagaggccttctgtctgaaggaggctgtaaggatgagttctacctgttggttcaggggcctctgacgcttttcccctctcctgttgcccttccaggctactatcgccagtatcgtcaggagcctgtcag

SEQ ID NO: 96803 - DNA, 381 bp, Homo sapiens
gcaactgattcagtgtgatttccagactttttaggcatgaaattcggacacttcagtatttccaggaatagcatatgcacgctgttcttgcttcatggaatgctacatgctttctgtttttctcattttggatttctccaaaactaactgaatttaagcttcaggtccctttgtatgcagtagaaaggaattattaaaaacaccaccaaagaaaataaatatatcctacttgaaatttactctatggacttacccactgctagaataaatgtatcaaatcttatttgtaaattctcaattttgatatatatatgtatatatgcatatacatatccacacttgtctgcaagaatattgattaaaattgctaaatttgtactt

SEQ ID NO: 96804 - DNA, 5177 bp, Homo sapiens
  misc_feature (1115)..(1115): n is a, c, g, or t
  misc_feature (1967)..(1967): n is a, c, g, or t
  misc_feature (2031)..(2031): n is a, c, g, or t
  misc_feature (2513)..(2513): n is a, c, g, or t
  misc_feature (2570)..(2570): n is a, c, g, or t
ttccagacactgtgtatgaatttgcagtccgtatttcacagggtgaaagagatggcaaatggagtacgtcagtcttccaaagaacaccagaatctgcccctaccacagctcctgaaaacttgaacgtctggccagtcaatggcaaacctacagttgtcgctgcatcttgggatgcgctaccagagactgaggggaaagtgaaagaatacattctttcatacgccccggctctcaaaccatttggagcaaagtccctcacctatcctggagacactacttctgccctggtggatggtctgcagcctggggaacgctatcttttcaaaatccgggccacaaacaggagaggcctgggacctcactccaaagccttcattgtcgctatgccaacaaccagtaaggcggatgttcagcagaacacggaggacaatgggaaacccgaaaaacctgagccttcctcaccttctcccagagctccagcttcctcccaacacccctctgtgcctgcttctccccaagggagaaatgccaaggaccttcttcttgacttgaagaacaaaatattggctaatggtggggcgccccgaaaaccccagcttcgcgccaagaaggcagaggagctggatcttcagtcgacagaaatcactggggaggaggagctgggttcccgggaggactcgcccatgtcaccctcagacacccaagaccagaaacggaccctgaggccgccaagtagacacggccactcggtggttgctcccggcaggactgcagtgagggcccggatgccagcgctgccccgaagggaaggcgtagataagcctggcttttccctggccacgcagccccgcccaggggcgcccccctcggcttcggcctctcctgcccaccacgcgtccacccagggcacctctcatcgtccttccctgcctgccagcttgaatgacaacgacttggtggactcagacgaagatgagcgcgctgtgggctccctccaccccaagggcgccttcgcccagccccggccagccctgtcccccagccgccagtccccgtccagcgttctccgcgacagaagctctgtgcaccccggcgcaaagccagcctcgccggcncggaggaccccccattcaggggccgcagaggaagattccagtgcctcagccccaccctcaagactttctccaccccatgggggatcatctcggctgctgcccacccagccacacctgagctctccactttccaagggcgggaaggatggtgaggacgccccagccaccaactccaatgcgccatcacggtccaccatgtcctcctccgtctcttctcatctctcgtccaggacgcaggtctctgagggagcggaggcttctgatggtgaaagccacggtgacggcgatagggaagacggcggaaggcaggcggaggccacggcccagacgctgcgggcccggcctgcctctggacacttccatttgctcagacacaaaccctttgctgccaacgggaggtctccaagcaggttcagcattgggcggggacctcggctgcagccctccagctccccacagtcgactgtgccctcccgagcccaccccagggttccctctcactctgattcccaccctaagcttagctcaggtatccatggagacgaggaggatgagaagccgcttcctgccaccgttgtcaatgaccacgtgccttcctcctccaggcagcccatctcccggggctgggaggacttaaggagaagcccgcagagaggggccagcctgcatcggaaggaacccatcccagagaaccccaaatccacaggggcagatacacatcctcagggcaagtactcctccctggcctccaaggctcaggatgttcaacagagcacagacgcggacacggagggtcattctcccaaagcacagccagggtccacagaccgccacgcgtcccctgctcgtccncccgcagcacggtcacagcagcatcccagtgttcccagaaggatgacacccggccgggccccanaacagcagccccctcctcccgtcgccacgtcccagcaccacccgggaccccagagcagagacgcgggtcggtcaccttcccagcccaggctctcactgacccaggccgggcggccccgccccacgtcgcagggccgctcccactcctcctcggacccttacacggcgagctccagagggatgctccccacggccctccagaaccaggacgaggatgcccagggcagctacgacgacgacagcacagaagtcgaggcccaggatgtgcgggcccccgcgcacgccgcgcgcgccaaggaggcagctgcgtcccttcccaagcaccagcaggggcggcaaagacgccgatgggagcctcgccaaggaagagagggagcctgccatcgcgcttgcccctcgcggagggagcctggctcctgtgaagcgacctctccccccacctccaggcagctcccccagggcctcccacgtcccttcccgacngccgcctcgcagcgctgccaccgtgagccccgtcgcgggcacccacccctggccgcngtacaccacgcgcgccccacctggccacttctccaccaccccgatgctgtccttgcgccagaggatgatgcatgccagattccgtaaccctctctcccgacagcctgccagaccctcttacagacaaggttataatggcagaccaaatgtagaagggaaagtccttcctggtagtaatggaaaaccgaatggacagagaattatcaatggccctcaaggaacaaagtgggttgtggaccttgatcgtgggttagtattgaatgcagaaggaaggtacctccaagattcacatggaaatcctcttcggattaaactaggaggagatggtcgaaccattgtagatctggaagggacccccgtggtgagtcctgacggcctcccactctttgggcaggggcgacatggcacacctctggccaatgcccaagataagccaattttgagtcttggaggaaagccgctggtgggcttggaggtcatcaaaaaaaccacccatccccctaccactaccatgcagcccaccactactacgacgcccctgcctaccactacaaccccgaggcccaccactgccaccacccgccgcacgaccaccaggcgtccaacaaccacagtccgaaccactacgcggacaaccaccaccaccacccccaaacccaccactcccatccccacctgtccccctgggaccttggaacggcacgacgatgatggcaacctgataatgagctccaatgggatcccagagtgctacgctgaagaagatgagttctcaggcttggagactgacactgcagtacctacggaagaggcctacgttatatatgatgaagattatgaatttgagacgtcaaggccaccaaccaccactgagccttcgaccactgctaccacaccgagggtgatcccagaggaaggcgccatcagttcctttcctgaagaagaatttgatctggctggaaggaaacgatttgttgattgaaagacacaaacacatggatccatcaaggagagctgggggtgtgtttctgagcttggcatcaaggctgatggagcctccgtccagcaggaagagaccgaatgctccttacgtgacgtacctaaataaagacccatcagccccgtgctctctgactgatgcactggatcacttccaagtggacagcctggatgaaatcatccccaatgacctgaagaagagtgatctgcctccccagcatgctccccgcaacatcaccgtggtggccgtggaaggttgccactcatttgtcattgtggactgggacaaagccaccccaggagatgtggtcacaggttacttggtttacagtgcatcctatgaagacttcatcaggaacaagtggtccactcaagcttcatcagtaactcacttgcccattgagaacctaaagcccaacacgaggtattattttaaagtgcaagcacaaaatcctcatggctacggacctatcagcccttcggtctcatttgtcaccgaatcagataatcctctgcttgttgtgaggcccccaggcggtgagcctatctggatcccattcgctttcaaacatgatcccagctacacggactgccatggacggcaatatgtgaagcgcacgtggtatcgaaagttcgtgggagttgttctttgtaattcactgaggtataaaatctacctcagtgacaacctgaaagatacattctacagcattggagacagctggggaagaggtgaagaccattgccaatttgtggattcacaccttgatggaagaacagggcctcagtcctatgtagaagccctccctactattcaaggctactatcgccagtatcgtcaggagcctgtcaggtttgggaacatcggcttcggaaccccctactactatgtgggctggtacgagtgtggggtctccatccctggaaagtggtaatcacaggaccgtcatgctgcaagcttgccctgcccagccccaccaactaagtcgcactaggggctgtgagcaaagacagccagcatgctcagccccgctgccctaggtgccaggaaggtcacagatggacactggccattctggtcatctcagtctggaactcagtcccacttcttggcctggacaatgaacaggattcagttttgctgttaactttgcttctctacttttttttgtttgtttgtaatagcacatcccagagacatcagaaaccagcaactgattcagtgtgatttccagactttttaggcatgaaattcggacacttcagtatttccaggaatagcatatgcacgctgttcttgcttcatggaatgctacatgctttctgtttttctcattttggatttctccaaaactaactgaatttaagcttcaggtccctttgtatgcagtagaaaggaattattaaaaacaccaccaaagaaaataaatatatcctacttgaaatttactctatggacttacccactgctagaataaatgtatcaaatcttatttgtaaattctcaattttgatatatatatgtatatatgcatatacatatccacacttgtctgcaagaatattgattaaaattgctaaatttgtacttgttcaccagaaaaatgt

SEQ ID NO: 96805 - DNA, 4405 bp, Homo sapiens
  misc_feature (1115)..(1115): n is a, c, g, or t
  misc_feature (1967)..(1967): n is a, c, g, or t
  misc_feature (2031)..(2031): n is a, c, g, or t
  misc_feature (2513)..(2513): n is a, c, g, or t
  misc_feature (2570)..(2570): n is a, c, g, or t
  misc_feature (4380)..(4380): n is a, c, g, or t
ttccagacactgtgtatgaatttgcagtccgtatttcacagggtgaaagagatggcaaatggagtacgtcagtcttccaaagaacaccagaatctgcccctaccacagctcctgaaaacttgaacgtctggccagtcaatggcaaacctacagttgtcgctgcatcttgggatgcgctaccagagactgaggggaaagtgaaagaatacattctttcatacgccccggctctcaaaccatttggagcaaagtccctcacctatcctggagacactacttctgccctggtggatggtctgcagcctggggaacgctatcttttcaaaatccgggccacaaacaggagaggcctgggacctcactccaaagccttcattgtcgctatgccaacaaccagtaaggcggatgttcagcagaacacggaggacaatgggaaacccgaaaaacctgagccttcctcaccttctcccagagctccagcttcctcccaacacccctctgtgcctgcttctccccaagggagaaatgccaaggaccttcttcttgacttgaagaacaaaatattggctaatggtggggcgccccgaaaaccccagcttcgcgccaagaaggcagaggagctggatcttcagtcgacagaaatcactggggaggaggagctgggttcccgggaggactcgcccatgtcaccctcagacacccaagaccagaaacggaccctgaggccgccaagtagacacggccactcggtggttgctcccggcaggactgcagtgagggcccggatgccagcgctgccccgaagggaaggcgtagataagcctggcttttccctggccacgcagccccgcccaggggcgcccccctcggcttcggcctctcctgcccaccacgcgtccacccagggcacctctcatcgtccttccctgcctgccagcttgaatgacaacgacttggtggactcagacgaagatgagcgcgctgtgggctccctccaccccaagggcgccttcgcccagccccggccagccctgtcccccagccgccagtccccgtccagcgttctccgcgacagaagctctgtgcaccccggcgcaaagccagcctcgccggcncggaggaccccccattcaggggccgcagaggaagattccagtgcctcagccccaccctcaagactttctccaccccatgggggatcatctcggctgctgcccacccagccacacctgagctctccactttccaagggcgggaaggatggtgaggacgccccagccaccaactccaatgcgccatcacggtccaccatgtcctcctccgtctcttctcatctctcgtccaggacgcaggtctctgagggagcggaggcttctgatggtgaaagccacggtgacggcgatagggaagacggcggaaggcaggcggaggccacggcccagacgctgcgggcccggcctgcctctggacacttccatttgctcagacacaaaccctttgctgccaacgggaggtctccaagcaggttcagcattgggcggggacctcggctgcagccctccagctccccacagtcgactgtgccctcccgagcccaccccagggttccctctcactctgattcccaccctaagcttagctcaggtatccatggagacgaggaggatgagaagccgcttcctgccaccgttgtcaatgaccacgtgccttcctcctccaggcagcccatctcccggggctgggaggacttaaggagaagcccgcagagaggggccagcctgcatcggaaggaacccatcccagagaaccccaaatccacaggggcagatacacatcctcagggcaagtactcctccctggcctccaaggctcaggatgttcaacagagcacagacgcggacacggagggtcattctcccaaagcacagccagggtccacagaccgccacgcgtcccctgctcgtccncccgcagcacggtcacagcagcatcccagtgttcccagaaggatgacacccggccgggccccanaacagcagccccctcctcccgtcgccacgtcccagcaccacccgggaccccagagcagagacgcgggtcggtcaccttcccagcccaggctctcactgacccaggccgggcggccccgccccacgtcgcagggccgctcccactcctcctcggacccttacacggcgagctccagagggatgctccccacggccctccagaaccaggacgaggatgcccagggcagctacgacgacgacagcacagaagtcgaggcccaggatgtgcgggcccccgcgcacgccgcgcgcgccaaggaggcagctgcgtcccttcccaagcaccagcaggggcggcaaagacgccgatgggagcctcgccaaggaagagagggagcctgccatcgcgcttgcccctcgcggagggagcctggctcctgtgaagcgacctctccccccacctccaggcagctcccccagggcctcccacgtcccttcccgacngccgcctcgcagcgctgccaccgtgagccccgtcgcgggcacccacccctggccgcngtacaccacgcgcgccccacctggccacttctccaccaccccgatgctgtccttgcgccagaggatgatgcatgccagattccgtaaccctctctcccgacagcctgccagaccctcttacagacaaggttataatggcagaccaaatgtagaagggaaagtccttcctggtagtaatggaaaaccgaatggacagagaattatcaatggccctcaaggaacaaagtgggttgtggaccttgatcgtgggttagtattgaatgcagaaggaaggtacctccaagattcacatggaaatcctcttcggattaaactaggaggagatggtcgaaccattgtagatctggaagggacccccgtggtgagtcctgacggcctcccactctttgggcaggggcgacatggcacacctctggccaatgcccaagataagccaattttgagtcttggaggaaagccgctggtgggcttggaggtcatcaaaaaaaccacccatccccctaccactaccatgcagcccaccactactacgacgcccctgcctaccactacaaccccgaggcccaccactgccaccacccgccgcacgaccaccaggcgtccaacaaccacagtccgaaccactacgcggacaaccaccaccaccacccccaaacccaccactcccatccccacctgtccccctgggaccttggaacggcacgacgatgatggcaacctgataatgagctccaatgggatcccagagtgctacgctgaagaagatgagttctcaggcttggagactgacactgcagtacctacggaagaggcctacgttatatatgatgaagattatgaatttgagacgtcaaggccaccaaccaccactgagccttcgaccactgctaccacaccgagggtgatcccagaggaaggcgccatcagttcctttcctgaagaagaatttgatctggctggaaggaaacgatttgttgctccttacgtgacgtacctaaataaagacccatcagccccgtgctctctgactgatgcactggatcacttccaagtggacagcctggatgaaatcatccccaatgacctgaagaagagtgatctgcctccccagcatgctccccgcaacatcaccgtggtggccgtggaaggttgccactcatttgtcattgtggactgggacaaagccaccccaggagatgtggtcacaggttacttggtttacagtgcatcctatgaagacttcatcaggaacaagtggtccactcaagcttcatcagtaactcacttgcccattgagaacctaaagcccaacacgaggtattattttaaagtgcaagcacaaaatcctcatggctacggacctatcagcccttcggtctcatttgtcaccgaatcagataatcctctgcttgttgtgaggcccccaggcggtgagcctatctggatcccattcgctttcaaacatgatcccagctacacggactgccatggacggcaatatgtgaagcgcacgtggtatcgaaagttcgtgggagttgttctttgtaattcactgaggtataaaatctacctcagtgacaacctgaaagatacattctacagcattggagacagctggggaagaggtgaagaccattgccaatttgtggattcacaccttgatggaagaacagggcctcagtcctatgtagaagccctccctactattcaaggctactatcgccagtatcgtcaggagcctgtcaggtttgggaacatcggcttcggaaccccctactactatgtgggctggtacgagtgtgggggtgtnggggataacatgtagatcctctaga

SEQ ID NO: 96806 - DNA, 355 bp, Homo sapiens
gtcaagctgcccctctccaacatcaaactgtagtctcttatgtccagctgcttctcctcttctctgctctgtcagtggagcctggggtttttatgggcataagattgggggtggggcgggacatgagtggttttggaaaaggcaacatcacatgggaaaacaggaatgcatgttctcacttggggccatggttccaggcttggacttgatgccttcacagctggattctatcaaatatttaaagaagaactaataccaatcctactcaaactattccaaaaaatagaggaggaggggatacttagaaactcatcctacaaggccagtattaccctgataccaaaaccagacaaag

SEQ ID NO: 96807 - DNA, 934 bp, Homo sapiens
tgcaaacttcttggccttccaagatttgtgtctatctctgtaactatctctaatattttccctaccagcctgactgaacccaacaacattctagatgcttctcttctagaaactatgtcaactacagcatctgtatttcaaccatattgctttacaacgattgtcttttacttttctatctcacttgcaaaagtaccattgctgaaataattcctcaacttcattgaggaccaattccttgacctcgcgattttctcattaccatactgtctccttgtatattagttttccttttaaaccacattagattatatggttccacactaccatcactcattaaaaaaacttgtttgcaaatatcctcaatttctctacatctgccactttctatggtaattctctgacaaaccaaatttttaatgagtaattcaccttctaacatgaagacagaagaaacttctgtggctggaaagaaatatcatatgagtaagctgactggtttttacttaaagggaacatcatgagctttaagtgggcattctacatgggcagtcatattctaatgaggaaacagaaacagtcagagaagaactttcttgttttcttctaaccaaatctataaaatggccttaatctgcatctatctgaaactttttgcagtgtattttccatcactaatcacagcatacaggtttcaaagaatttctacaggactgaaaaaaaccaaatcatgccaaatagtgggaggaagagctaccttattccaaaaaatactagtatcagaactcaggtttcattaaatacattgatacctagaataaaagactctcttgcagctttctgtggccagatgacttttgttcaatgaaatattaagcactgtgttgtatctccagaaagtccccattttgcttttctcttctttattcttatt

SEQ ID NO: 96808 - DNA, 369 bp, Homo sapiens
ccaaagaaaaatattacctagtaaattatgaggcttcttgaggatgttctatgctttacctattaaagaaggcaattacagaggttatgtggaaacacagaaaaacatttgtgatatgccaccgtgggaaaagcagaaaacaaaataccttcaagtattacatataggcaagaataaggaaacctatgaaaatgaaatagccatttggctggctgccgaaccactgaatttttccttttctaaattttctttaacactattactatatcagcattttggggaaaaggatagtgtgtgtatgtgtgtgtaggggggtagtgcaacaacatggtacgtgtgtttaatgaaatcgagcattttaaaagtatt

SEQ ID NO: 96809 - DNA, 177 bp, Homo sapiens
aaaggttgctccactactgtctgcatctgaacagaaaactacttcagaaaaccttcttggaaacaacaacagagcaaaatgaagcagggtctggccaatgattttcaggaagcctgagacttaaagggattctcagaagaaactcagaaaagtcgctaacttgtctgtgaagccaga

SEQ ID NO: 96810 - DNA, 487 bp, Homo sapiens
aacacacatcttgactcatttttaatatatctgtaagtaagagatggaattcctggggcttaaagtatattatacattttggtaaataatgtcacattgccctatgactgtcataaaggttatgacagtcttaactaatttttgctcttatttaatctgagcatatgttatttgtacttgtctactatttcatacttttggcatattttattccatatattctgccttagcctgtgctcctttttcccctacactatcaggaatacatagtgctttaatagtagatgttcaatacgatatgggttttaggaagaaaaaacctccctactcatttgagaataatgtagtaaccccaagctcagtgcattgtcctgtcatttttgtggacactgttttgatattccttaaaaatggatagtaaacatcaggtaggtactaagatatcaattaagagaaagtactcctattcactagacactagtagtga

SEQ ID NO: 96811 - DNA, 419 bp, Homo sapiens
gactccagccttactcaaatagacagaattttttgctgaagaatagaacagtttgtacactgctcacttatttgttagacaccaagtaaatgacagacaaagttctagatgcaagaatatagcagcaaacaacactgacaaaaattctattcttatggagcttgcctttcacaatgccagatattgtacaaaagaaacaagtgaattatatggtctatagaaattgataaatgttagtaagaccaacagagcataaaacggggatacacagtgctgagaggaagttgcaatcttaaattttgctttactaatggagaatatagagtcataaagtatatataatctattttagagacttaaagtagttttggttgctcttaaataaaagctagattctgagcaaaaatgttcctagctgg

SEQ ID NO: 96812 - DNA, 258 bp, Homo sapiens
atcgcagcggcacagctccctctagagttccttcacactcacatcctctcccgcctcaggtagaaatatccgcctgcttagctccaggctcccatgacatactcccgtacctcctctcaccccaccctcatcgcggtcagcccgtcttcattacttctgccacagaacagtgtcccgcagtgaggcggtgaagccttccttcccagaatgtgcctcatcctcttcctatggcgtgaacaactgttgccctgacctgca

SEQ ID NO: 96813 - DNA, 368 bp, Homo sapiens
tcaaattgtgaaatttagaattctgctatgacaagtggaaaattgagaaaagacgcagagccactttttgtcatcgtgtaggtgacaaggagtctcccaagtatatcctgctaataggagtagctctcaaaagttaatctcaataaagcctcctaaagtctctggcaaagaaaactgctgcaatcccttgtgcaattctccagactaagctgtatgggggaagcctaccttttttcagcccgaagttcaggagactgaggatgtaactggggacatgatcattgattcaaaggtgattgcttaagtatcttaaaaatgtatagagctaatctgagtacctgcttaaatttcaaagaagccctgtggct

SEQ ID NO: 96814 - DNA, 793 bp, Homo sapiens
cttggaacagactcccgccctaaagggagcctggggagccctctagatgagctgagagttcccttcatgtcttgtttccttaattcccggattctgatgggcttccctatatagagcatgcctcttgaaacaggtatgctactgtagaaagagtcaatgagggccgggcttggtggctcacgcctgttatcccaacactttgggaggctgaggtgggcagatcacctgaagtcgggagttcaagaccagcctggccaacatggtgaaaccccatctctactaaaaatacaaaagttagctgggcatggtggcgcacacctgtagtcccagctactcgggaggctgagggaggagaatcgcttgaaccaggggggcagaggctgcagtgagctgcgatggtgccactgcactccagcctgggtgacagaatgagactccgactcaaaaaacaaaaaaagagtcaatgagttcaaatcagaacagcctgctctgtctcttactggctgtgtttccatgaggaaaatgagttccttaaccttcctgggcgttattgttctcatctataaatttgctacagtaagaagtgaattataggattatagtaagggaagtcatgtgtgttaaagggctcaagggcctgacacagtaccctggcaaatcgtatgttagttatgtcaggaaaaactgcctgcgtttcagcaccctgtgaccaccaaccttacaagattacatctagtcacctgactagtgaccccaaattcatttgactaccactttcccccaaaacagcccc

SEQ ID NO: 96815 - DNA, 280 bp, Homo sapiens
cactgcactccagcctgggcaacagagcgagactccaactcaaaagaaaaacaaacaagtactgactctgtcatgctctttgggggcctgcgctgctctaccatctcatgtcacagtcagggagctctggctgagcatcagccaggatgtgacctggaaacctggcttggctcttaggttgatagtgttattcctttcaatggactcactcatcacaactcaagaactgcagagtaggcagcacggagccagtcagagaatccttgcctccttaacagcc

SEQ ID NO: 96816 - DNA, 417 bp, Homo sapiens
gttttttcccaaattatttgacagtttaagggagtcaacgctttcagattttacttttttttttttgagacggggtctcactctgttgcccaggctggagtgcagtggtgcaatcttggctcactgcagcctctgcctcccgggttccagcgattctcctgcctcagcctgctgggtagctggagttataggcatgcaccaccgcacctggctaatttttctatttttagtagagatgggatttcgccatgttggccaggctggtctcgaactactgacctcaggtgatccacccgccttgacctcccaaagtggtaggataacatttgtgagccaccgtgcctggcccagattttacttttaaaaaaacttttcaatcaaaattttactacttctgattcatgagggtggcataat

SEQ ID NO: 96817 - DNA, 811 bp, Homo sapiens
actcacttcattttgtcacactctggcttgtaattatctcataatgtctgcagatgctcaggaggaaagttaatgagatttccactgtttgaagttttaacagggtttctaatgggaaaatgggaagggagaagttttctattaggtaaaaaatagtgctattctcaaatggattctcccatttgcagggacaaggaaaactttaattttcgatgcccccatgacaccccaggaataatctaaagtttcctatactctaaggaaacttcagtaacggttttaagcaaatactttatttctaatcaaaactttctttctgaacatttgccctcgtattattcatttattcacccaagaaattatttggaagctctaagctctcattgttcctcacagcatttattttatcgtatcaaaggttaaaacttggattgcaatcttagaggaaaattaattcagtgattaagaaaaatgcactttaagcaatacacatttaaataactgacaggcatggggcaatgtatttctgaattttgttttttggaaaaacacttttttctacttaaaattttaggcagctgcaattcttctaccctatagcctggagaaacagcatgaattactaataagggagcaccaatctgcagtgcagtgaccactttcagaacaaaagggtgaaagctaaaaccagaaaaatagattttttaaaatctactggttgcttaaagcatatttggaccttggctgtacttgagaacattttgcaatattctaccatccttgagcagaaggcatttggccccagagacta

SEQ ID NO: 96818 - DNA, 841 bp, Homo sapiens
tgcagaggaaggaaggggtgaatggaaaaagagtggcaacttccttggctctcctatcctgcagtaggtgagccctctgcatgggatctttcggggctgagagctcttttctgttaaaggaatgtctgcaaaagacaagacaaatacatttgaacagtcccgaggagaggtaatttcagagtagacacctatttctccaccagaaacaaagcagatcccagatctgaaaagcaggcttgaggaggcaagaggaagcatccaggaaccccagagcaggcagtggattacccattggctctgggtaaagccaagagggtttagagagggatttgcgctgtttcagcctcctgattcaactcctctccaaggaaagaggctcagtaggccaaccaagccacttttcctctcttgagggaagacgaccaaagatgcaacttgcccagctgtctgttatgaacgaaattgcatccccgcaaaattcatatgttgaaggcctaacacctcgtacctcagtatttgactgtatttggagacagggtctttacagaggtaataaaggtgacacgaggtcattagagtgggccctaatccattatgatgggcatttataaacacggaggagattaggacacagagaagaatgcatggagaaaagaccatgtgaagactcagggagggtgtggtcatctacaagccaaggagagaggcatcagaagaaacaatcctcacaacaccttgatcttggagttctagcctccagagcagtgagaaaaacaaaccgccatccaggatgtggccctttgttatggcagccctcgaaaaccaacacacagcagaacaa

SEQ ID NO: 96819 - DNA, 176 bp, Homo sapiens
accctgaagggatctcaggacggaaatatgaaagcgaggggctgagggggcggagcagccctcaccacagagctgtcccgaatggcccagcagactcgggaagagggggctcccggggctgttccccagtggacagtggctctggggcaaggtggggacacagacagcaactccca

SEQ ID NO: 96820 - DNA, 460 bp, Homo sapiens
agtttggatataaaaatatcttggcaaaagcattcatgcctgtggattcttctcttaaggtaaaggaccagtgacatccttactggggcctgctgattaaggaacaagaataatgggtcaaaggggatgtgagttccctctctgtgatataaaattaggacatctttcatatttaagtgatgagaagatgtagcaagccagaaatttttgtcgcctctgatctaataatgaacagtgtatgggaccagggtggtcaggaggaaggtgagccattgaagggcaattgtccaaagccaccctctgattccacttttcaatgcttctggaaagtgagtttttaacataatgggaaggggatatattaaaatattgaacaaagcctaatatttatcattactgtgaaagtttgattatttgggccaggtataaagtaaggcctagtctgttcctttgatgacct

SEQ ID NO: 96821 - DNA, 3845 bp, Homo sapiens
cggccgcggggcctggagcccgggatttgtgggcggcgagggcgcgaggggccgcgcgccatgctccgggccccgacggcgcggacgccccctcgcgcgccagcgtccggcgcgaccccggatcccggtctgcgcattgccccccgacggctgcgctagggagcgcggggcccggcggggggcggccgagctgggcgccctcccccggcgcggagtccccgcaccccggagggatggggcgggcagccgcgggcgcctaagatgccggccatgcggggcctcctggcgccgcagaacaccttcctggacaccatcgctacgcgcttcgacggcacgcacagtaacttcgtgctgggcaacgcccaggtggcggggctcttccccgtggtctactgctctgatggcttctgtgacctcacgggcttctcccgggctgaggtcatgcagcggggctgtgcctgctccttcctttatgggccagacaccagtgagctcgtccgccaacagatccgcaaggccctggacgagcacaaggagttcaaggctgagctgatcctgtaccggaagagcgggctcccgttctggtgtctcctggatgtgatacccataaagaatgagaaaggggaggtggctctcttcctagtctctcacaaggacatcagcgaaaccaagaaccgagggggccccgacagatggaaggagacaggtggtggccggcgccgatatggccgggcacgatccaaaggcttcaatgccaaccggcggcggagccgggccgtgctctaccacctgtccgggcacctgcagaagcagcccaagggcaagcacaagctcaataagggggtgtttggggagaaaccaaacttgcctgagtacaaagtagccgccatccggaagtcgcccttcatcctgttgcactgtggggcactgagagccacctgggatggcttcatcctgctcgccacactctatgtggctgtcactgtgccctacagcgtgtgtgtgagcacagcacgggagcccagtgccgcccgcggcccgcccagcgtctgtgacctggccgtggaggtcctcttcatccttgacattgtgctgaatttccgtaccacattcgtgtccaagtcgggccaggtggtgtttgccccaaagtccatttgcctccactacgtcaccacctggttcctgctggatgtcatcgcagcgctgccctttgacctgctacatgccttcaaggtcaacgtgtacttcggggcccatctgctgaagacggtgcgcctgctgcgcctgctgcgcctgcttccgcggctggaccggtactcgcagtacagcgccgtggtgctgacactgctcatggccgtgttcgccctgctcgcgcactgggtcgcctgcgtctggttttacattggccagcgggagatcgagagcagcgaatccgagctgcctgagattggctggctgcaggagctggcccgccgactggagactccctactacctggtgggccggaggccagctggagggaacagctccggccagagtgacaactgcagcagcagcagcgaggccaacgggacggggctggagctgctgggcggcccgtcgctgcgcagcgcctacatcacctccctctacttcgcactcagcagcctcaccagcgtgggcttcggcaacgtgtccgccaacacggacaccgagaagatcttctccatctgcaccatgctcatcggcgccctgatgcacgcggtggtgtttgggaacgtgacggccatcatccagcgcatgtacgcccgccgctttctgtaccacagccgcacgcgcgacctgcgcgactacatccgcatccaccgtatccccaagcccctcaagcagcgcatgctggagtacttccaggccacctgggcggtgaacaatggcatcgacaccaccgagctgctgcagagcctccctgacgagctgcgcgcagacatcgccatgcacctgcacaaggaggtcctgcagctgccactgtttgaggcggccagccgcggctgcctgcgggcactgtctctggccctgcggcccgccttctgcacgccgggcgagtacctcatccaccaaggcgatgccctgcaggccctctactttgtctgctctggctccatggaggtgctcaagggtggcaccgtgctcgccatcctagggaagggcgacctgatcggctgtgagctgccccggcgggagcaggtggtaaaggccaatgccgacgtgaaggggctgacgtactgcgtcctgcagtgtctgcagctggctggcctgcacgacagccttgcgctgtaccccgagtttgccccgcgcttcagtcgtggcctccgaggggagctcagctacaacctgggtgctgggggaggctctgcagaggtggacaccagctccctgagcggcgacaatacccttatgtccacgctggaggagaaggagacagatggggagcagggccccacggtctccccagccccagctgatgagccctccagccccctgctgtcccctggctgcacctcctcatcctcagctgccaagctgctatccccacgtcgaacagcaccccggcctcgtctaggtggcagagggaggccaggcagggcaggggctttgaaggctgaggctggcccctctgctcccccacgggccctagaggggctacggctgccccccatgccatggaatgtgcccccagatctgagccccagggtagtagatggcattgaagacggctgtggctcggaccagcccaagttctctttccgcgtgggccagtctggcccggaatgtagcagcagcccctcccctggaccagagagcggcctgctcactgttccccatgggcccagcgaggcaaggaacacagacacactggacaagcttcggcaggcggtgacagagctgtcagagcaggtgctgcagatgcgggaaggactgcagtcacttcgccaggctgtgcagcttgtcctggcgccccacagggagggtccgtgccctcgggcatcgggagaggggccgtgcccagccagcacctccgggcttctgcagcctctgtgtgtggacactggggcatcctcctactgcctgcagcccccagctggctctgtcttgagtgggacttggccccaccctcgtccggggcctcctcccctcatggcaccctggccctggggtcccccagcgtctcagagctccccctggcctcgagccacagctttctggacctccacctcagactcagagccccctgcctcaggagacctctgctctgagcccagcacccctgcctcccctcctccttctgaggaaggggctaggactgggcccgcagagcctgtgagccaggctgaggctaccagcactggagagcccccaccagggtcagggggcctggccttgccctgggacccccacagcctggagatggtgcttattggctgccatggctctggcacagtccagtggacccaggaagaaggcacaggggtctgagtaccagccctagaactcagcgttgccaggtgtgctgccatctgctgttcggcccaacctcagagtgaaggcagggtggcagcctccccacggactccatgcggcccgctggctcagggcagggagcctggaagcaaaggaggacctggctcctgactctcagagaggataggctggatccctggggcaggcctctcctcggcctgctcctctgacctcccggtctccctctgcaggctgggggcagaggcctgaggacaaggaagagctttgccatcccctgcatgtgcccctgcctctacctgtccccaaatttttatattaaaaaaaaa

SEQ ID NO: 96822 - DNA, 1314 bp, Homo sapiens
tcatgctgctcaagcttggccccccagctaaactgtaagctcctaggggaagggaccccatgttagctttctcctgggctcctggtcagttccacgctcctgcagcctgtgtgtgtggacgctggggcatcccgtcccgtatgaccccacagtggctgcctgtccattgatttgttgtcctggtacctgggttcacagggtagtagatggcattgaagacggctgtggctcggaccagcccaagttctctttccgcgtgggccagtctggcccggaatgtagcagcagcccctcccctggaccagagagcggcctgctcactgttccccatgggcccagcgaggcaaggaacacagacacactggacaagcttcggcaggcggtgacagagctgtcagagcaggtgctgcagatgcgggaaggactgcagtcacttcgccaggctgtgcagcttgtcctggcgccccacagggagggtccgtgccctcgggcatcgggagaggggccgtgcccagccagcacctccgggcttctgcagcctctgtgtgtggacactggggcatcctcctactgcctgcagcccccagctggctctgtcttgagtgggacttggccccaccctcgtccggggcctcctcccctcatggcaccctggccctggggtcccccagcgtctcagagctccccctggcctcgagccacagctttctggacctccacctcagactcagagccccctgcctcaggagacctctgctctgagcccagcacccctgcctcccctcctccttctgaggaaggggctaggactgggcccgcagagcctgtgagccaggctgaggctaccagcactggagagcccccaccagggtcagggggcctggccttgccctgggacccccacagcctggagatggtgcttattggctgccatggctctggcacagtccagtggacccaggaagaaggcacaggggtctgagtaccagccctagaactcagcgttgccaggtgtgctgccatctgctgttcggcccaacctcagagtgaaggcagggtggcagcctccccacggactccatgcggcccgctggctcagggcagggagcctggaagcaaaggaggacctggctcctgactctcagagaggataggctggatccctggggcaggcctctcctcggcctgctcctctgacctcccggtctccctctgcaggctgggggcagaggcctgaggacaaggaagagctttgccatcccctgcatgtgcccctgcctctacctgtccccaaatttttatattaaaaaaaaa

SEQ ID NO: 96823 - DNA, 1553 bp, Homo sapiens
cggccgcggggcctggagcccgggatttgtgggcggcgagggcgcgaggggccgcgcgccatgctccgggccccgacggcgcggacgccccctcgcgcgccagcgtccggcgcgaccccggatcccggtctgcgcattgccccccgacggctgcgctagggagcgcggggcccggcggggggcggccgagctgggcgccctcccccggcgcggagtccccgcaccccggagggatggggcgggcagccgcgggcgcctaagatgccggccatgcggggcctcctggcgccgcagaacaccttcctggacaccatcgctacgcgcttcgacggcacgcacagtaacttcgtgctgggcaacgcccaggtggcggggctcttccccgtggtctactgctctgatggcttctgtgacctcacgggcttctcccgggctgaggtcatgcagcggggctgtgcctgctccttcctttatgggccagacaccagtgagctcgtccgccaacagatccgcaaggccctggacgagcacaaggagttcaaggctgagctgatcctgtaccggaagagcgggctcccgttctggtgtctcctggatgtgatacccataaagaatgagaaaggggaggtggctctcttcctagtctctcacaaggacatcagcgaaaccaagaaccgagggggccccgacagatggaaggagacaggtggtggccggcgccgatatggccgggcacgatccaaaggcttcaatgccaaccggcggcggagccgggccgtgctctaccacctgtccgggcacctgcagaagcagcccaagggcaagcacaagctcaataagggggtgtttggggagaaaccaaacttgcctgagtacaaagtagccgccatccggaagtcgcccttcatcctgttgcactgtggggcactgagagccacctgggatggcttcatcctgctcgccacactctatgtggctgtcactgtgccctacagcgtgtgtgtgagcacagcacgggagcccagtgccgcccgcggcccgcccagcgtctgtgacctggccgtggaggtcctcttcatccttgacattgtgctgaatttccgtaccacattcgtgtccaagtcgggccaggtggtgtttgccccaaagtccatttgcctccactacgtcaccacctggttcctgctggatgtcatcgcagcgctgccctttgacctgctacatgccttcaaggtcaacgtgtacttcggggcccatctgctgaagacggtgcgcctgctgcgcctgctgcgcctgcttccgcggctggaccggtactcgcagtacagcgccgtggtgctgacactgctcatggccgtgttcgccctgctcgcgcactgggtcgcctgcgtctggttttacattggccagcgggagatcgagagcagcgaatccgagctgcctgagattggggttgctgatctgacattaagaagaccttcagctcccaagaatctctgagctccacaggatgggcaagggtggatcgacccttgcagatacacattatattc

SEQ ID NO: 96824 - DNA, 1181 bp, Homo sapiens
cggccgcggggcctggagcccgggatttgtgggcggcgagggcgcgaggggccgcgcgccatgctccgggccccgacggcgcggacgccccctcgcgcgccagcgtccggcgcgaccccggatcccggtctgcgcattgccccccgacggctgcgctagggagcgcggggcccggcggggggcggccgagctgggcgccctcccccggcgcggagtccccgcaccccggagggatggggcgggcagccgcgggcgcctaagatgccggccatgcggggcctcctggcgccgcagaacaccttcctggacaccatcgctacgcgcttcgacggcacgcacagtaacttcgtgctgggcaacgcccaggtggcggggctcttccccgtggtctactgctctgatggcttctgtgacctcacgggcttctcccgggctgaggtcatgcagcggggctgtgcctgctccttcctttatgggccagacaccagtgagctcgtccgccaacagatccgcaaggccctggacgagcacaaggagttcaaggctgagctgatcctgtaccggaagagcgggctcccgttctggtgtctcctggatgtgatacccataaagaatgagaaaggggaggtggctctcttcctagtctctcacaaggacatcagcgaaaccaagaaccgagggggccccgacagatggaaggagacaggtggtggccggcgccgatatggccgggcacgatccaaaggcttcaatgccaaccggcggcggagccgggccgtgctctaccacctgtccgggcacctgcagaagcagcccaagggcaagcacaagctcaataagggggtgtttggggagaaaccaaacttgcctgagtacaaagtagccgccatccggaagtcgcccttcatcctgttgcactgtggggcactgagagccacctgggatggcttcatcctgctcgccacactctatgtggctgtcactgtgccctacagcgtgtgtgtgagcacagcacgggagcccagtgccgcccgcggcccgcccagcgtctgtgacctggccgtggaggtcctcttcatccttgttactgtgagaactaagacgatgtatgggaagggccggggacagtgtcaactactgagaaagtgagcaggtgtccaggcaagagtggctgccccccc

SEQ ID NO: 96825 - DNA, 645 bp, Homo sapiens
ctgtcgtttcacgatgggctgaggggtggggggtttccaacacttgctgcggaggaccgtgggcagccagggtcggtgaaggatcccaaaatggctgggcgaaaacttgctctaaaaaccattgactgggtagcttttgcagagatcataccccagaaccaaaaggccattgctagttccctgaaatcctggaatgagaccctcacctccaggttggctgctttacctgagaatccaccagctatcgactgggcttactacaaggccaatgtggccaaggctggcttggtggatgactttgagaagaagtttaatgcgctgaaggttcccgtgccagaggataaatatactgcccaggtggatgccgaagaaaaagaagatgtgaaatcttgtgctgagtgggtgtctctctcaaaggccaggattgtagaatatgagaaagagatggagaagatgaagaacttaattccatttgatcagatgaccattgaggacttgaatgaagctttcccagaaaccaaattagacaagaaaaagtatccctattggcctcaccaaccaattgagaatttataaaattgagtccaggaggaagctctggcccttgtattacacattctggacattaaaaataataattataca

SEQ ID NO: 96826 - DNA, 906 bp, Homo sapiens
ctgtcgtttcacgatgggctgaggggtggggggtttccaacacttgctgcggaggaccgtgggcagccagggtcggtgaaggatcccaaaatggctgggcgaaaacttgctctaaaaaccattgactgggtagcttttgcagagatcataccccagaaccaaaaggccattgctagttccctgaaatcctggaatgagaccctcacctccaggttggctgctttacctgagaatccaccagctatcgactgggcttactacaaggccaatgtggccaaggctggcttggtggatgactttgagaagaagtttaatgcgctgaaggttcccgtgccagaggataaatatactgcccaggtggatgccgaagaaaaagaagatgtgaaatcttgtgctgagtgggtgtctctctcaaaggccaggattgtagaatatgagaaagagatggagaagatgaagaacttaattccatttgatcagatgaccattgaggacttgaatgaagctttcccagaaaccaaattagacaagaaaaagtatccctattggcctcaccaaccaattgagaatttataaaattgagtccaggaggaagctctggcccttgtattacacattctggacattaaaaataataattatacaaaaaaaaaaataattaaccaactaagaataccacaaaaaggggggcgcgcgccgctataaaagaattccccgagaggggacaagggttatgctggtcacccaggttgttgttggtccaacggggccccaaataggaagccgaatttaacgcagcgcccggcgccccgttataccaccctgtgcagggaaaccacgcgaaccggacagatctggggagcaccttatttggcgcggcgcacatttggaaccaactcccctaag

SEQ ID NO: 96827 - DNA, 711 bp, Homo sapiens
ggctgaggaaagatcttcccgtgacccacttccgttacttgctgcggaggaccgtgggcagccaggtcggtgaaggatcccaaaatggctgggcgaaaacttgctctaaaaaccattgactgggtagcttttgcagagatcataccccagaaccaaaaggccattgctagttccctgaaatcctggaatgagaccctcacctccaggttggctgctttacctgagaatccaccagctatcgactgggcttactacaaggccaatgtggccaaggctggcttggtggatgactttgagaagaagtttaatgcgctgaaggttcccgtgccagaggataaatatactgcccaggtggatgccgaagaaaaagaagatgtgaaatcttgtgctgagtgggtgtctctctcaaaggccaggattgtagaatatgagaaagagatggagaagatgaagaacttaattccatttgatcagatgaccattgaggacttgaatgaagctttcccagaaaccaaattagacaagaaaaagtatccctattggcctcaccaaccaattgagaatttataaaattgagtccaggaggaagctctggcccttgtattacacattctggacattaaaaataataattatacaaaacaaaaaaaaaacacatccacaagacaactcatgatcatccacaacttgtagatacatcaaaccaaaaac

SEQ ID NO: 96828 - DNA, 639 bp, Homo sapiens
ggctgaggaaagatcttcccgtgacccacttccgttacttgctgcggaggaccgtgggcagccaggtcggtgaaggatcccaaaatggctgggcgaaaacttgctctaaaaaccattgactgggtagcttttgcagagatcataccccagaaccaaaaggccattgctagttccctgaaatcctggaatgagaccctcacctccaggttggctgctttacctgagaatccaccagctatcgactgggcttactacaaggccaatgtggccaaggctggcttggtggatgactttgagaagaaggtgaaatcttgtgctgagtgggtgtctctctcaaaggccaggattgtagaatatgagaaagagatggagaagatgaagaacttaattccatttgatcagatgaccattgaggacttgaatgaagctttcccagaaaccaaattagacaagaaaaagtatccctattggcctcaccaaccaattgagaatttataaaattgagtccaggaggaagctctggcccttgtattacacattctggacattaaaaataataattatacaaaacaaaaaaaaaacacatccacaagacaactcatgatcatccacaacttgtagatacatcaaaccaaaaac

SEQ ID NO: 96829 - DNA, 577 bp, Homo sapiens
gtataattattatttttaatgtccagaatgtgtaatacaagggccagagcttcctcctggactcaattttataaaattggcctcaccaaccaattgagaatttataaaattgagtccaggaggaagctctggtcattcaagtcctcaatggtcatctgatcaaatggaattaagttcttcatcttctccatctctttctcatattctacaatcctggcctttgagagagacacccactcagcacaagatttcacatcttctttttcttcggcatccacctgggcagtatatttatcctctggcacgggaaccttcagcgcattaaacttcttctcaaagtcatccaccaagccagccttggccacattggccttgtagtaagcccagtcgatagctggtggattctcaggtaaagcagccaacctggaggtgagggtctcattccaggatttcagggaactagcaatggccttttggttctggggtatgatctctgcaaaagctacccagtcaatggtttttagagcaagttttcgcccagccattttgggatccttcaccgacctgctgcccacgg

SEQ ID NO: 96830 - DNA, 631 bp, Homo sapiens
cgagctccggtaccccttgcatgtaccgggggctgcggaggaccgtgggcagccagggtcggtgaaggatcccaaaatggctgggcgaaaacttgctctaaaaaccattgactgggtagcttttgcagagatcataccccagaaccaaaaggccattgctagttccctgaaatcctggaatgagaccctcacctccaggttggctgctttacctgagaatccaccagctatcgactgggcttactacaaggccaatgtggccaaggctggcttggtggatgactttgagaagaagtttaatgcgctgaaggttcccgtgccagaggataaatatactgcccaggtggatgccgaagaaaaagaagatgtgaaatcttgtgctgagtgggtgtctctctcaaaggccaggattgtagaatatgagaaagagatggagaagatgaagaacttaattccatttgatcagatgaccattgaggacttgaatgaagctttcccagaaaccaaattagacaagaaaaagtatccctattggcctcaccaaccaattgagaatttataaaattgagtccaggaggaagctctggcccttgtattacacattctggacattaaaaataataattataca

SEQ ID NO: 96831 - DNA, 602 bp, Homo sapiens
ggctgcaggaattcggcacgatgtctgtgtcggtgaaggatcccaaaatggctgggcgaaaacttgctctaaaaaccattgactgggtagcttttgcagagatcataccccagaaccaaaaggccattgctagttccctgaaatcctggaatgagaccctcacctccaggttggctgctttacctgagaatccaccagctatcgactgggcttactacaaggccaatgtggccaaggctggcttggtggatgactttgagaagaagtttaatgcgctgaaggttcccgtgccagaggataaatatactgcccaggtggatgccgaagaaaaagaagatgtgaaatcttgtgctgagtgggtgtctctctcaaaggccaggattgtagaatatgagaaagagatggagaagatgaagaacttaattccatttgatcagatgaccattgaggacttgaatgaagctttcccagaaaccaaattagacaagaaaaagtatccctattggcctcaccaaccaattgagaatttataaaattgagtccaggaggaagctctggcccttgtattacacattctggacattaaaaataataattataca

SEQ ID NO: 96832 - DNA, 678 bp, Homo sapiens
  misc_feature (658)..(658): n is a, c, g, or t
ctgtcgtttcacgatgggctgaggggtggggggtttccaacacttgctgcggaggaccgtgggcagccagggtcggtgaaggatcccaaaatggctgggcgaaaacttgctctaaaaaccattgactgggtagcttttgcagagatcataccccagaaccaaaaggccattgctagttccctgaaatcctggaatgagaccctcacctccaggttggctgctttacctgagaatccaccagctatcgactgggcttactacaaggccaatgtggccaaggctggcttggtggatgactttgagaagaagtttaatgcgctgaaggttcccgtgccagaggataaatatactgcccaggtggatgccgaagaaaaagaagatgtgaaatcttgtgctgagtgggtgtctctctcaaaggccaggattgtagaatatgagaaagagatggagaagatgaagaacttaattccatttgatcagatgaccattgaggacttgaatgaagctttcccagaaaccaaattagacaagaaaaagtatccctattggcctcaccaaccaattgagaatttataaaattgagtccaggaggaagctctggcccttgtattacacattctggacattaaaaataataattatacaaaaaaaaaaaaanaacaaaacaccacagaaaaa

SEQ ID NO: 96833 - DNA, 717 bp, Homo sapiens
ctgtcgtttcacgatgggctgaggggtggggggtttccaacacttgctgcggaggaccgtgggcagccagggtcggtgaaggatcccaaaatggctgggcgaaaacttgctctaaaaaccattgactgggtagcttttgcagagatcataccccagaaccaaaaggccattgctagttccctgaaatcctggaatgagaccctcacctccaggttggctgctttacctgagaatccaccagctatcgactgggcttactacaaggccaatgtggccaaggctggcttggtggatgactttgagaagaagtttaatgcgctgaaggttcccgtgccagaggataaatatactgcccaggtggatgccgaagaaaaagaagatgtgaaatcttgtgctgagtgggtgtctctctcaaaggccaggattgtagaatatgagaaagagatggagaagatgaagaacttaattccatttgatcagatgaccattgaggacttgaatgaagctttcccagaaaccaaattagacaagaaaaagtatccctattggcctcaccaaccaattgagaatttataaaattgagtccaggaggaagctctggcccttgtattacacattctggacattaaaaataataattatacaaaacaaaaaaaaaacacatccacaagacaactcatgatcatccacaacttgtagatacatcaaaccaaaaac

SEQ ID NO: 96834 - DNA, 580 bp, Homo sapiens
ctgtcgtttcacgatgggctgaggggtggggggtttccaacacttgctgcggaggaccgtgggcagccagggtcggtgaaggatcccaaaatggctgggcgaaaacttgctctaaaaaccattgactgggtagcttttgcagagatcataccccagaaccaaaaggccattgctagttccctgaaatcctggaatgagaccctcacctccaggttggctgctttacctgagaatccaccagctatcgactgggcttactacaaggccaatgtggccaaggctggcttggtggatgactttgagaagaagtttaatgcgctgaaggttcccgtgccagaggataaatatactgcccaggtggatgccgaagaaaaagaagatgtgaaatcttgtgctgagtgggtgtctctctcaaaggccaggattgtagaatatgagaaagagatggagaagatgaagaacttaattccatttgatcagatgaccattgaggacttgaatgaagctttcccagaaaccaaattagacaagaaaaagtatccctctatcgagggtaccgagctcgagtcggatcatgtca

SEQ ID NO: 96835 - DNA, 873 bp, Homo sapiens
atttcagatatactcaacaaagctgttagaaacaaggagtggaattagaaaaattacccaagtagtattcaaatacctaattatttgcttgaaagcactgaaggccaactatggaactcagtggctccaccagagagaagtctggctaggtgctcaggtggcgtgtcctgaccattcagtggctgagccctgtgaaaacaggcattctgtaggtcttcggatgaggaacttgcagaagcagccgggtgctgccatcctaagctggttttccatatgggcttctctgtgagtgttaagaaaagctgtggtttgcctgtcagagtgagcgcccccactcagggtaaccacagtttctccatagagcaataggacagcaggagtgggctgggacgactcctaccttagcagctgctggggtagaatgcagcctggtttcagaactgaatttctctttcttcttaaaggtgaaatcttgtgctgagtgggtgtctctctcaaaggccaggattgtagaatatgagaaagaggtaaggatgatgggtagccgttgcctataatatgggttctctctttcatgaccacacatctttcacctggtggcaggaacctgccttggatattctgctttccgtctctgtttacattaactaaacacattccccctctttccagatggagaagatgaagaacttaattccatttgatcagatgaccattgaggacttgaatgaagctttcccagaaaccaaattagacaagaaaaagtatccctattggcctcaccaaccaattgagaatttataaaattgagtccaggaggaagctctggcccttgtattacacattctggacattaaaaataataattataca

SEQ ID NO: 96836 - DNA, 231 bp, Homo sapiens
ctcgataaggccaagatccaggataaagagatggagaagatgaagaacttaattccatttgatcagatgaccattgaggacttgaatgaagctttcccagaaaccaaattagacaagaaaaagtatccctattggcctcaccaaccaattgagaatttataaaattgagtccaggaggaagctctggcccttgtattacacattctggacattaaaaataataattataca

SEQ ID NO: 96837 - DNA, 293 bp, Homo sapiens
tttgcagagatcataccccagaaccaaaaggccattgctagttccctgaaatcctggaatgagaccctcacctccaggtcagtatgtttctgagagggaaccccatacttgccactgaatctagaaacaaaacagtattaaggaattacatatgaattcttgatgcccttatgacaacatataaagaaatccttgcattttcatgatgatcttaggagaggaaagtgtggtgaccctccaggccataggaagaagggataggaaaattaccatgtgaattttctactgcttat

SEQ ID NO: 96838 - DNA, 792 bp, Homo sapiens
cagaatttctttacaattcaaggtgctaagaggccattttttggtcatcaagtccagctgtccttttcagatgaagaaaatgaagcttatcatcataaagaattgtccagggttccgagttagtgatagggctgagaagacccttgagctcctgttcccagtctaatattctttctactccagtattgagatgcgtattcgtttccgcttgggacacagaatgtctttcagtatgacctttaaggattcgtagcttccagccctttgagctcctgggtgtattggcgacgactcactgtccttgtgtttgtagtttaatgcgctgaaggttcccgtgcccttgtgtttgtagtttaatgcgctgaaggttcccgtgccagaggataaatatactgcccaggtggatgccgaagaaaaagaagatgtaagtagttgaggctcctgcttattctaaaattctcttgatcttgacagctctctattatagctaagttaagttagagtgaattaaatggaagagttaacagccatataaaggaatgacttgtcaataaatgcaacaacatggacgaatttcaaaataattatgcggagtgaaagaagccaacaagaaaaagaagagtatagcatatgattccatctttgtaagactctagaaaatgtagtttgtctacagtggctgcctggggatggttgagaggggactgctggtttcacaggtggatacctatatcaaaacttatcaaatggtgttctttaaatatgtgcattttatcatatttcagatatact

SEQ ID NO: 96839 - DNA, 639 bp, Homo sapiens
ggctgaggaaagatcttcccgtgacccacttccgttacttgctgcggaggaccgtgggcagccaggtcggtgaaggatcccaaaatggctgggcgaaaacttgctctaaaaaccattgactgggtagcttttgcagagatcataccccagaaccaaaaggccattgctagttccctgaaatcctggaatgagaccctcacctccaggttggctgctttacctgagaatccaccagctatcgactgggcttactacaaggccaatgtggccaaggctggcttggtggatgactttgagaagaagtttaatgcgctgaaggttcccgtgccagaggataaatatactgcccaggtggatgccgaagaaaaagaagatgtgaaatcttgtgctgagtgggtgtctctctcaaaggccaggattgtagaatatgagaaagagatggagaagatgaagaacttaattccatttgatcagatgaccattgaggacttgaatgaagctttcccagaaaccaaattagacaagaaaaagtatccctattggcctcaccaaccaattgagaatttataaaattgagtccaggaggaagctctggcccttgtattacacattctggacattaaaaataataattataca

SEQ ID NO: 96840 - DNA, 728 bp, Homo sapiens
atttcagatatactcaacaaagctgttagaaacaaggagtggaattagaaaaattacccaagtagtattcaaatacctaattatttgcttgaaagcactgaaggccaactatggaactcagtggctccaccagagagaagtctggctaggtgctcaggtggcgtgtcctgaccattcagtggctgagccctgtgaaaacaggcattctgtaggtcttcggatgaggaacttgcagaagcagccgggtgctgccatcctaagctggttttccatatgggcttctctgtgagtgttaagaaaagctgtggtttgcctgtcagagtgagcgcccccactcagggtaaccacagtttctccatagagcaataggacagcaggagtgggctgggacgactcctaccttagcagctgctggggtagaatgcagcctggtttcagaactgaatttctctttcttcttaaaggtgaaatcttgtgctgagtgggtgtctctctcaaaggccaggattgtagaatatgagaaagagatggagaagatgaagaacttaattccatttgatcagatgaccattgaggacttgaatgaagctttcccagaaaccaaattagacaagaaaaagtatccctattggcctcaccaaccaattgagaatttataaaattgagtccaggaggaagctctggcccttgtattacacattctggacattaaaaataataattataca

SEQ ID NO: 96841 - DNA, 567 bp, Homo sapiens
ggctgaggaaagatcttcccgtgacccacttccgttacttgctgcggaggaccgtgggcagccaggtcggtgaaggatcccaaaatggctgggcgaaaacttgctctaaaaaccattgactgggtagcttttgcagagatcataccccagaaccaaaaggccattgctagttccctgaaatcctggaatgagaccctcacctccaggttggctgctttacctgagaatccaccagctatcgactgggcttactacaaggccaatgtggccaaggctggcttggtggatgactttgagaagaaggtgaaatcttgtgctgagtgggtgtctctctcaaaggccaggattgtagaatatgagaaagagatggagaagatgaagaacttaattccatttgatcagatgaccattgaggacttgaatgaagctttcccagaaaccaaattagacaagaaaaagtatccctattggcctcaccaaccaattgagaatttataaaattgagtccaggaggaagctctggcccttgtattacacattctggacattaaaaataataattataca

SEQ ID NO: 96842 - DNA, 634 bp, Homo sapiens
  misc_feature (18)..(18): n is a, c, g, or t
  misc_feature (29)..(29): n is a, c, g, or t
ggtcgatacggctgcganaacacgacagnagggggctgcggaggaccgtgggcagccagggtcggtgaaggatcccaaaatggctgggcgaaaacttgctctaaaaaccattgactgggtagcttttgcagagatcataccccagaaccaaaaggccattgctagttccctgaaatcctggaatgagaccctcacctccaggttggctgctttacctgagaatccaccagctatcgactgggcttactacaaggccaatgtggccaaggctggcttggtggatgactttgagaagaagtttaatgcgctgaaggttcccgtgccagaggataaatatactgcccaggtggatgccgaagaaaaagaagatgtgaaatcttgtgctgagtgggtgtctctctcaaaggccaggattgtagaatatgagaaagagatggagaagatgaagaacttaattccatttgatcagatgaccattgaggacttgaatgaagctttcccagaaaccaaattagacaagaaaaagtatccctattggcctcaccaaccaattgagaatttataaaattgagtccaggaggaagctctggcccttgtattacacattctggacattaaaaataataattataca

SEQ ID NO: 96843 - DNA, 509 bp, Homo sapiens
ggatcccctgaacattcgtgtcccaaaaggccattgctagttccctgaaatcctggaatgagaccctcacctccaggttggctgctttacctgagaatccaccagctatcgactgggcttactacaaggccaatgtggccaaggctggcttggtggatgactttgagaagaagtttaatgcgctgaaggttcccgtgccagaggataaatatactgcccaggtggatgccgaagaaaaagaagatgtgaaatcttgtgctgagtgggtgtctctctcaaaggccaggattgtagaatatgagaaagagatggagaagatgaagaacttaattccatttgatcagatgaccattgaggacttgaatgaagctttcccagaaaccaaattagacaagaaaaagtatccctattggcctcaccaaccaattgagaatttataaaattgagtccaggaggaagctctggcccttgtattacacattctggacattaaaaataataattataca

SEQ ID NO: 96844 - DNA, 1137 bp, Homo sapiens
ctgtcgtttcacgatgggctgaggggtggggggtttccaacacttgctgcggaggaccgtgggcagccagggtcggtgaaggatcccaaaatggctgggcgaaaacttgctctaaaaaccattgactgggtagcttttgcagagatcataccccagaaccaaaaggccattgctagttccctgaaatcctggaatgagaccctcacctccaggttggctgctttacctgagaatccaccagctatcgactgggcttactacaaggccaatgtggccaaggctggcttggtggatgactttgagaagaagtttaatgcgctgaaggttcccgtgccagaggataaatatactgcccaggtggatgccgaagaaaaagaagatgtgaaatcttgtgctgagtgggtgtctctctcaaaggccaggattgtagaatatgagaaagagatggagaagatgaagaacttaattccatttgatcagatgaccattgaggacttgaatgaagctttcccagaaaccaaattagacaagaaaaagtatccctattggcctcaccaaccaattgagaatttataaaattgagtccaggaggaagctctggcccttgtattacacattctggacattaaaaataataattatacaaaaaagaaaacagaaaaacaaaaaaaaaaaagcgtgtgtgtgggccggcccgcgggcccccggaagaaggcttcccagaaacccctcgcggtggggcggcgcgggggccccgggtgggtcaaggcggaacacgggggcccaagaggcggtgtccccgagagggacaactcgggggccacgagaacaaagggggggggagatccccacccaaataaaaaagagcccgggggggcaacacgggagggtttcgtgaaaacaacctccgagaaggggagaaacgcggagaggcaccaacacgagggggcactttcactaacaaggggggggggctccaaaggagagacgccccgagaatatctaacaattataagcgcccccggagttcgggggggaggaaaaaaaagtggagatgcagggacgaaaaacacaacaaaaaacaaagacaaaagaacaacacaaagagaaagaacaaaaaaaacaaacaacgaggga

SEQ ID NO: 96845 - DNA, 637 bp, Homo sapiens
ctgtcgtttcacgatgggctgaggggtggggggtttccaacacttgctgcggaggaccgtgggcagccagggtcggtgaaggatcccaaaatggctgggcgaaaacttgctctaaaaaccattgactgggtagcttttgcagagatcataccccagaaccaaaaggccattgctagttccctgaaatcctggaatgagaccctcacctccaggttggctgctttacctgagaatccaccagctatcgactgggcttactacaaggccaatgtggccaaggctggcttggtggatgactttgagaagaagtttaatgcgctgaaggttcccgtgccagaggataaatatactgcccaggtggatgccgaagaaaaagaagatgtgaaatcttgtgctgagtgggtgtctctctcaaaggccaggattgtagaatatgagaaagagatggagaagatgaagaacttaattccatttgatcagatgaccattgaggacttgaatgaagctttcccagaaaccaaattagacaagaaaaagtatccctattggcctcaccaaccaattgagaatttataaaattgagtccaggaggaagctctggctatcgagggtaccgagctcgagtcggatcatgtca

SEQ ID NO: 96846 - DNA, 291 bp, Homo sapiens
gcagagcaggggtaggaggaaaatgaaaggaaggcaggaaaagaggcaggagagggtggaaagggctggcctattccattggtaaacacctccagttatttgaaaatgtgttcttatgttgagtcaaaaatctacctccaggtaactttccaaataatttacttaggagccatgctgaacaaaccagctttctctgggccacaacacttcttaagatatttgcatgatagcacatcttcacttcatctcttctctgagcagggattctaaaagggtggtctccaatcagca

SEQ ID NO: 96847 - DNA, 429 bp, Homo sapiens
gtggagtggccttagtaggggtgaccattcacagaaataattatgaaatgtttgctaggaaaagtttctgattagcaaatttctaggaaaataacgtttcctcctcaatgtgcttgctaataaaagggtacactttggcatcaagcagacgcagtattcaaatcctggctctgccacttaaaagctggatgataccccacctctgcccccagcctcaatttcctcatttgagctataggtataataatctccacttcacagagtccttatgaagattaaagatgatccattcaaagtgcctggtacactgtaccagtggtactggtggcaccagtatgtggcacatgaagaaggtactcaagaaatgtggtttcctttccccccaggtggactgcaggaatataagctgaattgctgctaagtagttca

SEQ ID NO: 96848 - DNA, 152 bp, Homo sapiens
tctgccttggcctccaaagtgctcggattagaggcgtgagccattgtgcttggctgagtcctctgagacagtgaaactatctgaggctctagaggcgatgccgttcaaagtcatgccacttgttggtggtgtggactgatgtgaatatccag

SEQ ID NO: 96849 - DNA, 378 bp, Homo sapiens
accactttgtgagaacaaggcttccagattctgttaaactaaggggcaattaaaaatgaaaaatagaacattagagattttaagaatgtgggatttagaacagttaatataacaaatttgataagaaattagaaaaactaaaattattaaattgtactaatgtgtttggtatgggttaatcctaaaacttgagattttccttggatgttggattgtttctgaaaagatttaattttctttttaaaattatattgtgatgcatgaagagttttaaaaacttttattttttatgcttgtgaaaatcataaacgacacaaaagcatatctactcttagtgtaaatgttgcttatgtcagagctatgtagaatgaactgttg

SEQ ID NO: 96850 - DNA, 470 bp, Homo sapiens
ccctatctggaacagtttggggcagtcccttgtggaaactcccccgccaccacttttgaggcaactccagctgtgggttcagccagtaagaatagcagtatagtattaaaatcctgtgatggccaggaagcagccttattgataaagataaaaactcaacggtgccatagactttttgcagtgtttctgaaaggttttccattaggaaaataccttgtgcctacaaaaacagtatgtaaaatagactgatattatttaattagatatagaaatacctgttttcttatcagatgaaagtatgatggaaaagaacaggttaaaaacactctaatatggcttgaaaaaactaactcaaagttacatgaatccgcagtctcttcaacaaaacataatatttatttatatactggatagacacagcctagaaaggatttcttaaaaagcacagaatagtcctctgtgaagattta

SEQ ID NO: 96851 - DNA, 429 bp, Homo sapiens
caagggtgggaaaaaaagaaaggcaaggctggggtctgactcaggagaccaacaggctggaaggtgatttcagagggagaaggcctgtaagtgtgagcccacccttctcaagaatgcctgccaagaaattcttacttcccaaggcttaggggttagcttctcaatttccaatgcacccccctcccctctgcaacttgatccaataagcctgtaagtgctaagatggcactggaagagagaagcaatgaatgggtgggaaactttaaaaagaaccttcccagtcctagtgctccaccctggcctcaaagtcctgaagcctgatctgaaagagctggtgacagatttatcatttatttggggcaggacctagagaaagtggagagatcagtgaaacactagctctgggcgtcaattcttgtcaccaccttc

SEQ ID NO: 96852 - DNA, 977 bp, Homo sapiens
ctcttagttcactgattccactaatttctgaagcatcttttaagctacctcttgatttcctcatcacaaaatttagtctctcttcccatgagatcaaagttagaaaaagtgcctatatttttaccatttcaaaataaaatgtagacttaaaaatttcaaccaactttgagaaactatagacagagtttttatatagaaggaccccaaaacaacaaattttgtccaggatcgctcagtacaaatgctaacctgaaacttgtatttcagaacttccattctcctaaagggcagagtcactggaccagtatgtgttatatgtattttggctctttacatttactctttagttccatcttaatacacacaagcacgcgtgcacacaaacacacacacacattcacacatttatttaaaaccttaacattttaatagttacttctaaagtgtgtcaacttaatctcactctgagtgtgacagggagttagtgcctatgtgaatatattttttcatcacattcagtttttgctattgagggaaaattatctttccatctcatgtagtgcaaacttaaatcttaaatcatttaaatatgttttatttttccaaagcttacatttctgcattacaaatggtgtccattgattggaagtcaagctcactagcattcactgcatgagctatgcatgagcatgttaaggccaccatgttctgcctggcaaaataaatactttatcattttcctaagtgttggataattccctgacctttaaaaaggactttggagaacagattttcctctaaataatgtattaatagaccaacaagtaatttttttaaaataataatcatgaagtttaacatacttcaagctatctttacaactctgaaggttatctttgggtttctgttattcccatagaataagttgaaccaaaatttgtaattgtcttgctgtcactcaaaagaaatagatatgt

SEQ ID NO: 96853 - DNA, 165 bp, Homo sapiens
ctgttttcagttcttttatgtatatatctagcagggtaattgctggattatatggtaattctgtgtttaacttaataaggaactgacatactgttttcaacagcgattgcaccattttacattcctatcagctatataccagggttacagtttctctacatcttt

SEQ ID NO: 96854 - DNA, 720 bp, Homo sapiens
acagatatttaataaggaaatattccttcctgttcccactttcagggaggcctcttaagacatgaagaggaccaaaataacaattgcagtataacttcacatggtggggtggggggtgtggagttcaaatgtggttgatcaaaatagtgttgttactttcgtttagacttgattccaacatgtaaaaaaatcaggcactttagtgggagtgattttaacttcagtagtgaaagggcaatgcaattaagagttagggtagtgtttctcaaacttcatcctcagaggtgctttagaaattgactacctttggtttgaatttatttttagaaatatatcttcttttcagtatttttaaaactgtaaaaggtaaaccatgttttctcaaatgtgttaaatggaattttaactcattatgtttcaagttttaaccagtgtgttgactttataagaagtttataatattaacttaaactttaaaaggtggtatgcacttatacctttaaggtattggggtttcacataatttttcctttgacgggggagtgttttgctgctcaacagaaaaggtctgaagtctactgtgtatgctagggttattatgatattgtaggaccatttaggaaatgaggaactggcttctttagcatcagcaagacttagaacacctgcatatctttgcttaggctattctggcctggccctgggagaggggaccttgtg

SEQ ID NO: 96855 - DNA, 282 bp, Homo sapiens
gaacctccactatatccttgattttgatctccattccatttctcttatcattgttaaccacagccctgtaagaccagtaataaatttctgtctactgatgattctattgaattgaaatgcagagccaatggcatctttcagaaaaggtaacctgaatttcagaaccagataataagagaattctcctttaccagtaagatatgtttttcctgcttaggacaaacccattacttgtcactttggatatactttatttcatcaaatctaagacattactcattt

SEQ ID NO: 96856 - DNA, 781 bp, Homo sapiens
attcctctcccctccccatccactctagttagagggatgtggactagaatgggaataaggacgcagactccagagcagactgcctgcatgaactccaggtccccaccagccagttctaaactaaaagttcagatattctgaaccatggaacaaacatgatgtggcctgctgaagtagaaatgtggacttttgggatgtgagaccgaaatcactcatagataagggtccttcctaaatctacagagtgggcaacaaacctaattcacttgttaaaataatcattgagatggaaattgcaaacgttctgactctggagagacagagggtgactggcaggcaaaggagaaatctcaggcttcagtaatgagaatttttcatgagtcgcctaatcaagctcatgagacctggagagtctatgaggaaagggttcagtgatagagaaagccggagatgatgaggctgggagagtaagcttctcttaccattgttctctattctccctactcccatattcttccagtgggacaaagtgccccaaagtataagtcagtgtgtcccaaggggtctggagtttaggtacctgaacatggaagagggccttgctaaactggtttgacctttctctcatccccagcaaagttctgaatgcgggttctgactctgagctgaaggcatacttcatgaagtttcctgctgccctttcactacacagctggacttggaggcaaacttggagataaaaatatagttcccgtgctatcccttataaagatttaagaga

SEQ ID NO: 96857 - DNA, 610 bp, Homo sapiens
ttttccattggataaagtggttgtagtttttgtgtggatttttatgtgtcataagttgatgtttttaataatctatacaatttaacatcatatgctcagtttttgtaaacatatatacattataactagttaccaaattaattttataaagtcatatttcctctagggcccactaactagtaaacattggagccagaattctatctcagcaatgagtaactacaaaactggagtgggttttttccctataccatgctttcttgttaatgtttgatatgttaggactacagaggttatataaaaaatataaacaaacattgtggtgtaacgtaagaatagctactgttatttatgtacttaattaggataaaatatatttctttggaagaaacaaatgggtgtttgtttttattacagctagatttaaatagttttctttgaaatgttggtaaatgtatttattcaggaacctcaggcactatatgatgaagtaagaactgtgccaattgcaaagctggataggacagttgctgagaaagctgttaaaaaatatgtagaagatgaaatggcaaggtaagtcacacttcaagatgcatgacaaaaataagaa

SEQ ID NO: 96858 - DNA, 303 bp, Homo sapiens
gacacttcccctcttttatggaagcatagtaagattttttctttatggcgatcatgatggagaagtatatgctacaggaggagaggttcaaattgcaatggaacctcaggcactatatgatgaagtaagaactgtgccaattgcaaagctggataggacagttgctgagaaagctgttaaaaaatatgtagaagatgaaatggcaaggctccctgatagattgtcagtaacttggcctgaaggagatgaattattgcctaatgaggttaggcctgctggaacccctattggtatgtttgttta

SEQ ID NO: 96859 - DNA, 386 bp, Homo sapiens
tcctaggaagggagttttgcaatatatctattcatctgctcctgactagtgcattaaagagagctcttcttcaatcttgtcttcccacaaatgaagtagcactttgttctcctagagaagctctttttatggaactgcattaatcacctacataaacccacctcctcgtgcatcccaatgcttatgttcctcctttctgaagctctccccagttggcaatgaaaggaagtgcagacaatgagctgtggcttcttgaagggcagaggcagactcctcagtcaccctctgatgaatgattacaagaactcattgtgcaaggcaatgaagaacatttatgttgatacaatacctgggctttaaaatgccttccgatgacataacaccag

SEQ ID NO: 96860 - DNA, 589 bp, Homo sapiens
aggaaaaagaaattgaaacagagtcatcatactgacatgacaggcgttataacagagggatttgaaccctaaactgtggtaggatttagactgctcgggtttgaatagcaactgtaccttgcatgagccaggcaagagtcttaggttgagttcctccagacacaggtcatgagcaaggattggaaaggaggtgatttactggggaatgtgcttccaagaagaaaagtgaaggagtagggaagcaagccagggaaggggaagaagccagctcaggctgatccttggagagtcctggagcatggctcacacttcaacctctccctccttgaggccaacgatctgggtgcttgtgttcctacaccagttccttctgtcactggcaaggggggagagggacacaaactcccagagcctttccactctccccccagtgaggggtaatgtgcagaagtttccagagaaagcatttgcagccaagcccacaggggtctgagcatgcagagctggaaaagaggacccaggggggatctgggcagggcatacctggcagtataatagggatcataaatggtctaccttatatagtgtg

SEQ ID NO: 96861 - DNA, 396 bp, Homo sapiens
gtggctatactaagagtttaaaagaaatcatttatgtggctagacatactgacttctgtagcagagaatagatagggagcagtggctctcattagctttggagatgataataaaactggaaaagatcagaaaagtggaaaatgatctttgcatctgagtgcactgattcatgatgtggaaagataaaagaaagtcctattttttttaatagtccttaaaacgcaaatggaaaagtaaaaaatctgcagaaagtgagccagcttttctttccttttgatagaacgaagaacattccagtggaaggtgtagaaatacatggctaatttcctgtggactaatttagctttctatggaaatgaggaaagtaaataaatcaggatcaaataattcaacatg

SEQ ID NO: 96862 - DNA, 452 bp, Homo sapiens
caggagccaaggcactgctctttcaccccgagaaccctgggactcacccgtgcttctctcccagtatcagattcgttctctgtggcagtggttgggcttcctccacttccctgctcttagggtctaaactggcagtgtcacgtcgtgagcatacctctgccttcaagttcaaatgcagacagacacaagtctctgtttaaattcctgaggaagaatttggttggcccaatgtggtcagctgtctacccaagtccaatgaactctgctcatgggaatggggctggggaataaatgtggcttagagggctgacgtgagatcccagagtctggaagctatttcaaggttctggaaatagtctagtagggctacaaaactcagagcaagccatagggtccggacagtaccctatttcctttatttctaattattttctgctctgccttttgaggga

SEQ ID NO: 96863 - DNA, 449 bp, Homo sapiens
ggcgtggtgggaggctgaggcaggagaatcacttgaacctgggaggtggaggttgcagtgagctgagatcgtgccactgcactccatcctgggcaacagagcaagactccatatatatttgggcccatttcatgctgcaaatcttaattacgtctgacaatttacctaaatattccaacagcaaaattcaactgaattacaataccacatacctatcagaactctgtgactcagagttcagaactctcaaaaggctttgtggtttctggcagcaatgacaggagctcactctgggattgcctctcacggattcttaacactttttttttttgccatggaaaccttatgcagtccaatgaaagctatttcagataacgtttttgaataaaacacataagattactaaggaaatcaatcacactgaaagcagttctatccctgaccttaaa

SEQ ID NO: 96864 - DNA, 541 bp, Homo sapiens
gcccaggctggagtgcaatggcgtgatctcagctcattgcaacctccgcctcctgggttcaagcaattctcctgcctcagtctcccgagtagctgggactacaggtgcacgccaccatgcctggctaatttttgtatttttagtagagacggggtttcaccatgttggccaggctggtctcgagctcctgacctcaagcgatcctcccatctcagcctcacaaagtgctgggattacaggcatgagccaccatgcctatcccgatgttgtgattctgttatccccatttaacagacaagaaagtacaaagtggggaagtcctttatccaagaattctggaagccaggcaggcttgtgccacactgatgttcatcaagcctgggcacatttaacccctcctgccctccatgcacctgtggctccagcaaaagggctgtggcccctcctccatggattagaacctgtggctgagccacaatccagcacggaggataacagcaaggatgggtgtgcattcagggtcttcctctgcctacggtct

SEQ ID NO: 96865 - DNA, 1706 bp, Homo sapiens
gggaaggcatttgagccattttggggtgtatagatgtagtaagacgatgggttccgtagtggggagaggtgactagacttcgaggtgctaagtgtaggaacaggatggaaaagccctagtgaaatgtggggaattgggttagtggggctctggggaggtacctagagaggaagtgagggaggccacggaatatgaagatggggaggccctgcggcatgtagtggggacggagggccaggaggccgatacgggggccggtgggggggtagggggcggcaaagggaggggaagtaaactgaactggggctgggcaacaggaaaaaagaagaaaccacagattagagaaatctcggcggtcaggaggcccggggtctaagatgtaaagaggtaaacagatttagggattgattgtctgctggggtgggttgagaggagaaaagggaagaaaagtcgggggactacgtcctcagacctgacctgagtggtgagaggtggacccaggaggagtggcaggtggtggcggggttttgcagagctcagttggaggccctctccgaggcagcttgatggaacgtgggagagccgggctggagtcacagtttttattttgctagggaggtagtcagtggcgcacaaagggtaacaagcagtgatagtggggatgctttccattttaggaaacttttcctaaaaggaagtggcaattttaactaatctcccctccgccgctcccagctgccactccagatgctgctgctgccgccgcggccaccccaccctcggtcctcctctccggaggccatggacccaccgccccccaaggctccccctttccccaaggcggaaggcccctcctccactccttcctcggcggcggggccccgacccccgcggctgggccgccacctcctcatcgacgccaatggggtcccctacacatacacggtgcagctggaggaggagccccggggcccgccccagcgcgaggcgcccccaggagagcccggccctcgcaagggctacagctgcccggagtgcgcccgtgtctttgccagccctctgcggctgcagagccaccgcgtgtcgcactcggacctcaagcccttcacgtgcggcgcctgcggcaaggccttcaagcgctccagccacctgtcgcggcatcgcgccacgcaccgcgcccgcgccgggccgccgcacacctgcccgctctgcccacgccgcttccaggacgccgcggagctggcgcagcacgtgcgcctccactaagctcgagacccggcctgtgctgccctgcccgtctcagggccaccaagtctgacccacacagcgtcactcactcccacacacaccccctggctctgctgaggttactgccttaccctgggcctcagccccaccttccaaagggaggagcatcattccttccttaccccctttctagctgtgtgatgtagaccaaagtcgttgcccctccctgggcctgggaaccagtcggaactgggttccagtccagctgtgctgtgtgagcctgtgcaagtgacatgacctctctaaaccttggttttctgctctctggagcggtgaaccggtggttgtctgcggggaagagatgataaagagcacgggcacggtctggttcatttctgtatctaccccccttccgcccacgcccccgaccctttgctcaataaacattccgcactcca

SEQ ID NO: 96866 - DNA, 1220 bp, Homo sapiens
  misc_feature (2)..(2): n is a, c, g, or t
  misc_feature (4)..(4): n is a, c, g, or t
  misc_feature (6)..(6): n is a, c, g, or t
cnangngtgggagcgccggctccaggcggcggaacctccgcactgggctcgcgcgcttccggccggcgccttttcccagggactccgccaacccctcgcacccccgcgcccccagtccccgcgtccccggcgccgccggcccggagctgcccggaagtctcggttccgccgccggcgctcgccaggggaagcccggggccgcccgggacctcggcccgttcctccggacccgagaggccgccgcacgggctgccactccagatgctgctgctgccgccgcggccaccccaccctcggtcctcctctccggaggccatggacccaccgccccccaaggctccccctttccccaaggcggaaggcccctcctccactccttcctcggcggcggggccccgacccccgcggctgggccgccacctcctcatcgacgccaatggggtcccctacacatacacggtgcagctggaggaggagccccggggcccgccccagcgcgaggcgcccccaggagagcccggccctcgcaagggctacagctgcccggagtgcgcccgtgtctttgccagccctctgcggctgcagagccaccgcgtgtcgcactcggacctcaagcccttcacgtgcggcgcctgcggcaaggccttcaagcgctccagccacctgtcgcggcatcgcgccacgcaccgcgcccgcgccgggccgccgcacacctgcccgctctgcccacgccgcttccaggacgccgcggagctggcgcagcacgtgcgcctccactaagctcgagacccggcctgtgctgccctgcccgtctcagggccaccaagtctgacccacacagcgtcactcactcccacacacaccccctggctctgctgaggttactgccttaccctgggcctcagccccaccttccaaagggaggagcatcattccttccttaccccctttctagctgtgtgatgtagaccaaagtcgttgcccctccctgggcctgggaaccagtcggaactgggttccagtccagctgtgctgtgtgagcctgtgcaagtgacatgacctctctaaaccttggttttctgctctctggagcggtgaaccggtggttgtctgcggggaagagatgataaagagcacgggcacggtctggttcatttctgtatctaccccccttccgcccacgcccccgaccctttgctcaataaacattccgcactcca

SEQ ID NO: 96867 - DNA, 351 bp, Homo sapiens
tcggtacccggtgtttatcgatgccaccacctgacctgagtggtgagaggtggacccaggaggagtggcaggtggtggcggggttttgcagagctcagttggaggccctctccgaggcagcttgatggaacgtgggagagccgggctggagtcacagtttttattttgctagggaggtagtcagtggcgcacaaagggtaacaagcagtgatagtggggatgctttccattttaggaaacttttcctaaaaggaagtggcatcgataaacaccaggtggcatcgataaacaccaggtggcatcgataaacaccaggtggcatcgataaacacaggtggcaatcgataaaca

SEQ ID NO: 96868 - DNA, 1726 bp, Homo sapiens
  misc_feature (2)..(2): n is a, c, g, or t
  misc_feature (4)..(4): n is a, c, g, or t
  misc_feature (6)..(6): n is a, c, g, or t
cnangngtgggagcgccggctccaggcggcggaacctccgcactgggctcgcgcgcttccggccggcgccttttcccagggactccgccaacccctcgcacccccgcgcccccagtccccgcgtccccggcgccgccggcccggagctgcccggaagtctcggttccgccgccggcgctcgccaggggaagcccggggccgcccgggacctcggcccgttcctccggacccgagaggccgccgcacgggctgccactccagatgctgctgctgccgccgcggccaccccaccctcggtcctcctctccggaggccatggacccaccgccccccaaggctccccctttccccaaggcggaaggcccctcctccactccttcctcggcggcggggccccgacccccgcggctgggccgccacctcctcatcgacgccaatggggtcccctacacatacacggtgcagctggaggaggagccccggggcccgccccagcgcgaggcgcccccaggagagcccggccctcgcaagggctacagctgcccggagtgcgcccgtgtctttgccagccctctgcggctgcagagccaccgcgtgtcgcactcggacctcaagcccttcacgtgcggcgcctgcggcaaggccttcaagcgctccagccacctgtcgcggcatcgcgccacgcaccgcgcccgcgccgggccgccgcacacctgcccgctctgcccacgccgcttccaggacgccgcggagctggcgcagcacgtgcgcctccactaagctcgagacccggcctgtgctgccctgcccgtctcagggccaccaagtctgacccacacagcgtcactcactcccacacacaccccctggctctgctgaggttactgccttaccctgggcctcagccccaccttccaaagggaggagcatcattccttccttaccccctttctagctgtgtgatgtagaccaaagtcgttgcccctccctgggcctgggaaccagtcggaactgggttccagtccagctgtgctgtgtgagcctgtgcaagtgacatgacctctctaaaccttggttttctgctctctggagcggtgaaccggtggttgtctgcggggaagagatgataaagagcacgggcacggtctggttcatttctgtatctaccccccttccgcccacgcccccgaccctttgctcaataaacattccgcactccaaaaaaaaaaaaacaaaaacaaaaaaaacaactttggcgggcggcatcagggaccaagcagaaacgctccaaagcccaaagcgtacgcgcgacgcagaccccaacgacacaggcacactgggacaatacgggtacccaaggaaactcgcgcaagaaaagggcgcgcattcacccaaaaacaaacgcgcggggacacagcgagtgtttcgaaaacaaaccagagaggagaccggggggcacaaacgggggaatacaacacggggggccaacggaggcgcaataaaatagccccccgcgcggaaacagagagaacaagcacaacacaaacaacacacaaacacgaccgacgaggaacagagcaagcaccgaggacgaacacgaccgaaaaagcaaagcaaaggggccggaagaaaacggggagaagacagagcgaacagacacgaagcgaacgggagagaagagcaacgcgcagacacgacgaacgagaggaaagaaaagaggaagaaa

SEQ ID NO: 96869 - DNA, 2175 bp, Homo sapiens
gggaaggcatttgagccattttggggtgtatagatgtagtaagacgatgggttccgtagtggggagaggtgactagacttcgaggtgctaagtgtaggaacaggatggaaaagccctagtgaaatgtggggaattgggttagtggggctctggggaggtacctagagaggaagtgagggaggccacggaatatgaagatggggaggccctgcggcatgtagtgggggggtagggggcggcaaagggaggggaagtaaactgaactggggctgggcaacaggaaaaaagaagaaaccacagattagagaaatctcggcggtcaggaggcccggggtctaagatgtaaagaggtaaacagatttagggattgattgtctgctggggtgggttgagaggagaaaagggaagaaaagtcgggggactacgtcctcagacctgacctgagtggtgagaggtggacccaggaggagtggcaggtggtggcggggttttgcagagctcagttggaggccctctccgaggcagcttgatggaacgtgggagagccgggctggagtcacagtttttattttgctagggaggtagtcagtggcgcacaaagggtaacaagcagtgatagtggggatgctttccattttaggaaacttttcctaaaaggaagtggcaattttaactaatctcccctccgccgctcccagctgccactccagatgctgctgctgccgccgcggccaccccaccctcggtcctcctctccggaggccatggacccaccgccccccaaggctccccctttccccaaggcggaaggcccctcctccactccttcctcggcggcggggccccgacccccgcggctgggccgccacctcctcatcgacgccaatggggtcccctacacatacacggtgcagctggaggaggagccccggggcccgccccagcgcgaggcgcccccaggagagcccggccctcgcaagggctacagctgcccggagtgcgcccgtgtctttgccagccctctgcggctgcagagccaccgcgtgtcgcactcggacctcaagcccttcacgtgcggcgcctgcggcaaggccttcaagcgctccagccacctgtcgcggcatcgcgccacgcaccgcgcccgcgccgggccgccgcacacctgcccgctctgcccacgccgcttccaggacgccgcggagctggcgcagcacgtgcgcctccactaagctcgagacccggcctgtgctgccctgcccgtctcagggccaccaagtctgacccacacagcgtcactcactcccacacacaccccctggctctgctgaggttactgccttaccctgggcctcagccccaccttccaaagggaggagcatcattccttccttaccccctttctagctgtgtgatgtagaccaaagtcgttgcccctccctgggcctgggaaccagtcggaactgggttccagtccagctgtgctgtgtgagcctgtgcaagtgacatgacctctctaaaccttggttttctgctctctggagcggtgaaccggtggttgtctgcggggaagagatgataaagagcacgggcacggtctggttcatttctgtatctaccccccttccgcccacgcccccgaccctttgctcaataaacattccgcactccaaaaaaaaaaaaacaaaaacaaaaaaaacaactttggcgggcggcatcagggaccaagcagaaacgctccaaagcccaaagcgtacgcgcgacgcagaccccaacgacacaggcacactgggacaatacgggtacccaaggaaactcgcgcaagaaaagggcgcgcattcacccaaaaacaaacgcgcggggacacagcgagtgtttcgaaaacaaaccagagaggagaccggggggcacaaacgggggaatacaacacggggggccaacggaggcgcaataaaatagccccccgcgcggaaacagagagaacaagcacaacacaaacaacacacaaacacgaccgacgaggaacagagcaagcaccgaggacgaacacgaccgaaaaagcaaagcaaaggggccggaagaaaacggggagaagacagagcgaacagacacgaagcgaacgggagagaagagcaacgcgcagacacgacgaacgagaggaaagaaaagaggaagaaa

SEQ ID NO: 96870 - DNA, 1659 bp, Homo sapiens
ggctggtacccggccgagttttttggatgccgggctggagtcacagtttttattttgctagggaggtagtcagtggcgcacaaagggtaacaagcagtgatagtggggatgctttccattttaggaaacttttcctaaaaggaagtggcaattttaactaatctcccctccgccgctcccagctgccactccagatgctgctgctgccgccgcggccaccccaccctcggtcctcctctccggaggccatggacccaccgccccccaaggctccccctttccccaaggcggaaggcccctcctccactccttcctcggcggcggggccccgacccccgcggctgggccgccacctcctcatcgacgccaatggggtcccctacacatacacggtgcagctggaggaggagccccggggcccgccccagcgcgaggcgcccccaggagagcccggccctcgcaagggctacagctgcccggagtgcgcccgtgtctttgccagccctctgcggctgcagagccaccgcgtgtcgcactcggacctcaagcccttcacgtgcggcgcctgcggcaaggccttcaagcgctccagccacctgtcgcggcatcgcgccacgcaccgcgcccgcgccgggccgccgcacacctgcccgctctgcccacgccgcttccaggacgccgcggagctggcgcagcacgtgcgcctccactaagctcgagacccggcctgtgctgccctgcccgtctcagggccaccaagtctgacccacacagcgtcactcactcccacacacaccccctggctctgctgaggttactgccttaccctgggcctcagccccaccttccaaagggaggagcatcattccttccttaccccctttctagctgtgtgatgtagaccaaagtcgttgcccctccctgggcctgggaaccagtcggaactgggttccagtccagctgtgctgtgtgagcctgtgcaagtgacatgacctctctaaaccttggttttctgctctctggagcggtgaaccggtggttgtctgcggggaagagatgataaagagcacgggcacggtctggttcatttctgtatctaccccccttccgcccacgcccccgaccctttgctcaataaacattccgcactccaaaaaaaaaaaaacaaaaacaaaaaaaacaactttggcgggcggcatcagggaccaagcagaaacgctccaaagcccaaagcgtacgcgcgacgcagaccccaacgacacaggcacactgggacaatacgggtacccaaggaaactcgcgcaagaaaagggcgcgcattcacccaaaaacaaacgcgcggggacacagcgagtgtttcgaaaacaaaccagagaggagaccggggggcacaaacgggggaatacaacacggggggccaacggaggcgcaataaaatagccccccgcgcggaaacagagagaacaagcacaacacaaacaacacacaaacacgaccgacgaggaacagagcaagcaccgaggacgaacacgaccgaaaaagcaaagcaaaggggccggaagaaaacggggagaagacagagcgaacagacacgaagcgaacgggagagaagagcaacgcgcagacacgacgaacgagaggaaagaaaagaggaagaaa

SEQ ID NO: 96871 - DNA, 1784 bp, Homo sapiens
  misc_feature (2)..(2): n is a, c, g, or t
  misc_feature (4)..(4): n is a, c, g, or t
  misc_feature (6)..(6): n is a, c, g, or t
cnangngtgggagcgccggctccaggcggcggaacctccgcactgggctcgcgcgcttccggccggcgccttttcccagggactccgccaacccctcgcacccccgcgcccccagtccccgcgtccccggcgccgccggcccggagctgcccggaagtctcggttccgccgccggcgctcgccaggggaagcccggggccgcccgggacctcggcccgttcctccggacccgagaggccgccgcacggggaaacttttcctaaaaggaagtggcaattttaactaatctcccctccgccgctcccagctgccactccagatgctgctgctgccgccgcggccaccccaccctcggtcctcctctccggaggccatggacccaccgccccccaaggctccccctttccccaaggcggaaggcccctcctccactccttcctcggcggcggggccccgacccccgcggctgggccgccacctcctcatcgacgccaatggggtcccctacacatacacggtgcagctggaggaggagccccggggcccgccccagcgcgaggcgcccccaggagagcccggccctcgcaagggctacagctgcccggagtgcgcccgtgtctttgccagccctctgcggctgcagagccaccgcgtgtcgcactcggacctcaagcccttcacgtgcggcgcctgcggcaaggccttcaagcgctccagccacctgtcgcggcatcgcgccacgcaccgcgcccgcgccgggccgccgcacacctgcccgctctgcccacgccgcttccaggacgccgcggagctggcgcagcacgtgcgcctccactaagctcgagacccggcctgtgctgccctgcccgtctcagggccaccaagtctgacccacacagcgtcactcactcccacacacaccccctggctctgctgaggttactgccttaccctgggcctcagccccaccttccaaagggaggagcatcattccttccttaccccctttctagctgtgtgatgtagaccaaagtcgttgcccctccctgggcctgggaaccagtcggaactgggttccagtccagctgtgctgtgtgagcctgtgcaagtgacatgacctctctaaaccttggttttctgctctctggagcggtgaaccggtggttgtctgcggggaagagatgataaagagcacgggcacggtctggttcatttctgtatctaccccccttccgcccacgcccccgaccctttgctcaataaacattccgcactccaaaaaaaaaaaaacaaaaacaaaaaaaacaactttggcgggcggcatcagggaccaagcagaaacgctccaaagcccaaagcgtacgcgcgacgcagaccccaacgacacaggcacactgggacaatacgggtacccaaggaaactcgcgcaagaaaagggcgcgcattcacccaaaaacaaacgcgcggggacacagcgagtgtttcgaaaacaaaccagagaggagaccggggggcacaaacgggggaatacaacacggggggccaacggaggcgcaataaaatagccccccgcgcggaaacagagagaacaagcacaacacaaacaacacacaaacacgaccgacgaggaacagagcaagcaccgaggacgaacacgaccgaaaaagcaaagcaaaggggccggaagaaaacggggagaagacagagcgaacagacacgaagcgaacgggagagaagagcaacgcgcagacacgacgaacgagaggaaagaaaagaggaagaaa

SEQ ID NO: 96872 - DNA, 386 bp, Homo sapiens
accatgactggggttaagatgataagagcacgggcacggctggttcatttctgtatctacccccccctcagccccaccttccaaagggaggagcatcattccttccttaccccctttctagctgtgtgatgtagaccaaagtcgttgcccctccctgggcctgggaaccagtcggaactgggttccagtccagctgtgctgtgtgagcctgtgcaagtgacatgacctctctaaaccttggttttctgctctctggagcggtgaaccggtggttgtctgcggggaagagatgataaagagcacgggcacggtctggttcatttctgtatctaccccccttccgcccacgcccccgaccctttgctcaataaacattccgcactcca

SEQ ID NO: 96873 - DNA, 252 bp, Homo sapiens
gagaactagtctcgaaaaaaaaaaaaaaaaaatcacacaactagaaaatgctggagccatgatctattctgattttgattccaggtctgattctatagcctgtgttcttacccattagaccacactgcctatgtgaaatacagctttcaatgtggccctgaggggttaaacatgacgatagacgaagtgcttagcccagttgcctgccatgccattagtcctcattagatgctgattgcgaaagaaagaagc

SEQ ID NO: 96874 - DNA, 416 bp, Homo sapiens
cttcattttcttctaatttcactgaaatatagtcttccttcttctgaaacaaaaatcactacatgctccttttatttctataattcattttttaaaaatgtcctactgtcctttttttgttcaaattaactcttcacatttttactctcacagcagacttaattcattttcacttaaaatatgcattatagtcaatattggattggaaagtatagctttgtataagtgattactgtaatgcttcctagtatactagttaattgtaaacatactgaagacactgttggaatagagttggccaaatctctctagtttctggattatgtagctaaggtgtctatatctatacctgtgtctatctatctgtctccacttatctatctatatttaatcaaattggtttgttttttgattga

SEQ ID NO: 96875 - DNA, 270 bp, Homo sapiens
ggaacgtcactgggatgaggaacgtcactgggatgaggaacgtcactgggatgaggaacgtcactgggatgaggaacgtcactgggatgaggaacgtcactgggatgaggaacgtcactgggatgaggacgtcacttgttgaatgtcccacaactattagatggtagagactaaaggtaaaactgactccaaaaatcagtgcttaccttatgttgtactactactcacagttttaggaacagaaacgggaagttaaaggcgtcttatgta

SEQ ID NO: 96876 - DNA, 591 bp, Homo sapiens
aatcctagaatggatgctcttaaactgatttaagcacgcttccatggtcagaagccttatggttgccacagggtattaggagcatggagaccaataatggatgtccttgttctgatttgaggatgcctccaaggtcacatactctgtttgcaccacgcttaggaaggagcgtgaagaccaaggggagtaatagtcaaagtccttacctttgtttgggtggtttgtttaagagtaatcaacgtattatttaaaagtgtgaaatacagtcaaagatggccaatgttattccagtgatatgggagtgacatgaagtattatattgatgatgcatatataaaaaacaggatagttaatgaaacacccaatgtttgagtgattctgtatactgatagggaatatcaagagtgttactgggttttgtgaatcacgggccttgaaagtattattaatgaataaatgacataatcaatagacaaggtagaaatgaatagcaaaacccagtaacactcttgatattccctctcagtatacagaatcactcaaacattgggtgtttcattaactatcctgttttttatatatgcatcatct

SEQ ID NO: 96877 - DNA, 427 bp, Homo sapiens
tatcatgagtttatctccacgctaaggttcacttatggactcacttggtcccacgggcccccaagttaagaatgcattttgcagattatcccatgctttattagtacctgtttatccgctaattagaacgacaatcttaatctaggccacaatattttctgaagctcaagaaaataatttaggggaggaagagaggaagatggaaatagacaaattttcactacaaggcactgtgatctaactatttttacctgttctcccttctatcagcacaattaagagtatgcacaattaagagtataacattccacttttattactacgagctaacaactgttcatacttactgacaggtgaacaaaattacaaattattcaatgttctccagcttagctttcatactttagcttacatcttttaatttata

SEQ ID NO: 96878 - DNA, 581 bp, Homo sapiens
ctctgtttacatttgctggtcgctggaagatcgaaagactggacaaaatccatatggcggccggccggcgcggtggctctcgcctgtgatcccgcgctttgggaggccgaggcgggaggttcttctgagctgaagagttcgagaccagcccgggaaacgtagtgagacccccaccatctctacaaataataacaaacaaacaaaaggtccccccgccccgccggccgcgggttgccgtcgcacccaggcacatttgaagggcggcaggagccaaggcctggctgtcactgctgtcccggacccctttgacggcccctgggggttcaccagagggctggcccgtggctcactgcccagtcctctatgaggacacttcgccatagacattttgttattgcagactgctctgggaacacccctgactgggccctaaaatgaattccagaaaaggaatcgcaggtcaaggggcggttctaaaaggcttgggctagggtcagccagagctctgtgcagcagatgggggcctggaaaagtctgcagaagtggccttccgcccaggccctgcctcccccgacgggggc

SEQ ID NO: 96879 - DNA, 203 bp, Homo sapiens
cacgccccacaaatttttgtatttttagtagagacggcatttcactatgttggccaggctggtctcgagcttctgacctcaggtgatctgtccacctccacctcccaaagtgctgggattacaggtgtgagccaccgcgcccagcctgcattttcttaattcgtttaggcttagggtctttattttttctctgttttacaggg

SEQ ID NO: 96880 - DNA, 306 bp, Homo sapiens
gctgagcctcctaggggtaacgcaacaggagcaatgtcattgcttctaagaggcagagctgggatttaagcctcaaagctttctgattgatcccctggcctggctcttttgtcggccaatttgtgctatgttgacagtgctacggtgatgaagggaaagcatctctctggggcaggaacctgctcacaaaactttgctggctggatgcagtggctcacgcctgtaatctcagcactttgggaagccgaggtggggggattgcttgaggccagcagtttgagaccaacatgggcaacatagcaagac

SEQ ID NO: 96881 - DNA, 190 bp, Homo sapiens
cctccctagcactgtctccgtggggaataagcttctccccacacttcccaaacacccaggatgccgagggcgatggaggagcagcaaacacttaagcataatgagggcaaaaccgattctcaagtggggagaacgttttccgtcaggcatgtccacccttttgaagttgtggacacaccttcaaaccagc

SEQ ID NO: 96882 - DNA, 305 bp, Homo sapiens
gatggaagctgtagtgagagagaagcttctcacacaggactctgatgcatgctcccccatgacctgtccttagctgaggcaccaccacaaccctgaccctgaaagcagagaccttggccatgtccctactttccctcttttccttacctggcacatttcattggtggtgagtcctggtctttttccttcctggctccagtcctttccagcctcccctgcccctcattcatggccctagccccggtcctcccaacttgcatcgacctcctccttgggcctcctcctctgcctccaacctggctccc

SEQ ID NO: 96883 - DNA, 468 bp, Homo sapiens
tcaggtggggtgtcctgggcttgttcttcactgaaacagacctgggctccttttcttcctgtcctcaggccagaaatcccccatcaatttgtctaagggaaccatcactggccaagatacagagggggcaagaacacaggagaccgagtcttcttaccaggagaggtgatttcaaaactccaaacaatctccaagtaaaatccagccccagtaagggcctgtagcataaatttgaattttggagggagtccagccctccacgtgtttctctgataggaactgggagagcttcccccatacagccaagtcctgtcgcggagcagtcccccgaccaccctgtctctgccccaacccctccttatggaggcaaacaggccaccaaactacagcctcccacggtgttccatcagcagtcacaggaaaaccctcatggcttctgggctttgcctccccaatatgccacccagc

SEQ ID NO: 96884 - DNA, 228 bp, Homo sapiens
aagacaactcagatatggtttcttatgttccaaaaatgattccattagcacggggtccccaacccccaagccacagaccagtagcagtctgtggcctgttgtgaactgggccatacagcaggaggtgagtgagtggtgggtgagtgggtaaaacttcatctgtatatacagccgctccccatagctcacattaccacttgaagtccactttctgtcagatcagtgatg

SEQ ID NO: 96885 - DNA, 858 bp, Homo sapiens
agcaagttcttttgccaatggcaaccagcagagcttcccctgaagattggaggggatgagtcaggggcaaggaaggattaacagattctgcctcaagtcctggtgaaccaactcctctccccaagacagacacatactagtgaaataaattggatttaaatcatcacctgaggcaatcctgaaagagaaaagcagtcctagaaaagagtggaggaaaagaggacagccccattctctttgtgaccacgaagactgccgccatgtggttgggagccacgtaacttcttttagtgccagctgagattcttctgccctggaactagttcctccgagttattgccaggcctggagattgaattcctgcagctggaaggtggggaaaggtacggacaaatgagctatgaatttaacaggctaacatcccagctccacagggctgtggccagagaggaattctcccctttcaaagctgactccggattgcttagagaaagaagcgaataataattgagtcagaatgagaagtccttccttccttctcaggaggatgtcctgttagcaacttctttggacacaaggaggaaattaagaagcatcattactgttaatatcattttctttttcagaatgttaacagccttgatattatacaaaggttgataaaaatgtatttcataagtcaaaaaacaccaacggaaacaaaaagttctccaagggggagaacggggcaataggggcgaagaacctcgaagggggcgcgcggtacccagttgtggtgccctttaaggaggggttaatcgaagctgggggaacccagggcaacagtggtccggtgggagatggtatcggcacaatcag

SEQ ID NO: 96886 - DNA, 332 bp, Homo sapiens
tacagatatatttatcatggtatgtttgatgggatgactgacacaggaaatctgttaaagtcttaaaatggaatgagaatgttgttttaaaagaaaatagcaaaacaacaaaaaagcaaaccttaaaatgtgaagaaagtgtgaattttagttttgtcacagttaactgtgtcaaagagaattaaaaaaaaaaacttcagattttgtttacatattttactacatttttgctggtataattccttagccacctatgtacatactgctttaagaaatgtttttttcctgtttatttctgtttggtttatattctggttgtctttttctttttg

SEQ ID NO: 96887 - DNA, 663 bp, Homo sapiens
ccacctcggtctcccaaagtgctgggattacagacatatggcattttaaaaattatttataatacgtgaaaaatgcaagttacaaagcagctgctcagtatgagcccgttctgggagcagtggggagaggagtggtcatattgcacaggtttcattgtgttctcagtggctgtctgctgatttttactgtttccctttgactcatctatttaccttaactgtagtttctaagtttttttgaagtgttcattactaaggtaatttttcttttttctttttctttggaggggacagagtcttgctctgttgcttaggctggagtgcagtggctcaatctctactcactgcaaccttggcctcacaggttcaagcgattctcctacctcagcctcctgagtaactgagtaactggcattacaggcgcctgccaccatgcccagctaatttttgtacttttagtagagatggttttaccacattggccaggctggtcttcaactcctgacctcaagtgatctgcccaccttggcctccccaaagtgctgggattacaggcatgagccactgtgcacggtctaactttcaacaggagttttaatttttttttttaaatttaaaagaaaagaccgagaataaaatgtacagagtttaaaggtagaggca

SEQ ID NO: 96888 - DNA, 180 bp, Homo sapiens
ctttgtcatggatacctacgggatgatctgctcagcaaccatcacccacatgccttaagtgacctgaactccttctgtatcagaaagagctgtgttgcttttgtgtactgaggggaagaaaccaaccatgaagattttgtatcactcaagagacatcataaaaaataaacaagagtttaa

SEQ ID NO: 96889 - DNA, 643 bp, Homo sapiens
gattataggcgtgagccaccacacctgaccgcaagatacttcttacacagaggctgccatcgcagaagcttgtgttgtactatcgacccccattttgggtcattttttatcagaaagatgagttgttctgcagctacagattgcgtgtataatcctggccagcatctctaaagcttgtcagctgcttcacgagtgagtacccctgttcacagaggagatcaggtgagtgtgcaggtctgaacttactactgcaatgggaaggtcagctcagagagcattaactttggatacagatgataacacaacaaaactattacctcatatctacgtcgctatgagcagactgggaatagggtaatagtgcttggagttggcagaggtgcaacagtagatggccatgggtgctgctttggaagggcctaaggatacagttgttgaatgattgtaagaacaagagaaaggtggagtctcaataaggcagccgtacaatatgtttatcaagccttcaataggtttagtatatactcctttggcgcatgcttacaagtttactgaactataaccaaacatcccactgggaaatgttttgaattgatgtgagaatttgacattaagtagcaacttgggacatcagagaggcctc

SEQ ID NO: 96890 - DNA, 671 bp, Homo sapiens
aactgcaggccaaatcaacagcaaccctaagaacaagcattcttttttttttttcaacagaactaggccacacatattttttgtcgttatttaaatttttagttgtactacatagaaaataaactcattttaaaaagttatttcagtaggcaatgcatcttcatgacttttacatatgagttttattttttattacttttgaagaaaagtctgtagaaacctacttttcaaggcatctgacccaaccattgccttggatggcagcaatccagctcaggcacagcatcaccgccgcccggccgggaagaagacgccggctcgggcagcccgcagccttcgagagaagatgcctgagaagcgcggcgtcggcgtgggtcctgcgcagcctgccccgcgagcgcccgctgcaagtgcgaggaaacccgcggtttctccagatacagttaaactgttagctctctctaggagtcacagaagatgaaacagtctcatgccaggaaagcaaaatccctggaggtgaagcccctccatccatgtaacggttaatactgtatgctgtgattcactgtgtctatttgccatcgtctagtagagtattcaccaagctagcaactcagttgagctccaactcaaccaatgaattgcctgcctgtcacaacgtgttggggtac

SEQ ID NO: 96891 - DNA, 457 bp, Homo sapiens
tatgtacatataattcactgggagagttttactagcacacttttgaattatggagttaatttcaaaacgtacatcaacttaagtaacataatgccatctcagtagaaatgcttcattttcctgatcttggaactaggtattgccacttgagtagccaatactgatccacttgaggcagccctcaaaccctagcctggacgaatataatggtcttctgtacagttttttttgctatggcttttcagcttcctcattgattaaaaatatgtgagaatctctcaaaagttatgggacaatttgagttttattactttttaaaagtcagatgagaaaatctgctccttaagaatataataacaattgcataagcatcattctgttgtccagcaatcatttgtaatgaagaggatttttacttccaaataaaataatacatgaacttttgactaaaagcctt

SEQ ID NO: 96892 - DNA, 374 bp, Homo sapiens
agcacgattcttacaatgagatctaaatgggaccattgttcactttcttgagtgtgataaagatccagcaaggagcctcccagatggagtacatggagaccatgactgtgaaagatgaggatcaagtgcagatttggtggcctctgattgccagtatctggcagccacattctcttcccacaagatgtgctggaaatatgaccaagcagaagttcacttaagtgaatccaacagttaaacctaccatggaagggtgtggtgcacagagggcatgtggagaagagaagaccacagtgggaacctccaaggaactaacatctagctggggatgaggggggatttggctatgtagagagtaaataaagtgatatgag

SEQ ID NO: 96893 - DNA, 218 bp, Homo sapiens
taataatttgtaccatgacatgcagagatatttctattttgttgcccctccttgaaagaactaagaacaattctatttcagagtttactatagctgcctagtaaatatttattcacttgaaaagaattatatgcaataagttcaactattgtggtagttcaaatgaaaaaatattttttaaccttgtgatcacattacccacttgtactttaaagtat

SEQ ID NO: 96894 - DNA, 488 bp, Homo sapiens
gatctcatgtgttgagatctctgtgccacttaagggatataccattgataagctaagctgaaggtatattccctgttctgctaagtgttctaggatgccgtcagtccaggactatttatactttttgaacctgaaaacttcatggaaatgtgtatactttctagaacattccccaaccccacctcagtgtgtgcgccttagtttcctatagttgctgtaacaaatcaccgcaaatttagtggcttataacatatctttattatcttacagttctggaggtcagaagtttgaaatgggtttcactgagctaaaattaatatgtggatagggctgtgttccttctagaagcactaggggagcatctgttcccttgccttttttcagcttctagaggccacctgcacttttggcgcatgaccccttcatccatctttaagtcaccaatggccagttgagtctttttcgtatggcatcactgatcagtactg

SEQ ID NO: 96895 - DNA, 601 bp, Homo sapiens
tattacagaatgttctttcacttagactagttttccaaaataaatttatttacttattttagagatagggtctcactctgtcacccacactagagtgcagtggcatgaacataattcactgtagcttcaaactcctgaattcaagcaatccttccgccttagccttctgagtaggtgggattacagatacatgccatcacaccctgctaacttttttaaattttttatagagatgggcgtcttgctatgttgctgaggctaatctcaatctcctggcctcaagagaccctcttgcctaggcttcccaaagcactggaattagaggtatgagccacctctcccagctacccaataaattatttctttcagattttattcaaaattgaactttttcaataaaagcaaaataagtaatgttcttgggtcctctgggattctgcattaatttcattaactctgaggagtatacaacagattttgtcttccaccacctccttaaggatattgctagttcctttttagccaaagctttcaaattatttttatttgtccaataatccctgtgaccctgaatatgcctcaataaaccatatgtttaaac

SEQ ID NO: 96896 - DNA, 428 bp, Homo sapiens
aacgatactgggggaggagtgaggaggaggaaaatgctgatgatgaagctgaccaggccaaggaagggagatgagaaaaaccagatcaagcttcacctactcctgcctacgtctaacaccaaaggtgttttgttccatgctttgaatcctttatctacacaggacaactacaaatagcaattggttaccctacccttgatagtaaattggtgtgtcagtgtctttcctgattttcttttcacgacaattgagtaacctccaaacactgtttctgaaatcagtgggaatgagaggaatcatacagtatggactgttttgtgactggcttccttgtttccacattatgtctgtgaaattcatccctcttgtggcagacaggaggagctcactgcctttcactgtcttgtaatcttccatggccggagcac

SEQ ID NO: 96897 - DNA, 643 bp, Homo sapiens
gtcacttacccagagtccatatattgaagtgaaaatggaatttcatgaagcaaatatagttataggatggtaactctggacaaattttataaaagatgaactccaattgcttcatttcacagataacagctctgagcactagggagagagggagggattggcctagcatttgctttgtgtcttgagcagtcacatctattatggaagtactcactactcagctatactcactccctgagacaggatggttggaaagaaaccccaccttagcttcatcattaaccaagaaaccccaaggatgcttagagaaaaactctggaattatttgggaattcctggaagaagctatgccctctctcctgcatcccaaagcccactctacaccatcttgaaaaatgtcaaggaactgcatggattaggttgactctggatgaccctgggtagagacacattcagtttcctgctgacaccgcaccaagaaagtgatttggtcaggtgactctaggagaaattggtactgatagtatccaaggcagatttttaagtatcagacttaatacataatgattcttgggaaagccatttaaatccctgagactttaagtggataaatgtaggtaaagtagtatagtacttggctcat

SEQ ID NO: 96898 - DNA, 448 bp, Homo sapiens
  misc_feature (2)..(2): n is a, c, g, or t
  misc_feature (65)..(65): n is a, c, g, or t
  misc_feature (181)..(182): n is a, c, g, or t
angagtgaaaaacacatgaatgcacagaataggagattgaaatataaaccacagaacattcatanaatggaatactttgcagtcataaaaatcttctcatagaagaatatttgacagcatagggatatctgtggcatattaagtagaaagtcagacttgtaaacattatatacatattcanntatatttaaacaccatgatcccatatttagatataacaactaaaagttcagatggctatatatcaaaatgtgtcaaatgttcaaccttgcataggctgactgtagatgaattttatattattctttgtgctttcttgtagttcccaaattttctttattgaatctatattacttttgcaatttaaagaatttaatttataaaattttataaaataacttataaatttgaaatgtattgcatttaagaataaaaagtgtttaattac

SEQ ID NO: 96899 - DNA, 719 bp, Homo sapiens
aataagtggataaatatcttacctgaaagatagcttcattaaataaactaactcctgagaggatttctttggcctttaatatcctatttaatagatttcttataaccatatcagcaaagccactctgctctggacaatggtcagaaggtaggaagaagtgttatagggtaatgagcaatgataaggccaccaaatataatcccattgtaatgggattctacccacttgtagaagtttattcaccactacaaattactaaagttaacctaaacaattaaagaaagaaatcttagtctttaagaacagaggattgtaaagtgagccagaccttccaatcagctaaaataatgtaaaataatgtacttttcaacctgacttggcttaatgtagttaagtaaattttaggataggttctaaaaaaccttgagaggcattttgttgttgttgttgttgttgttagtttgccttaaagttaaatgtacattgacctttggtatttcttagaaaaacctgttactgaacctagtacagaatgtgaatcatttcatgcctgaaatacaagattgatgtttacagggcaattgtccagaatcttgctgaattggaaagtatttcactcttcatcactgtagatccgtttaactttacaaatgtgttatttaaaacataaaccattttggtgcacaggaaacccacttaaaattaaattttaaaaagct

SEQ ID NO: 96900 - DNA, 518 bp, Homo sapiens
acccccacacaacaacaaaaaaggaaggaagcaagaaattttaaaaagaggtgagtcttcttttcttcccacccatgggcttttccagtccctagaaagttcttcttatagtctaacctaattccttcttgaacaaatgtaagacatatgtctctaattttcatgggaaatggagaggagttcacaactatgtccatattacctatcttcaaatacttaagggcctctctctgccttctcttctctaagataaacaagttctcttctttaagtctgtaataatcatccaatttatttcatggcccccttgatcttgaaacacggcaaatttgaataagatatttgttttaaagtagttatgttgctgtaagttctgctcctctaatacttaaactttccccattatgatacctctttgcttgttatattttaaacagtgccttgctgtttaaatgaggaatgagaaaagatttgccttgctagcatctgtcaccgccgaccctaggttgcctctgaag

SEQ ID NO: 96901 - DNA, 237 bp, Homo sapiens
gtaagagctaaatctacgcaacttttagaagaaaacataggagtaaatctttatgacctgagattaggttatgtttggtttcttagatatgacaccagaagtacaagaaacaaaagaaaaaatagataaatagaaatatatcaaaatgtaatacttttgtgcagtagacaataccattaagaaagtgaaaggacaaaccatagaatgggagaaaatatttgcaaatcatttatcaga

SEQ ID NO: 96902 - DNA, 324 bp, Homo sapiens
atcgtcatagctgactctagagggtccacggccgcatctgacccagatatttgaaaaacaattaagccactcagtaaatgaactgccttagagaagattataatgttggccttaatttcttttaccaactttccatttccttgaaatgcagctaatcaacttatattaactgtcctggaaaattttttggtttacagagctttttgtttttaaattgttaccactaatttaagaaatttagactgaaaatgttacttttaataaaaaggaaatgtcttagacatattaatgcatataatttttcatatcacgaggtgcaatcat

SEQ ID NO: 96903 - DNA, 313 bp, Homo sapiens
gcagcctccaggctttagttacaccccccccaccagtgcggaagaagacattcttcaaatttataaattataagaaatcagaaaatgaaaagatcaaaatgctaaataaactggcgttaaggagctctcgctctgctcttgcgcgtggtagtggtgagagcggggcatccgagagccctagagctggtgactgggcgacctcagcctaacacctgcctttgagcctgtatcctcgccaggtggctggaagagtaactgatggggattgggacaaaggtccccacaggtgtcttcttagtttatattcatttcc

SEQ ID NO: 96904 - DNA, 161 bp, Homo sapiens
agcagaagggtaggggcaagagtaagtgctggtaaaggcatcacacatgcagaatcagaggtctccaactgcatgaggacagaggactcccacaggctgcttaaggtaaagaggaaagaaaggagctggtaaatcaacttaggacttagaagatataatga

SEQ ID NO: 96905 - DNA, 140 bp, Homo sapiens
aaaaaaagaagggaaataaaagtgggaagaaactgatggataaggcaccaagtaaaggaaacagcagactacaggtcttaatgtaggtacaggtggggaataaatttttgtggcaaggtggatgggcacgaagaagtggg

SEQ ID NO: 96906 - DNA, 818 bp, Homo sapiens
atggaacgctcatctggctgtggcagcctgtgactgaatgagagaaaagtgccctagaagctattcattacgaattcactggaagctctcaaacgaggctggcagaagctgaaattgaagtggtctctgacctaattttcttctgcatgaaacatctgcatcaaggctctctttgatgtattccacttggctctgtctacgggattgtatcacatggactcggtgttgcctccttattgaaagacatttccagcctttgcaaggtaatgcgatgttactgttacccaagctaatcactcaatgtgctcctaaaatagaaacaatagcagttcagagacaatgttgtctgctggctgttcctgcagcttgggctcctggttttccaactgaaatctgtggcatttgcctcctgtaattccaaaacaaaggagagggagaagaagggcaaagctatgcaagataatgttgaaggaccagcagcattatgtgtgagaagcttcatcttatttggtccttcaagccattgggtaggattttggcaccatttaaaccacacagagcaataccataagaggtctgccttaagaaagaaaaaaaatctctttatttggatgttgcttttattccaaattctgattgacaccctccactgagagagagagagagagagagagagagagagagagaggtgtgtagtgaagtttagagtgttgagagacactgaggagatatatgaactacttaaaaaagaggcttccgctcgaaagctctcacaacataggtggaatgcgagagagaaatcccccgccacacgcgaa

SEQ ID NO: 96907 - DNA, 432 bp, Homo sapiens
tagcttgaatctgttttaaagtcttcctttgaacataaattatatttaaattcatatatatggatttaatattactatccccctctacttaaatatgtttttgtgtcttatgcaatgatgttggtaaataaccaaaaatctaaaatgacccccaaaatatattcacctaccatatttcctaaaaagttcttccaattgtatgtagtatctatattctcccaagtgcacgtgcgacttcaaaaaggtatgatagttgcccagatgattctaaactcaacaccagtgaggcacaactcacagagggcacccacagcagtttggaaaggcaaggttgtgttggataaaatcagatccacctagccatcatctttattgtattacccctttggagagctgtggggattgaagcaggtggttttcaccactgattta

SEQ ID NO: 96908 - DNA, 216 bp, Homo sapiens
gaaactcctggagggcagagccatgcctgccatttccatcattgcattaccaccacccagcacagtgcctggcacaaaagagttgctcaataaataaatcaggatgaatggataaatacacggataggcactttgaattacagatgagcttaaatactttgtgtttttcttagtcaaacatgtgcaattaagcatgtgataaattatatgatgacc

SEQ ID NO: 96909 - DNA, 417 bp, Homo sapiens
gcactggagctgaatttaccctgggaaggcaaaccctgggaagtcaagagcagcctggggctgaaacaataattactgcaagagcctccacggagacagcgcccgcaccaccagcatctcccattatggatgggagaacagaggccccgagaagttaagctgcctggccaaggtcacacagaggcagagctggattcaacgcaggcagattggctccacagtctgtcccaccgccccaccctccaaagtcccccggtaacagtccagttcttcaccaggcggtgaagaactgggcctgttgaggtaaacatgaggaagttctaggcctgtagagacaagtcggagaaaggagctggggctaaagaggctgttgtaaggcttgagattggcctacataggcgtctagaaggccggagc

SEQ ID NO: 96910 - DNA, 605 bp, Homo sapiens
aacaacggggtgaaataggccttacttgcccccattttatagctgaggaaactgagtttcagagaggtcaagtaattcactcaggatcgtagagctgataaatgagagccaggttttaagcctgcctgtgtctctctaatccaaaatatatgtgctctccattgtacttcctatgccttagagagactgattagtgaaagggaaactaggaaatgcttgagtatttccagtcctaataatattcagttcaaattccaggaagggcagtgattttcaaccttcttaacttttctgttttaaatctgcaaaagaaaacctgccacagaccagaaaggagaaagttccccctaaattgtgtcaatctttgcagataataaagcaactctttcacttctgcaggattgtcaagtgggatgtccaaacctgagaaacagctatttgggttctttactctgcccctgaatagagtcggagcttcaggcttcagggaagggacaattgccatcaaaagtcgtatgcccgggagcaggtgttgctcagaattgtgaagacgttatgaacccaggtgacttgactcaagagttacaaccccactaatgagaagg

SEQ ID NO: 96911 - DNA, 186 bp, Homo sapiens
tcgaagaatgagagaaaaagagagaaccttggcctggtgactatactcttcaacacaactcagggaggccaggtgtggtggctcacacctataaccccagcactttgggaggcagaggtgggaggctagcttgagctcaggagttggaaaccagcctgggcaacatagtgagaccttatcactacc

SEQ ID NO: 96912 - DNA, 3069 bp, Homo sapiens
tctctatttttcctgcaggctcggccggtggattaccctaaggactacctttctcatcaagttcccatatcgttccacaaacactggaacatcgatccagtgaaggtgtatttcacatggttggcacccagtgacgaagacaaagccaggcaggagacacagaaaggttttcgagaggagttataaatcagggtgacctgtgcgcctagcctgcgcagggaatgaactggagactgtggcctcatcccactgtgctgtgctcacaacacttgtgtctgccacatggcattgggtgcttcctgactttagggggagattttatgtatggtattttttgacagaggaagaaaaggggtcacaggagaaacatttttttttctgggaaaaatcacttgcttttgacttatgcagttgttttaacacttagtgatgactgtgtattctccaagctgtgatacagcagtttttttttattgtcacagggaaataaatggtaccagaagtccctttcctgttctgtctcttcattgtaatggaagtttcagttgggcatgagcctggagagatgtgactgtctacagttctatttgtatatataaaaagaagactgaaagtcttttgacatggatattgtgaatggtatgaacttttaaaccatattattgatgatgaaaattatttcctgggaactcagtaggaataataccgtattaaggaataatactgtacataaaacatcatgaaaccctagatatgaaatcccctgaagtctgtaatcatggtggttatgttttgtctattcttttgctgtttgtgcctcataaaaagagaatgaggtcttctgctagagcttcgtattgctttggaagttcatctgtgttttatttctccctgaagccctatctttatggcttacttgtaacatgaaagtagtagatgctgccagaaaatagtgtcctcaatattttaaaacaatgttgacatgttttgttcaagtcagcaagctctatgtgagtctcaggaagtgaattaaatttggaccttatgttttactcttgtttttttttttttttttgaatgttacttaatgactctctcctgactcaggagagaaaccccttgtggaaggacagcatggtgatcaggcaatttctctgggttcccaaagaatgacatttgaacacagtattttgaaacagctctagttttcaaattatatctttaatatatagtaatgtaacatattcagtattaatgtataaaaagcactctaattatataattcagtttttgtaaaggtatttgcataaaatttaatatgtcttaaactaattttggtaaattacttcttttttttctttttaataaaaactgttactcattaactttgcttataatgctttttatagcccagcacagaatttaaagccataccaccaaaagtacctgtgtgtgttaatatgtttttcttgtagcatagattgactatttgcaatagtattagtatttaccatttttccaaattagcaactaccagacctcacgtgttgcagtgataacacaatgcattggattcagttttgtgaaaatggattctgtggccatccaagggatgtatcagggatgatcagctgatgagaggctccagaaggatttctagatcgcttcaagcctatactgatggccttagctttgttcagtcattgtaactgggattgttgtcattgctaccgtggtagtcaccttcatgtcatctataatagtactcctggagagccctggctgcctacaccagtggaaaagagtctccagttctgctctggcctactaactgttaccactgagagaacaacatgttcatttgacatgattgaagctggcatccgtatatgaagatccttgtcaagctttcttctgtggtctgattagtgttgataccggggcacctcctctggtacttttaagtgttttgttaattatgtttactttttggaatggtgtaagcctaaccacaaataaaagatctttgcctaagtttttgatttctcaaatattgtgttcattagtctagactgggaatggggaggggaaatggggaaaatgaatgaatgaaatcagaaaaaagtcagcggctcagtaaatacagtttaaagagagaataattacttcagagctacccttttaagagaaaaccatcagaaattgataatgtttatataaagtttataaagccattgtgttttgttatataacaaatcagagatgttattttagaatcgattcccatctaaagaactcaattttgagtctgacatttccaggaccagatattgtcttactcacatttcctttgctttgaaatagggctttccttccaaatggctatttttaggctagggatgttaacatcagggatttgtgtgtggaataactggaatgtcatttttgcttttaagccatttctgatgatatagccaaagcaggttgtctgactatgtaggatttttacatcttgaaactaaatcagaaatccagacatgaaaataacctttctagaatgcctaggagcagaaaacaataatagcatgctaaatcacaaatgatgctatgtatgggtatgtaaatatcagtgctgtctgcatttctgggtttattgaagacctcttgttgtatatatcctcaaaaattaatgtaattgacatcttcaagaatgtttctattgtcttccattcataatcagagatgtaatttgtatggactaaataaaaactttattatgtaatgaaaaaaaaaaaaaaaaaaaaaaaatttggggggggtggggctggaaaaagttttctaaaaacaattcggtggggcgcgcgggcccagtatgttctactggagacacgttggcccaacaggttgctcccaaagggaacaccgggcccaggcacacgtggctgtgggttccccacccaaaaaaaaaacgccggggcggaacccggagggttctgaccaaacccaaagggagtcgagaggcccatcggggtctatcacacggggtgctccagagagcgaaattaattc

SEQ ID NO: 96913 - DNA, 2033 bp, Homo sapiens
tctctatttttcctgcaggctcggccggtggattaccctaaggactacctttctcatcaagttcccatatcgttccacaaacactggaacatcgatccagtgaaggtgtatttcacatggttggcacccagtgacgaagacaaagccaggcaggagacacagaaaggttttcgagaggagttataaatcagggtgacctgtgcgcctagcctgcgcagggaatgaactggagactgtggcctcatcccactgtgctgtgctcacaacacttgtgtctgccacatggcattgggtgcttcctgactttagggggagattttatgtatggtattttttgacagaggaagaaaaggggtcacaggagaaacatttttttttctgggaaaaatcacttgcttttgacttatgcagttgttttaacacttagtgatgactgtgtattctccaagctgtgatacagcagtttttttttattgtcacagggaaataaatggtaccagaagtccctttcctgttctgtctcttcattgtaatggaagtttcagttgggcatgagcctggagagatgtgactgtctacagttctatttgtatatataaaaagaagactgaaagtcttttgacatggatattgtgaatggtatgaacttttaaaccatattattgatgatgaaaattatttcctgggaactcagtaggaataataccgtattaaggaataatactgtacataaaacatcatgaaaccctagatatgaaatcccctgaagtctgtaatcatggtggttatgttttgtctattcttttgctgtttgtgcctcataaaaagagaatgaggtcttctgctagagcttcgtattgctttggaagttcatctgtgttttatttctccctgaagccctatctttatggcttacttgtaacatgaaagtagtagatgctgccagaaaatagtgtcctcaatattttaaaacaatgttgacatgttttgttcaagtcagcaagctctatgtgagtctcaggaagtgaattaaatttggaccttatgttttactcttgtttttttttttttttttgaatgttacttaatgactctctcctgactcaggagagaaaccccttgtggaaggacagcatggtgatcaggcaatttctctgggttcccaaagaatgacatttgaacacagtattttgaaacagctctagttttcaaattatatctttaatatatagtaatgtaacatattcagtattaatgtataaaaagcactctaattatataattcagtttttgtaaaggtatttgcataaaatttaatatgtcttaaactaattttggtaaattacttcttttttttctttttaataaaaactgttactcattaactttgcttataatgctttttatagcccagcacagaatttaaagccataccaccaaaagtacctgtgtgtgttaatatgtttttcttgtagcatagattgactatttgcaatagtattagtatttaccatttttccaaattagcaactaccagacctcacgtgttgcagtgataacacaatgcattggattcagttttgtgaaaatggattctgtggccatccaagggatgtatcagggatgatcagctgatgagaggctccagaaggatttctagatcgcttcaagcctatactgatggccttagctttgttcagtcattgtaactgggattgttgtcattgctaccgtggtagtcaccttcatgtcatctataatagtactcctggagagccctggctgcctacaccagtggaaaagagtctccagttctgctctggcctactaactgttaccactgagagaacaacatgttcatttgacatgattgaagctggcatccgtatatgaagatccttgtcaagctttcttctgtggtctgattagtgttgataccggggcacctcctctggtacttttaagtgttttgttaattatgtttactttttggaatggtgtaagcctaaccacaaataaaagatctttgccta

SEQ ID NO: 96914 - DNA, 1834 bp, Homo sapiens
tgtgacattatgtaattgtgtacttgagaataacgtgcaaaaatacaataatgtcacacatccctatatattttctttttatgtattttactttctttacaaagaaattaattcttttttttctttttaataaaaactgttactcattaactttgcttataatgctttttatagcccagcacagaatttaaagccataccaccaaaagtacctgtgtgtgttaatatgtttttcttgtagcatagattgactatttgcaatagtattagtatttaccatttttccaaattagcaactaccagacctcacgtgttgcagtgataacacaatgcattggattcagttttgtgaaaatggattctgtggccatccaagggatgtatcagggatgatcagctgatgagaggctccagaaggatttctagatcgcttcaagcctatactgatggccttagctttgttcagtcattgtaactgggattgttgtcattgctaccgtggtagtcaccttcatgtcatctataatagtactcctggagagccctggctgcctacaccagtggaaaagagtctccagttctgctctggcctactaactgttaccactgagagaacaacatgttcatttgacatgattgaagctggcatccgtatatgaagatccttgtcaagctttcttctgtggtctgattagtgttgataccggggcacctcctctggtacttttaagtgttttgttaattatgtttactttttggaatggtgtaagcctaaccacaaataaaagatctttgcctaagtttttgatttctcaaatattgtgttcattagtctagactgggaatggggaggggaaatggggaaaatgaatgaatgaaatcagaaaaaagtcagcggctcagtaaatacagtttaaagagagaataattacttcagagctacccttttaagagaaaaccatcagaaattgataatgtttatataaagtttataaagccattgtgttttgttatataacaaatcagagatgttattttagaatcgattcccatctaaagaactcaattttgagtctgacatttccaggaccagatattgtcttactcacatttcctttgctttgaaatagggctttccttccaaatggctatttttaggctagggatgttaacatcagggatttgtgtgtggaataactggaatgtcatttttgcttttaagccatttctgatgatatagccaaagcaggttgtctgactatgtaggatttttacatcttgaaactaaatcagaaatccagacatgaaaataacctttctagaatgcctaggagcagaaaacaataatagcatgctaaatcacaaatgatgctatgtatgggtatgtaaatatcagtgctgtctgcatttctgggtttattgaagacctcttgttgtatatatcctcaaaaattaatgtaattgacatcttcaagaatgtttctattgtcttccattcataatcagagatgtaatttgtatggactaaataaaaactttattatgtaatgaaaaaaaaaaaaaaaaaaaaaaaatttggggggggtggggctggaaaaagttttctaaaaacaattcggtggggcgcgcgggcccagtatgttctactggagacacgttggcccaacaggttgctcccaaagggaacaccgggcccaggcacacgtggctgtgggttccccacccaaaaaaaaaacgccggggcggaacccggagggttctgaccaaacccaaagggagtcgagaggcccatcggggtctatcacacggggtgctccagagagcgaaattaattc

SEQ ID NO: 96915 - DNA, 801 bp, Homo sapiens
ctcactgagcactcctttacagacttacaagtctttactctgtgcctatttttctgcatttagcagtctctttatttgttggtaccaccaaaggccagcatgatgcctggtacatacttagtgcttataaatgtccaatgaatgagtgaaactgacaggctagagaagggggtaggtaaggagagctggtccaggaaaagcccagaatgacagtggatttcagagaggctctcttcctgatacagagggcccctgcacctacagatgaagaagggtggcagtttcaggtgtctggactggttctctgcaccccattcagggcagaaaggcagggtttcaggactgggagccagctgtgttattacaggtggcctgggttctgtgttgagcgagatcctaatggtccctacatttaaggcagccatttccagcattttggccattgcatcaggagaaagagaggcaaaaacaagaggggatgtcattcaaagaacagtacactgaattgtgggggtagagtggggaggaggaaagaggcaaacatctggccactgaatgactcaccaaagttaggagtgagccatctgtgtgaatcccagaggaaaggctcacaagcactcatctgctacgtactcaccctgtaatgtcgcgggaaatgcataaaagtgaaaagaactcctacgccaaagttccaggtgtggaaaagttattctgagcaaggagctagtcaacagaaaggatgtagcaattcaaattacatagaacaataagatttaacaaattgagacatggggaagcaaa

SEQ ID NO: 96916 - DNA, 356 bp, Homo sapiens
aactgaaaaaattaatcgtcgtatgctcttcactcatcattgaagcagcatgcctacttttggtgccgtaaaaatggcagctgacaaaatagttcttacaggtaaacaatttggaagacattatacaaaataagtttatagttatcttagaaggaaggtgaaacaactctctagatgggataaaccaggtgctaatacggatgtgttaccttacatgggctttgcatttctctgcggtgcttgtttctacttttctgtcctacctcctgccctgccccttgctagtttttattattattattattattacaatgaagtgagattaaaggaacctttgggtgccaatgaaaatatta

SEQ ID NO: 96917 - DNA, 808 bp, Homo sapiens
aaaaaaaaggagtttgatttcaatgtcgcccgttgctatggaaacattgccagcattacaccttctgatatcttcatcttctccaatctctggctgtgaccctggagaaattatgaaagaagaaagggcaggaataaagatggactgagcaccagtgtgaactgtacgccagtgattatgagtaccaaggccataacctcccagcctcatagccagacaatgacatgggaacaaatggcttcattttgtgggtggagaacttgagcctcagaggtcatatgtattgtcaggcaaagccaaaaaagtgacttactgaccaccaagaatgaacagctagagctcaaactacaatggacgtttcttagaaactcctaattccaaatgtgttcactccagacaaggatcttggacatagcgacaaagtagcattggccacatccaatgagaacagccatcaggacagaggccagccttgtagctggagcttggtgaggtcaacataggtcagagggagaggccagcacacagctctctcaggaacaccactgggctatgggaggatcgagagacagatggtgcctccacaagaggcgtggatccaggactctggagggcctggggctccccaagtgagggtccttgggtgcaagactggggtaacactgatgcacctctcggctgtagccaccactgaaacatgctttgggagcagatgtttgaagccacaggaatgtgatctgtgccattgtaggcatgatgtgtcaaaaatgtggtttgaaaggcccatatttcttgaaagccctgtgag

SEQ ID NO: 96918 - DNA, 838 bp, Homo sapiens
aaaataattatataataagaatatatcattatattttataatataatatatgttagagcccgttgctatggaaacattgccagcattacaccttctgatatcttcatcttctccaatctctggctgtgaccctggagaaattatgaaagaagaaagggcaggaataaagatggactgagcaccagtgtgaactgtacgccagtgattatgagtaccaaggccataacctcccagcctcatagccagacaatgacatgggaacaaatggcttcattttgtgggtggagaacttgagcctcagaggtcatatgtattgtcaggcaaagccaaaaaagtgacttactgaccaccaagaatgaacagctagagctcaaactacaatggacgtttcttagaaactcctaattccaaatgtgttcactccagacaaggatcttggacatagcgacaaagtagcattggccacatccaatgagaacagccatcaggacagaggccagccttgtagctggagcttggtgaggtcaacataggtcagagggagaggccagcacacagctctctcaggaacaccactgggctatgggaggatcgagagacagatggtgcctccacaagaggcgtggatccaggactctggagggcctggggctccccaagtgagggtccttgggtgcaagactggggtaacactgatgcacctctcggctgtagccaccactgaaacatgctttgggagcagatgtttgaagccacaggaatgtgatctgtgccattgtaggcatgatgtgtcaaaaatgtggtttgaaaggcccatatttcttgaaagccctgtgag

SEQ ID NO: 96919 - DNA, 281 bp, Homo sapiens
ctggaaaagcttcagtgcagatgtatcttgggtggtcaagtcaattcacatcatttttggaagtagatacaatataaataagtgaggcaaaattaggataatttcatcaactctgaaatgcattggttgccagatacgctattattttatgtccctctaaggtaggttaaaaatgctgccagttacggcggggcacagtggctgacgcctgtaatcccagcactttgagaggccgaggcaggcagattgcctgtgctcaggagctcgagactagcctgggc

SEQ ID NO: 96920 - DNA, 315 bp, Homo sapiens
gcaatattattttcccaaactttctcttaaaactttttcaaaaccaggcatggtggctcatgcctataatcccagcactttgagaggctgaggcttgagcccaggcattcgaggctgcagtgagctgtgatcatgccactgtactctaacctgggcaacagagaaagaccctgtctctaagaaatgggaaataaaaaataaaaactttttcaaactgagaaaaaaaattgacagttgcatctaatgcccttcacatacagtcaatgttagaagaagatttaccctgaacatctcacttttctgcatggctcaggt

SEQ ID NO: 96921 - DNA, 339 bp, Homo sapiens
cagtcactgcaaatgaggttacatgtttagtattctgtaactactaaagcaagaaaatagattaatattttagttgtggtttttgcacagatgcacaaagtcagaactgatattcatagttttataattcagtgaaataaaatccaccccatttgtaaacatttcacttgaagttgagtacatgtcgtatattaaataattgaagtttggctgggcacaatggcgcatgcctgtaatcccagcactttgggaggccgaggcagacctcctcacctgaggtcaggagttcaagaccagcctggccaacatggtgtaaccccttctctactaaaaataaaa

SEQ ID NO: 96922 - DNA, 739 bp, Homo sapiens
caggaggatgtgcatacattatatgcaaatacacaatgctacgccatcttatataagggacttgagcacccaaggattctggtatctgaggggtcctagaaccaatccttcatggtttctgagggatgctttaaaactgccaagtctgacattttgaaaatacaactgagcaacttgttttattatgcaatagcccattaaaagcgtgtggtgattttgttctcttgaacaaaaatgatataggagtgaatcatatcaggctggatgggaaggcaagcattgttcatagccaagtattttctaaaggcaaacgggtttacagccataccagcctgaaagtgtccatcttgtctaacggcaaatggctgccagggacgcggcctggcctctcctgccacatcttctgggtaaaggtgatcagggtaggtgtcttatcactactccagagctttagaatttaaaaaattaagccataggaataaaacacctaaaagtcaggacaggtccccatttgaatttgttcagctgttgtccttgtaaaagctcctgacatcactttgctctctagaactgttcaggggccaggggacttgagactaaaagtcaggaagcccaacaaacagacaattttaaactgagaaatacagtttatttttttctgtaaacctgatttttcccccccttggagaaacactagatacattttaagagatgaataatctgtatataaatattgcta

SEQ ID NO: 96923 - DNA, 533 bp, Homo sapiens
agagtactgggccaggactggtgttgctaccacttgtaaagtcaaaaagcctgagccgatggtaacgagtggtactgtttccgtttcttttccatctattgcaactttctcaagcattttcagctctgaactttaattccagactgtattttctgtgagtcctgatcaagtgatacaaatgagctgcaatggtgacataaactcttgacagagattggaaaagtagctggaacaccatcttttcttttaactttttatggtgcttctgttggcatagttggggaaagcacctacaacatgagttttatcatgaagcttcacagacactttcaaagaacagtcattctgcttgccactttttgtatggtgagcattatcatttctgcttactacctgtacagtggctacaaacaggaaaatgaactctctgagacggcttcagaagttgactgtggcgacctccaacacctaccatatcaactaatggaagtgaaagcaatgaagctttttgatgcctcaaggacagaccccac

SEQ ID NO: 96924 - DNA, 410 bp, Homo sapiens
ggaaggagcccctggagagaggtttaagccaagtctgccccagggaagtgtctctggctggttgtgttttcagggactgagctggtgcctgggactccatctttgtctggggtaccgcattgtatgtagtcacagccttaagtaatggggagcactggagggctggggcttggaagagatacaagctgagaggagcaaagaagctggcagctgatagcaaaagaccagaggctcacaaacatgcagtttgcaaggaaagccaggaacaagggtcagctcccaaagaggccccttccacacccatagcagtcccttagggtctcttccacccccttagggtctctgctaccctcttagtgtctcttccacctgcttagggtctcttccactcctggtcagcttggaggcca

SEQ ID NO: 96925 - DNA, 215 bp, Homo sapiens
agagatttcaccactgcactccaacctgggcaacagagcgagactccatctcaaaacaaaacaaaacaaaaaacaactaaagtagggtaagtggcacagagtggtggggtgttcagattgtagatgaggtggccagggaaggtcctttggataagatcaccatatcactgagggtcttgttagggaaacaaactacgtgtttcagagaggggaaa

SEQ ID NO: 96926 - DNA, 504 bp, Homo sapiens
cggactggaccagctgttgggctttgtttgctctttttacgaattgaaaaactgaagccaggagcggctgggtgacgtcccaggtcactccttactttcctccccacgctgagctcagacgacttcccgtgacaccactgttggtggcggaatgggactgtggctgcttccgctcagccacgctccctctctgtggacggcggagggtgtgtgtcccagcccggctgccgccctcccttaggtctgtctcccggggctgctgtaacccaggctcacaaacctggtggcttaaagcagcagaaacttagtctatcagatctggaatccgcgtcgattggccatcatccagccatcggtgttggcggggccacctccctctagggcctaggggaagagcattccttgctgcctccagcgtctgggtgctgatggcattccctggccagtggccacctccctccagtcgctgcctccgtgtcccatggccgcctccctccagtctct

SEQ ID NO: 96927 - DNA, 437 bp, Homo sapiens
gttgatactttggaggattgacaggtttgacaactgagaggtgcctgggaagaggttggttcctgttgctgaggagtaccagcaagttttgaagggtggcaatgggaaggatatgatgtgacaaactggactgctaatgggctgttcgagtgaagatgtctgtcatacctttacagatgcaggtctggagctcaggagggaggtcagagctgaacttgacatcatcaatatagaactaatcattgaagccatagtatggcatcattgggaggaaatgaggaggaaaatatagaaatacaaagatgtcaaggaagtagccttggggaatgcccacctctgggaagtgggaaaactctaggagtagccagagctcaaagaatctgtgaatgagcatagtgtcctaggaggaaggaatagtcagttttgtgaactactac

SEQ ID NO: 96928 - DNA, 436 bp, Homo sapiens
cctctgatgactatcttaacaagttcctgccccgtgaaatacaggttggaaagggggctggaagagggaactggagcttggtactaagctgcttgaggtttctcagaaggggtatggccaggaggggtggggccagaaacccctaaaccagaactgaaatgtctcactaagcagctaggaaactttatgtaagttaaacctctttcccatccacccactcaccttcagtccccaaaaagtaaaggcacaaaacatagcgtttgcccacaggccaccagttctctggggttgaggggctgatcctattgcaaagtcctaagtcagtagctgagggtaggagacggctgggagtgcagtcagggttctcccttcccaggtttgatgggtccttcttctggggtcaggtaatgaaagtcttgcggcacaagtacctcat

SEQ ID NO: 96929 - DNA, 219 bp, Homo sapiens
ttgttttatttgaatattagcacatataagaataaacttttgggaaataactacttcctattctgcccaccctttacttaagcagtaaagtacctcttttctaaagaaccaggaaacatcaaaataaccacaacaaaaatctaaacagttttcaaataatacattcagttctcataataataagggctatataccatgggtccacacaaactgtgctgc

SEQ ID NO: 96930 - DNA, 1029 bp, Homo sapiens
tcctgggtctgcgcccctcccctctgcggtacccgtgtcctgcctagtaggggatgggggtggctttccagcacagccagccctcaagtttcccagaacagtctccccacctccccccaacactcgacattgttcctctctggctgttttttcctgttcgggtcccttcaaggcccaactgtgcccagccctctgcagctggggacactgagtgggttgggggtgtatgtttgcaaggatagaatttctcatgggggagtggccctgcttcctcccctagaatggcttggggcttagggctggggacttgccctccatggaggtcagtgggagttgcagctgcagcgagggggctagcgcagtgcccagctcgctgggtgacctcgggcacggctcgtcccctcctcggcttcagtttgcctatctgtatgttggagcttctactccacatttcttctcccctaactccagcccctgaaaccgtcttccccagtccctccccgggctgcgactaggttggacctagaagcacacgggaccaggctgggcgaagaacactgacgcccagagccgaataaacaagagttccgtgtttcagtctctgcttctctgtacctatttcgacctctcagtcgaggctgggtctctaatatacctttctctattagccatgctgcttctccctcacggaagtcccactgtctaccttgaatccaacccgctgtggcgcctttcttgccaactcaatccatgcaccttccgtgggtggttttggcgggccgtcctgacccccaaacatccctcctccctccctggcgtgaaagggctgagatttgctccggcaccctacgcgcctgacgttataatgcacctggggtgggctgcgacctcccagctgagccttgttcctcgaagagacaggagactaagagacaatgagctgagtgaggagcccaggaacccgggttccgaacagctgcgtagaatgcgagcggccaaatggtggagaatctggccgggtaaaaggag

SEQ ID NO: 96931 - DNA, 1694 bp, Homo sapiens
tcctgggtctgcgcccctcccctctgcggtacccgtgtcctgcctagtaggggatgggggtggctttccagcacagccagccctcaagtttcccagaacagtctccccacctccccccaacactcgacattgttcctctctggctgttttttcctgttcgggtcccttcaaggcccaactgtgcccagccctctgcagctggggacactgagtgggttgggggtgtatgtttgcaaggatagaatttctcatgggggagtggccctgcttcctcccctagaatggcttggggcttagggctggggacttgccctccatggaggtcagtgggagttgcagctgtaaggtggcagggcctacccatcttacagaggtgaagacgaggtccctctgcctctgctgcagacatggcgtctgcacccacccttccaccctcagggcctggccacggggtcctgggtcccccacaatactgtgcactcgacctggttgacccaggacaccctcctcgttgaacagccctggctacacctgcttcagtgcaactggagccctcaccggcgagtgcctgacacctcggccttttctcttccggaggggcgctcctcagtgtgtttggggtctccctcgctccacgccctccagggggccgcatgtgcacttgccctgcattgcctggcccccgaggttccagggtctcaactgtctactaaccggcttcccgacagggtgagggtgaggtcgcatctacaaccagagccagcgcttccccgccgccaccccttttcttggaatcccgctgcttagctacctgcgggtgtcattggccccgccccatttccccacgctttgaagggggcgagtctccacagacctcctagggggatagacagcagctggtgtgaccccacacacccagtgaggtctctggagccgcggtgcgggaagcggggacccgggtttgaatcctgcccctctggtgtggtgcggcctcttcccacagacttttggcctcagtgttccccgcctgggaagtggggactggccctggtacctggctccagagctgcacccagaggcgatcagcccggtgcgggaacggggcggggtggccgcaactacgggccacggatcctgacccgccctgcccacgatgactatccacatcctcatcctgctgttgctcctcgccttctccgcccaaggggacctggacactgcagccaggcgaggccagcaccaggtcccccagcaccgcgggcacgtctgctacctgggcgtatgccggacccaccgcctggcggagatcatatactggattcgctgtctccaccaaggagccctcggggaaggccagccacgagccccaggacccctacagctatgggcgccgccggtggcgcgaggcggaagcccggctcggttcccaggattccggcctgcagcgagggggctagcgcagtgcccagctcgctgggtgacctcgggcacggctcgtcccctcctcggcttcagtttgcctatctgtatgttggagcttctactccacatttcttctcccctaactccagcccctgaaaccgtcttccccagtccctccccgggctgcgactaggttggacctagaagcacacgggaccaggctgggcgaagaacactgacgcccagagccgaataaacaagagttccgtgtt

SEQ ID NO: 96932 - DNA, 845 bp, Homo sapiens
gtttctcaaggaagccatagtctgtcttaaaatgctttaggacagctttacttttgaccacatgaccagagtgctctggaagcttctgatgcttcaacctaaaagttccttgaccccccgcccccccccttttttttttaattttaaaacaatagtatcttcattttcctgacacaaagtagcgagtgacctaggaaaatcaagtctgagttaactttaattctagaacggtctctttgtggcagtgttttctgcatcacaacaaaatctagataataactgcttagtttgtgatatgtaggtaattttcaaaaattttgttaatttcctgaaaagtttggggggtatctattttggataatgcatttattttaaaggtagataggatctttctctggtaggttttgcttgttgcttttagtagccacggacctgggctttcatcctgctgcttttcctctcttctgtcttctcctggagctgttgagtcaccagggcacacagatccctcttctccatttcctggggcacctgtttggcctcacccctctcctgcctggactgttgtaatgctctccttatctattttcttaccttttctgttctctgccccatcaggccatttaacacactgcttccctggtggtctttctgaaacagcaatgtgtctcttccctctccagaattcttcaagtctgacctctgttccttacagcataaaatatataaactctttagtgagatagaaagtttctttattgtgtagcccagtggatttcagcctttttgtgtcattgatacatttccatttcagaatttttagctgcataatggaaatgattgaa

SEQ ID NO: 96933 - DNA, 399 bp, Homo sapiens
agcatgggatctggattcagtagcaggcaggaaatgtggctctgtcaggatagcagcaccacctcagctcctcaaggtttgcagaatgaccaaaaggcctacaaggccagggtgatctcagtcattttagggtattcccagtcacttataacaacaatccttcactgtgtataagatgtttaccaagtgtttccaattatattaacttgtttgatcctcttaatatctcttaagaagacagtactctgaattcaaaaccaaacaaaaagaactgtaaatctccattcattatatttcctttctaattgggatatgtaagctttatctgtaaaattaaaaaaaaaaatctgtgcaagtagccaacattctaaagcactcaagtaccagtcggtacaggcc

SEQ ID NO: 96934 - DNA, 387 bp, Homo sapiens
cgtttattattcagcgatcctgcaacagctctggacaccttcctcctccagcacggagtcagggattactttctgttaaccatatggccctttacaaagggctttctcaaatgtgatctcattcaatccttgtaagagtgggacaggaaggcatagtaggcatcctcctcctcctcctcatttcatagcaggagctgagcctaagagactgtcagtttcccacctgggatcagagaggccctgactgcacagtgtaaccatctggagggctttttttctttttcaagacagagtctcactctgttgcccaggctggagtacagtggcccgatcttggctcactgcaatctccacctccccggttcaagtgattcttgtgcttcagcc

SEQ ID NO: 96935 - DNA, 347 bp, Homo sapiens
tcccctcagagaggaaccccaacaaccaatgaaactactccacaccaaggagagatgagggcccagagccaggccaaggaatctggattgctacctgcctgagttatggttgtaatgagaatgtagtaaggccagattctatataaggtactgtcacacaattacatggatacaaaaagagtggggtgaaaagggagattcaaacatgggacgtaggccaggcatggtggctcacacctataatcctaatgctttgggaagctgaggcaggcggatcacctgaggtcaggagttcaagaccagcctggctaacatggtgaaaccccgtctctactaaaaatacaaaa

SEQ ID NO: 96936 - DNA, 544 bp, Homo sapiens
ttttaatagagacggggtttctccatgttggtcaggctggtctcgaactcgctacctcaggtgatccgcctgcctgggcctcccaaagtgctgggattacaggccaccgcgcccggcctccaggctcctgaatcttttgttttcctgtttcgatttttctgggttaatttataacacgatcttgtctcagcttttccacagagccctccccttcacccttccctcattgttcaggaaagcttaggccacgtgacagtgaggggagtgcccccacaatgattatgtcagcagctgcttggaggcctgttcatctactacccacgtttccagggagccctgcgaggaactactcatcacggtcctggatggagggggctgtgtaactgcagctctcctgagcccagactaacattttattgcctgcaaatcgtgcccctgttctctttctaggactactcatctcttttagagaatcagaattcccagccccctttctcctgttgacactcttttcccacctccccaacctatccttgtttaaaaa

SEQ ID NO: 96937 - DNA, 400 bp, Homo sapiens
taattttcccaataaagagcacataatttacaaataacaataaaatgttcagtattctttgttctaaattccatgtacccaatcgtttctttaagaatgtttttattgatttttgccaaattattgtatctatagctaacctatgggtgcaactgatgaatgaatatagtcccaaaataatatggttagtatttttggttaccttagtaggtaagaagaaggtgaaaccaaaaagacctgtgttggaacctcatttgctcctccataatattagtaacttccttactgaatcaaataacagttttcaaataatagaccaccactatttttccagttttgtgctgctcatgatgtaatgtctacaaacacagcacactttgaagtttaatatgtaatattt

SEQ ID NO: 96938 - DNA, 830 bp, Homo sapiens
gtctcatcatctggttaccaggatatttcctttaagtgttttctataccaggacccattcatatagcagttaattacaatggactttctaaggtgaagaaagaaaagagacagggaagtaacctgaaagatcatttctataatttttcaaagtttatctgcaacaagcagaaaagtcaagataactaccaaattgaactacaatatagatagatgatagatagatagatagatagatagttaaagatagatagatacatagatagagataataggtagaaatagataagtggaagaactttcattgtttttaactgcacaaaatggaagttgtcctaactcgatatgcatagatcaaggcggacttataccaatgagaaaggaacttctcagttgacagagtttaattctagtgaccctggcattcatccatacattcacttatttgtcacacatttattgtatcagaaactgaagaggaattcagggatgtaagacttagtccctgtcttcaagtagctcgcgatcgagaatgggagaaagatatgcaagagtataattatcatgcaatgtggtgagcatgatgatggccacagtgagacagtgggtcctgggagtgagactcacatggaacatgagagtgagaatcagagaaggtggattgctagggagatgaaggtgagttttttaaaaaacctctcacagcctaaaagcacagcatggcaaagtcacagagttctgaaacagcctgaggttgttctgcagatagttcagggaagacatagaccgggggtggggagtgaggaagcatggtagaagaagggtgaccag

SEQ ID NO: 96939 - DNA, 229 bp, Homo sapiens
tacttgaaaagggtcaattttgtggtatgttaattatacctcaataaaaataaaagctataataaatgtttaatgtcttccaaataccatgttctcatacaggctgagttcccacccaggcagccccagatacctacagtttctgtggccagtgacccaccacagctatgtggtagcctgcggaacaggagaggcaaggtcatcctcattacggctgagtcacaaatgc

SEQ ID NO: 96940 - DNA, 325 bp, Homo sapiens
ttcctcaacccccatagtccgtcctatacaaaggagttctctgtggagtcatttaccttgcttatttggttggtaaattaccacctgttcctgttgatgagtttgcagagaaattcacagatgttgctgaaattttcagcctagccatgttggttttgaacagtgactggttttgctttttgtgaagaaaacacttgctcgaacagcatcctttgaaggagacactgtaaggtcaaaattcttttgctggctgcctcaagctactgagtgaaatcacatttcactgtatacttttgtcctcctttctaactgatagagacatgcc

SEQ ID NO: 96941 - DNA, 281 bp, Homo sapiens
attgatgtatagtgggtaataatgcccagatcatgaacagtgatgccttggcaacattatttgatgcttctccaaggtaaagcacctgtaactgaaaaagtttataatgtggagtgcgtaatatcaagggctttaaaaacaaaaacttatgctgtggatacctgctgtttatttcatgcttattgctgccatatgtgcggatgttttgtgtaagagcagtctgctgttgtgagctgtatgcagaggaatcattagtgaataccccccccattgaagcttat

SEQ ID NO: 96942 - DNA, 3870 bp, Homo sapiens
  misc_feature (2)..(2): n is a, c, g, or t
  misc_feature (64)..(64): n is a, c, g, or t
  misc_feature (264)..(264): n is a, c, g, or t
  misc_feature (454)..(454): n is a, c, g, or t
  misc_feature (548)..(548): n is a, c, g, or t
  misc_feature (573)..(573): n is a, c, g, or t
  misc_feature (1119)..(1119): n is a, c, g, or t
  misc_feature (2056)..(2056): n is a, c, g, or t
  misc_feature (2093)..(2093): n is a, c, g, or t
  misc_feature (2109)..(2109): n is a, c, g, or t
  misc_feature (2766)..(2766): n is a, c, g, or t
cngtttcctccaatggtaacatcttgccaaactataggacaatgtcagagctaggatattgacnttgatacagtgaagatacagaacagttctaacaccacaacggtctctcatgttggccttttatagccataccagcttcccttctccttaacccccataaccactgatttcttctccatttctataattttatcatttcacaatataaccatatagcatgtaacctgtgggtttggctttgttcactcagcagagttctgnggaaattgggcaggttgttgcagtcactggttcatcaggtttaagactaggatacatgaggcaaagggaaatcccagagacacacttctgtgtgtttcgttgggtccccagtctgcctttttccacctttcagagtcttctgtttttttccccatataatgtacagggttctgagttatacttagtgggngaaatagggtaaagtatgtctaattcatcttccctgaagctgaagtcagtgagattagtttcctaaagttgcaaatagccaaaagctttgctcnggtgaagtctaatgactgcaggttnaaaatttttggtttggataaattggtatttcttattcaaaattgctaagaccatatcccagctctggggttgtaatttggattttgagaaaagacagaattttaggaaaatgctgagtagaattaagaggaacaaatttctcatatggtgattattctttcattctgattatagaataacaagctgaagctatgaaaggtcatcttttccatcagatcacgaagaccaaggcttaaatcatcttaggcagagatttcaatttacaagttgtcttgggagaaaggaaaatattcaggcatacctctgagatattgtgggtttggttccagaccaccgcaagaaggcgaacatcataataaagcaagtgacgcaaattttttggtttcccagtgcatattaaagttatgtttacactatactgtaatatattaagtatgcaacagcattatgtataaaaatgtacataccttaatttaaaaatactttattgcttaaaaaaatactaacaattatatgagccttcagtgagttgtaatctttttgctngtggagggttttgtcttgatgttgatggctgctgactgaacaagctggtggttcttgaaggttggagtggctgtggcaatttctttgtgtgtgtgtgtgtgtgtttgtgtgtgtgtgtgtgtgtgtgtgtcttgctctgtctcccaggctggagtgcagtggtgtgatcttggctcactgctgcacctctgcctcctgacatcaagtgattctcttgcttcagcctcccaagcagctgggattacaggcaccagccaccacacccagctatttttttacatttttggtagagacacggtttcaccatgttggccaggctcgtctcgaactcctgatctcaagtgacccgcccacctcagccttccaaagtgctgggattacaggtgtgagccaccgcacccagccagcaattttttaaaataagataacaatgaagtttgtcacattgattcaactcttcctttcacaaaagattcctctgcagcatgcaacgctgtttggttgcgctttacccacagtagaacttttttcagaattggaatcagtcctctcagtccctgccactgctttatcaattaagctcatgtaatattctaaatcctttgttgtcatttcaaaaacgttaacagcacctttaccaggagtagtttccatctcgagaaaccattttcttcactcatccatatgaagcaattcctcatcagttcaagttttatcatgagatttcagcaattcattcacatcttcaggttccacatttagttatagttcttttgctgtttctatcacatctgcagttacttcttccactgaagtcttaaacccctcaaagtcatccataaggactggaatcaacttcttccaaactctcgttcatgttgataaaaatgtcaatacctcctcttctgaaccaaaatgtatttaatggcatcgaaantggtgaattctttccaggtggttttttgattggcttngctcagctctatcagnagaatcactacctatggcaactatagccttacagagtatatgtttaaaataaaaagacttgaaagccaaaattaccccatgggatgtaaaatggatattgtgttatcaggcatgaaaacaacctttattttccttgtgaatctttatcagagctcttgagtgactaggtgtgttgtcagggagcagtaattttattcatatatttttaaatttattttaagttctgggatacatgtgtataatgtgcagaattattacataggtaaacatatgccatgatggtttgctgcacctatcaacccatcacctaggtattaagcctggcatgcatttagctatttttcctgatgctctcccccacttcccccaagcagtaatatttttaaaggaattttttttcccctgagcagtagatctcaacagtgggcttaaaatattcagtaaaccatggtagaaacagatgtggtgtcatctaggctttgttggcgccacttacagagcacaggcaaaatagatttagcataattcttaagggccttggtatttttggaatggtcaatgagcattggtttcaacttaaagttagcagctgactttagctcctaaaaacagagtcaacctatcctttgaagatttgaagccaggcattgacttctntctagctttgtaagtcctagatggcatcttcttccaatataaagctgttttgtctacgttgtttgtttgttgattgattaattgtggcccaggctggtgttgagctcccggcctcaagtgatcctctcgcctaggcctcccaaagtgctgggattacaggagtgagccactggcccagctgaaaacctgctgtttcatgtaaccaccttcatcaattatcttagatctttccaattgacttgctgcaccttctacttcagcatattctgtttcactttgcacttttatgttatggagacaatgtctttccttaaacctcatgacccagcctctgctagttacagatttttcttctgcagcttcttcacctcatttagccttcatagaactgaagagagttagggccttgctctggattaggctgtggcctaaggaagtgtttgatctattttgaccactaaaactttctttacatcagcagtaaggctgtttcactttcttatcatttgtgcgtgaagaatcacctttaatttccttcaagaacttctcttttgcatttacaacttggctaattggtacaagagagctcacttttggcctatctcatttttggcatgcctttctctcaaagcttaatcgtttctagcttttgctttaaagtgtgagatctgtaactctttcagttgaacacttagaggctatcaaaaggttattaattggcctaatttcaatattgtgtcttagggaatgggaggcctgaagagagggagagagacagggaaatggcctgttgatggagcggttagaacaagtacaacatttattaattaagtttgctgtcttatatgggcatggtttgtggtgtccaaaactattacaatagtaatgtcaaagatcactgatcagatcatcataacagatatgatgataatgaaaaagtttgaaatattgtaagaattaccagaatgtgacgcagagacatgaagtgagcacatactattggaaaaatgtgctaatagacttgctcgctgcagggtttccacaaatcactttgtaaaaaatgtactatctgcagagcgcaataaagcaaaatgcagtaaaatg

SEQ ID NO: 96943 - DNA, 321 bp, Homo sapiens
ctcattgcttaagtatggatggcacatagtgacttccttcgaaagaatgtgcacagggaggaagtacagtgacatcacagtggagaagcccaggaaatccctcctccgccaggtgatcaaggtgaacgtcaacagtgatgaatcatgttgtttgtacataaccagagtataatgggatggaaatgtctcttcacttctgtggtcttcctcatacacacagacaaaatccgaaagccctgtccaaccatcagaaaacactagacaaatttcaatagagaggcattcgacaaagcacccagccagtgctcctcagagctgtca

SEQ ID NO: 96944 - DNA, 453 bp, Homo sapiens
ggaaacgcattcttggttgcagagagaggaagtggcttgcattgttggacaaaaagaaaaatgattgtttcctagggtcactgtcctcagcctccctttagagagcctggatcttgcagccatcagttatggaagtggctctgggaataactttgccctgggtgatgattgttgatgaaaagagtcgaagtgtataaaatatttgaagagatttattctgagccaaatatgagtgaccatggccagagacacagccctcaggaggtcctgagaacatttgcccatggtggtcaggacgcagcttggtttaaacattttagagaggtatgagacatcaatcaaatacatttaagaaatacattggggctggctgggcgcggtggctcatgcctataatcccagcactttgggaggctgaggtgggtggatcatgaggtcaggagattgagacca

SEQ ID NO: 96945 - DNA, 385 bp, Homo sapiens
ttctgtggaaggctgcagtttgggattggttctcaggtgtctttctaactgctttctaaggatgaagacggccgggcacggtggctcacgcctataatcccagcactttgggaggccaagacgggcggatcacgaggtcaggagatcgagaccagtctgggcaacaagagtgaaattctgtctcaaaaaataaacaaacaaaacaaaaccatatgatccagcaattccattttggggcaagaattcaaaaagatatttacacatccatgttcattacagcattattcaaaatatccaagaggtgaaaaccacaaaaacgtccatctaaaggtgagtacatgaagatgtggtataaacatacaaaggaatattatgcagccttttt

SEQ ID NO: 96946 - DNA, 260 bp, Homo sapiens
ggtgagaggaggctaagacattattcaccagttgcagaccccagaaaagagggattctggccactgtgttccaaagtggcccagttgtgaaagggaagacatttgggcctcagcctgccttaaaagtgggaatatccttgaacaatcagaaagcattgtatttttccaaaagctcttggcagcagcggtgctatctccagggtagcggctgccctcctctgaataatgagaaaattataattattatcaagaattattat

SEQ ID NO: 96947 - DNA, 176 bp, Homo sapiens
aattttaattattataggtcatttagaaaccatgcactataaagtatttagaaagaacttggtagtaatttttggaaaaaacattttctccaagcactgtttaaaacagctcaacttgggccaggtgaggtggccatgcctgtaatcccagcactttgggaggccaaggtaggcag

SEQ ID NO: 96948 - DNA, 456 bp, Homo sapiens
gacttataatgtctgggcttgagttgggtgattcaggggaggatccaggatgctgtcaggaagaaggggatgattctgtgcttggctatcttaataattctcacctaaaaggctaaaagaaccgtgtgaggctaaagccactgttggcagaaaagcagccatcactgacatcagccaggataggcgatgagggatcatttttttgtttcaatcttcttgctttggtctgagcagacaaaattgcaggcagagtggtcttattttggtcttgatctggtgccatcatgcatgctcttgtctgagttggtgtttgtgagatcgtccctgttcagtgggacacaaggccagccgtgagggccagccctgctctcttcccactcctctatgtacttatcagtcacgtaacacaacgtgctctctctatggtgtagaagcatggggtcatttacaggggca

SEQ ID NO: 96949 - DNA, 130 bp, Homo sapiens
agcctcccaagtagctgggattacaggcgcccaccaccaagcccagctaattttaacagaattctccattcttctgtgcttgggcaggggatagacaaagccaagataagccaaatcaaaggtcactctt

SEQ ID NO: 96950 - DNA, 863 bp, Homo sapiens
ctcctgctcccagcccagccaatcaccattctatgtcctgtctttatgaatttgactgctctagagacctcatataaatggaatcatgcagtatttgtccttttgtaatgggcttattccacttagtataatgccctccaggttcatccatgttgtagcatgtgctagaatttcctccctttttatggctgaatactattctactgtatgtatgtacctcattttctttatccattcatccacatgtggatgtctgggttgtttccatctttaggctattgtgaataatactgctgtgaacatgggtgtacaaatgcctcttcaagactgttttcagtttccttgagtctatagccagaagtggagttgctggatcatatggtaattccatgtttattttttttgaggaactgccattctgatttccacagcagctgttccattttacattcgcatcaacaatgcacatgggttccagtttctccacatccttctcaacactggctgttttctttctctttttcttctttttaaataacagccatcctcatgggtgtgaggtctaatcgtggtcactttagttattttatttttaaaaatgttttttgagacagggtctcactctgttgctcagcctggagtgcagtggcatgatctcagctcactgcaacttctgcctcctgggttcaagcgattctcctgcctcaacctcctgggtagctgggattacaggtgcctgccaccatgcccagctaatttttgtatttttagtagagacgggttttcaccatgttggccagggtggtctcaaactcctgacctcaggcgatccacccacctcggcctcccaaatacaggtgtga

SEQ ID NO: 96951 - DNA, 499 bp, Homo sapiens
  misc_feature (432)..(432): n is a, c, g, or t
atgcctatcctttcccctccaggtttaaagtcttcgcagattatgaagactacattaaatgccaggagaaagtcagcgccttgtacaagaacccaagagagtggacgcggatggtgatccggaacatagccacctctggcaagttctccagtgaccgcaccattgcccagtatgcccgggagatctggggtgtggagccttcccgccagcgcctgccagccccggatgaggccatctgagcctccagaccagaccccaaaccagcccttgagtctgtcacactctcttgggccagccccagcacctcatgcagagggtggggtactggagttagatctctaagcccctcctggaaccctcattttccccactctcaatgtcccagtgtccagcgtgactaaggacacgggcccccttccgtcctcgggctcncggtcccctcctatttatggggtctgaccaactgcacccactccctaataaattcattctccttggg

SEQ ID NO: 96952 - DNA, 611 bp, Homo sapiens
ccaaagatatccacagcccgccgcggagagaaaaaaagctcagagaaaacctttccccctgatgctttcctgaaagctcctgcaatcagctacaggtcagaatgttcatctccatcacgggattccctctgagacacacagaaaagagtatgcaagatagtctggttataggcttctgatgatattgcttaaataactttaagaccatacacttcgctcagtgaagatctccagaagtctgcttcagaaattgatgggttcatgacactgctaacccaagatgcaacaagactggaattgattacatggtactgaatgaactgatgaaaattgattataattttatagctttttggagcattgctggttctttaatgttctagtttctggacttaagaaatctctttctcttaacctaactgtaacatacaatttagtagattatacttttgaaaacagaagtgaagcatttatcttttttcccctgcctgatttttccagaattttgaaatccttactgaacactcttattttcacgatgatatagttgttagcaaaagtccaataagaatctgttcaccttgaacagagacctcagaaataatgccgca

SEQ ID NO: 96953 - DNA, 169 bp, Homo sapiens
tcacgcagtgtcatcttattcaagtccatttgagaagcggtgagcaaattggctaggcctttattgttgatgtcaaattctctttccttgctcaccctataggtccaggccagtttcctttcatcctcccaaagctattaacacgatagtgtgaatttgatgctgttga

SEQ ID NO: 96954 - DNA, 480 bp, Homo sapiens
aggtgatctagaggatccgtttggccctttccacagttctccagtggcttccactgtggcattctgcactgaaccccttccgtacctcttaccaagtctcagtctggctggtcatcaggaacctgtgtgccctgccctccaatgcacgcacacgaacatggccagccttgaagcacttgctgttcccttcctgcttccttcctcctctccctgtccatccaggaccatctcctcctaggtctctgagttctttgagatctcgcaactcttcttatgacaccacacagatgtcccacaccacaatttaatagctggttcctatgtcaggctatgtgtgggcctgcatgacacctgcttctgcacgaccatcacttggagcaccagctgtacacacacctgctgagcccatcctacatatagacactgatgttaatgagtttaggttggcaaacggagtaagtggattacaatagtgggttt

SEQ ID NO: 96955 - DNA, 125 bp, Homo sapiens
agacacaggccagtctgtgcaggcccttcaggttattgaagtagtttgaagatgccaataaatagcacccctttctccaaatggatctgttttttgtttgtttgttttgagacagagtctcgttc

SEQ ID NO: 96956 - DNA, 508 bp, Homo sapiens
tttgtacctatggagtagtttttctctgcaagtcataaactcccaagcccaacaggaagacaggatgtagccctgaaaggtcaactcagtcatccccctgcctctgggctaaaaccaggtcatgaattgaatgtgatccattctcaggatgtttctctagttcctgctcctgcccaacctaaatctctctttccaggactgagagaagccagctgtcatgctccaagggagatcagacacacactgccttgtgtgtttgtaaactggatggccctcctacttgacctagccttctctagcccctctccccttcatctcccctccacctctgagcacacattcagagacgtcaaaccaacagattcaagccatggtaacccaagaggtgaactggtggccaaataaaaccaagcagcgcacgccacactcaaagaaggaagatttttgtatcatccattttctggcagtgttcctgtcctggctcgttttagattcctttggatccctg

SEQ ID NO: 96957 - DNA, 899 bp, Homo sapiens
gtaaattctgggtttcagaaaaagttaggggtttgatttgtatggcatgaaagacatgtgacaaggagtattatggtgtagtgttaatatgatacattaaggccaggtcatgagattctcaagtgttaatttaaaaactttgggctttctttagtaggcaatggagggtgagtgaaggttgctgagtaggaaaatactaatagatatggctagcatattgattaattttcttcttacaatgatcagattaggaaggtgctattgttgtccttattgctcatataaggtaaccgagtttcaaagagtttaaattatttgcaaaggcttatacagccagcatgcagtaaagccaagatttatacatatgtaggctgactccagagcccattgatagttcctccttgaatttgggtcacttatgtggagagtccttgagcaatagtataaacataaagaaagcacttggttaagaagagtctgccacagggaaggtattggtgatagaaagcagactagtttcagtgtatggggacctgggttcttgtcttaactctgttcctctcaagctatgtgttcttagtaatacaaaatctctcagcaacatcctcatccataaaatactaaataaaaatatgtgctggaaattttttataaactacaaagtctacaacttgaaaaaatcaatggagaaaactttgcaaatgaaagattattagaagctatttcaatagtctaggtgtaaaacaaagtagaataatgacaatagaaatggtagaagggacaatgatcagagatgggaactgtatgacaggattaagagttttgtccagtggcaacagtaatgttataatattctttccccagcttagtacatctaataatacatttgactagattac

SEQ ID NO: 96958 - DNA, 173 bp, Homo sapiens
ttagcagacagtgatgtggagaatgggtacctcctgccagtgtctggacattgctttgtgtggtcgatactgcagaggctacaactctggactggtgactgaactctaaccagtgtggaatccactacggcttggaagttgtttactagcaattccacagctttagaagtaca

SEQ ID NO: 96959 - DNA, 141 bp, Homo sapiens
agccattgtgtttctgcttccttctgtgatgccttactctatggttgtttctgccctgtttggcttgggattcctgggttccttgcatgcatgctgtagcataggattgggtgttggtactagttacatacatgaggctag

SEQ ID NO: 96960 - DNA, 1369 bp, Homo sapiens
ggccacaaatcaacaacaacaacaacaacaaaaaacaaagcgcacacagagactgaggtcctctttggcattgagaagatggctatgcaagtcccaactagcaagtgcaaacttcccagcttcacttctgccagtgtcccttcaccccttctcaaccccactgggaggcaggagggtgcttgacaataacagccttggcatcactctgccagggtgtaataggaactgttacaattctgagattctgtgtaagcactggcctttctgcctagaatgccttctcctctcttttttaactgcatgctcctatttatctttcaaagcccggaaaaaataacactgcacacgggaaatgctcccttcctactgcagtcatttagatgactctatgccattccattcatttctctttcctaccacagaagtgctttgagattttggagtcagactgcttgaacttgaatcctggccctctcatcagagacttgacttattttaggcaagttatataaccaattttacctcagttccttacccataaaatgggtctaatgagagtacctaccacacagaattttgatgaaaactgaatgagatgaaggcctttaaggcagtggtccccaaccctggggacacagacaggtaccattttgtggcctgttaggaactgggccacacagcaggaggtaagcagtgggtgagtgagatcagcgttatttacagctgctccccattgctcaccttactgcctgagctccacctcctgtcagatcagcagtggcattaaattctcatagcagcacaaaccctgtcatgaactgcacatgcgagggatctaggttgtgcgctccttatgagaatctaatgcctaatgacctgtcaccgtctcccatcacccctagatgggagtgtctagttgcaggaaacaagctcagggcttccactgattctacattatggtgagttgtataattatttcattatataatacaatgtaataataatagaaacacagtgcacaacaaatgtaatgtgcttgaatcatccccaaaccatcccagtccacggtcttccacattttgtcttttcacaaaattgtcttccacaaaactggtccctggtgccaaaaaggcttgggaccactgctttaaagcctttgcatagtgcttagaattgagggggaaaaaaaaaacaaaaacaatgtagctagttgctacaatcactatattggtgagtttcaaaaggaaaagaattctgtcccatttatgcttgagccttgagttgctaaccaagcctgacacaaaattactgttgaagggatgtgtgagtcctaattgaaatgaggcctcttaagggaattgtggaccaa

SEQ ID NO: 96961 - DNA, 740 bp, Homo sapiens
agatgaagggggaaaacagatcacaaattttgttgcacaccgagtccctgctaaggcactagaatttcatgtcaacatgaaatcctggtctatgcttttatcagaaaattgagtgtgttagaaacttggaggtctacagactgtcatttttatcctttgaaaaaaggccaaactctcatccagcgagtccaggtgagcttatactaatttccctggatgtcattttaattgtttatttgtatgatttgtttattcaaagagacataattttaaaatatttttataggtctgaacacagagtggccattgaataaatacagactaattagacggccatttggagcacgattttctaccctttttttctcccaaatttcttatcaaaattaaaacctaatgaacaaatagaactttaaatacagaatgtgacaaactggaatgcaaaccctcacatctgtctctctcagattttatcaatttgcgatcttactctctccacgagtcacacagcaatcatcagataaaacagatggaccaggctttctggaataagaaaacatgcttttgtattgcctctaccgaatttgtctcagctgaactctatatcttcgttgtagttacttggaggaagggcaaaatcaagattagaagcacaaacagcttgttttcttcatatcttaagagaaagggagtatgagagaaggtaataggagagacagtaagtgggcagtaacttcctt

SEQ ID NO: 96962 - DNA, 103 bp, Homo sapiens
tgctgggattacaggcctgagccaccgcacccagcctgacagacctttatttttatgaactttagaaaaccaatagcataaatatgaaggactctgactcaca

SEQ ID NO: 96963 - DNA, 779 bp, Homo sapiens
acctctgtggtcttccttccaataacccgtaactcctttcctaccagcagaaaaacatcagacaaattccaaaagtagggcatcctacaaaaggcctgagagtactcctggaaacttgacatcaaggtcatcaaaacaaagtctaaggaagtcccatggccaagaagagcctaaggatccatgaaaactaaatgtaatatgatatcctgatgagatcttgcatcagaaaagggacagtaggtaaaaacgaaggaaatcaaaaagatgggctttagttaatactgtatcaatgttggttccttggttccttaattataacaaatgtatcatgctaacagaccatgctaataataggggaaacgatgtggcttctgtcagaactctgtacagcaccttcttttctttctttctttttctttttttttttttttttgagacagtcttgctctgttgcccaggctggagtgcagtggcagtgatcttggctcggtgaaacctccgcctcctgggtgcaggcgattctcctgccttagtttcccaagtagctgggattacaggcgcctgccaccacacccagctaatttttttttatttttttattttaagtagagacggggtttcaccatgttggccaggctggtctcgaactccagacctcaagtgatctgcctgcctcggcctcccaaagtgctgggattacaggcatgagcccccacgcccagtcagcactttcatttcactattctgtaaatctgaaactgctctaaaaaataaattta

SEQ ID NO: 96964 - DNA, 289 bp, Homo sapiens
cgtatgttccgcgtgtgtgcgcaaggtgtgggtccgggtgcacgggtgtgggtctgtgtgcacgtgggtgtgggtttgcgtgcatgtgggtgcgtgtacgtgtgtgggggtgtgtgcacgcgtgtgggtgtctgcgtgtgtgtggatgtgtgcgtgcgtgtggatgtgtgcatgtggctgtgtgtgtgcacgtgcgcccgtgtgtatgtgcacgtgggtatatgcctgtgcgggtatgggtgtgcacacgtgtgatatatacacatgcatatgtgtgtgtgcatgtctg

SEQ ID NO: 96965 - DNA, 802 bp, Homo sapiens
ttctcagtgttccacctactccctttccatctccttgctgggctaagaaaaggattctgatgaagaaatcaaagttcaggaatggtaaatgttctgatcaaggttgttctgctggagtggtggttgatctcaagcttcccgcaagcctgttgactacagcattgatcagttcgcctaagtttcctgactgtaaatatcatggctgattctaatatcatgcacaaagcctgtcattcagagagatggtgctacaaattgttttacagttttagttgtgttcaaatcaaccaagtataaatcagaatgtcatcaaggctatgagctccacctttctaaatctgggtattccacttccgagaagggttttgtgcctgagaggttgatatctgcaactgtctcaaggctctaacttttcataaacactattgcaaactagtttaggttgtacaagagaagactttcttttaaaaatcaaaagtataggttttgattcatctttgcaagatgggagaaaaaagcagaaataaagtctagcctcccagatgacctcaatattggaaatgacccatgcaagcactttcactgagaagtgaataaaactaggataaattgctgccagatttagtgtacaacaggtctgattttgttgcttcacaactttttttctcatcaaacagtagagtggacttcgacatggagaagatcctgtcaaaacttcactcacactccctaattcagaggggtgagggcaggtagtggggcaaagagccatgatacacaaagtgcaggccactgcccccca

SEQ ID NO: 96966 - DNA, 565 bp, Homo sapiens
tagacttctgtatccccacccgctacattacacttcaagaaatttaacttatatcaatcaaaatttgcttcttaatggatgtacatctcaaactcaatagcccaccctttacaaacactgtacaacccaatagtgaaagcaaaaaaagctatgtagttatttctttaaaaccttcagcagttaagaagaaggagacatatcaaagcatattttttccatctggctccagaactttagttcatgggcaaagtatatggtatttgtattggcaaaataagttgtgatttcaaagcatcatctagtagcactgtaacatagaccatggtgctaaatgaggcatgctagtgaatatcgttcttgtaatagtatcaattgtttcaatatgtaaaactctgtttaaagctatatgttgaatctctactctacttttgggtgtctggccatccaaaaactgaatcccacaagttactaatagacttgaactgagaactatctctgaaaatagatccaaaggcacactttgttccagatgtctcagggaaaaggtgacttctgctctcaaaaa

SEQ ID NO: 96967 - DNA, 293 bp, Homo sapiens
ccaccgcctcacccagctcatttttgtatttttggtagagacagggtttcgccatgttggccaggctggtctcgaactcctgacctcaggtgatctgcccacctcggcctccgaaaatgctgggactacaggcgtgagtcactgcacccggcctaccccacctcttaataccatcacagtgaccatcagcttcagcataggaattctggggacacattgtgaccacagcagctaccttctggctacagtgagtaatgctgctgtgaacatgggcgtacatcccacaatcccac

SEQ ID NO: 96968 - DNA, 224 bp, Homo sapiens
aaagcatgggccagagctttcttttattgtgtttttttgtgggaaggaatgaacgttttttttgtgggaaggaatgagcgagacagggtagacgagctgaacaaacttaggattggatagttcgaataatttggcagaccagagaggtggtctctagctgcctagtacctggctctgaggagatttagagtaagggaagcattggctgtgtgtggtggttgggg

SEQ ID NO: 96969 - DNA, 390 bp, Homo sapiens
tatgtgtgtatgtaaaatgaactgcatagaagggcagaaaatgtttaagtattagaagctaagactttggtatggaattatttaatggctaggcaaacttggaagttatttgacttttctgacctttcccatcccacttataaaacagaggtcaaaacagcacttaaacttcattaaactgctgtattaaaggagattaaatatgtgttatagtttagtataatgtctggcacatagtaaatgatcaataaatgtcatccttattgtaactcttacttcctgtttgcataagcaatctaactgaaacaaaacccttctaatctaattataaaactgagaacatccccatatttccaaactgatcagtactgaaagaaatagtttgcttct

SEQ ID NO: 96970 - DNA, 353 bp, Homo sapiens
gtgcagggaagggaaggagtgtcactttcattagcatttgggtgtcacctagcaaaatagccaggacctcaccacatcaccctgtggagaagcccaaccgccagcaggcctcaccaagcacacacagcttccaatcacacctaaaaatgaatggataagggccaggcatggtggctcacacctgtaatctcagcactttgggaggtggtcaggagttcaagaccagtgtggccagcatggtgaaaacccgtctctactaaaaatacaaaaattagcctggcgtggtggcacacacctgtaatcccagctacttgggaggctaagacacaagaatcgcttgagcctgggagagg

SEQ ID NO: 96971 - DNA, 154 bp, Homo sapiens
ctggtaagttacaggttgcctgattgtatggccaccccaactgccccggaggcctctgtaagtaggagaggtttccttttgtctgagaaatggtaggacggagcttttaggaaggtatagggtggggagcttcctgtgtccagccctatgattt

SEQ ID NO: 96972 - DNA, 169 bp, Homo sapiens
attctttaagggagcatcccttgactcagctgtcccacctaagatagttcccaagtactacagtgctgcaagaaaacattttctcagaaaccacagatactcttcaaatacgtaaagcattcaaatatgaatttcaaaactttctccttgatttattgatatggtttgg

SEQ ID NO: 96973 - DNA, 434 bp, Homo sapiens
tgctttgctctatggtgaacgtgccctcctatcgctctgggctctgcatggcgatcattcttattggctgcagaatactttctctggggagtggatggagctaacatttatatagcactaaccatgtcaggaccatagtctgagtcctttaacatctattaactgacttaatccccacaaaagctttctaaggctggtccgcttttagtcccattttacagaagaggaaactgaggcagagctaaatcaagtggtctggcccagaggcccacaactggctagcggtggagctggactttgaagcaggatcctgagcgtatcctctttacagtgatagggctgtaaccaaggtcttcttggggcttcggacctttggggcacctgaggttatttccttggaaaggcaacccttggcatgggcttttttttttttt

SEQ ID NO: 96974 - DNA, 308 bp, Homo sapiens
gtggctgactccctgctcaccctcccaactgcgtcagccatagggaactggggtggggtcccagcacccctgggcaggcagttccataggggattacctccagctgtctttcacagagagacagccaagctacagatcaatcaaccccattcataatcaaagaaaatgaatcaaaccagatgtcagtagtcacccatgaaattaatcaaggcataagacactagcactctgctccttggtggggatgcaatgagatgtgtgcccccttgatgggagagtaagttaatgataccgcctctccagaaagg

SEQ ID NO: 96975 - DNA, 527 bp, Homo sapiens
tagagacagggtctcactctatcacccaggctgcagtgtggtggcatgatcacagctcgctgcagtctcgacttcatggactcaagcaatcctccagcctcagccaccagaatagctaggactacaggtgtatatgccattctaggctaatttttttttttttttttttggtagaggctcactatgttgcccaggctggtctcaaacccctaggctcaagccctctgcccgctccggcctcctaaaatgctgggatcacaggcatcagccactcagcccggccacaattattttaaaatataaaggggaaagccttcccaggcaaattccaaaatctagaagtataaaagtctggccaatttgatcataaaattttaaatgtttctataacaaataaatacaaacatgtcagactgggagaaaacatttacagcatacataacaaaaatattaatattgaaaaagaataaagaactctaaaattcactgataaattattcccctcgccctcaaaataggacttggaa

SEQ ID NO: 96976 - DNA, 694 bp, Homo sapiens
agccgccatcttgctttacatcctgagggcttggctggtaactgcttggcaaggctttgtttagcaatcttgcctgaagtgatgagccctgaggttccatatgctagccctgtctcttgaagcaccccacccagcggctgggttttcttctgcctgtgtgtatactgtgtgtgatgtctacaaaaagagctctaattaatttggcctaaagaaagacaagtgcctggatcaaatatttttttaagggaaggtaaaagctgtggtacctttcagttcacatgactttaatctttaagaaataaaaacagccctaaaagggacaggattatttgacatgtttaggtgcctgggattgccaaagcaggtcagatgcaaggtttgctaagtgttttgaggttataaactgcgttttgggttttgagaaccatttgacttgctggcttcacaactggtaaggcctggggacatatggaactaaccatacccttaattaagaaggcaaccttggatgcacttagcactcaattaaagcaacttacaaagttttaccttaaagttaaaaattgctaggagttaattgaaactactggaagtaaatttacatgcaaggtgtgtaagaacagtaaaatgtgttttttagtaaaaggttataggaaggccttaaaatgtaaacttttgcttagggttaaaggat

SEQ ID NO: 96977 - DNA, 659 bp, Homo sapiens
attccctgtataattgatgccgaggagggtagatcgcaatccctgcacgtacttactgacgtggtggtccacagcttccacccagtttgtccccttcttcccctggacaaataatccaagagacagaggcagtcattagtgccatgatcgactttgaagttagacagaattggactccccattttaatgtttaaattaattttacatttaaaattaatttttagtattcaactagaacttagtagatgattcaattaggtaatgcattggaaaatgctttatagattctaaagttctctgtaagtagcaagtaatatgataattgcatggcatgaatgatcctgatcctcagtattaggacttttattattgttacaggataaagaaaaatacactgagaagccatgatttgggaggtctgagacaccattaattaatggaagattcagtttttcgctatccttccttggtataccttaaaatcatattcaaagaataagtattttgcccttactaaaatgcaaaatccaaagtgatcacatttacaaaaaatgctgatcagaatatagacaaaatgaccgataatatccaaaacaatattatccccaactgggaaagtttcttcagcgcttttgttctacattttgctgcactaaaaa

SEQ ID NO: 96978 - DNA, 678 bp, Homo sapiens
acaccgtggttgaaattgtataaacgaggaatagtaaattacaaaatcttggttgatgatacagaagtgcttacagaacatagtcactccaaagaccctttcactccacttatcaaagtaattttgtcctcagtttaatggcaggtgaaacaatattgaacaaagcagcctctgctgtatctgaagccctttagttagtgttcatagcagtaaatgctctagtaaagggacagcttctattccaatcccaggttttcaatcactttggttctttttttgagacagagtctcgctgtgttgcccaggctggagtgcagtggtgtgatctcagctcactgcaacctccacctcctgggttcaagtgattctcatgcctcagccacctgagtagctgggactacaggaacatgccaccacacctggctaatttttatgtatttttttttttgtagagacagggtatcaccattttggccagactggtctcgaacttctgacctcaggtgattcccctgccttggcctcccaaagtgctgggactacaggcatgaaccaccgcacccggcccactttggttcctaaagttttctttcaggtaaagtttttaatgcatagtttctgcccaaaggttttgtttgtgtggactgattattggataagagaggaagggactaccaa

SEQ ID NO: 96979 - DNA, 475 bp, Homo sapiens
aagggattgacatgtgaagtcaatagaacacaagagaacccagaaacagattcacagaaagatgctcaactaatgttttacaaaagtcaaaagcaattcaataaaataagtggtgctagaaaaattatacaattgcaggcgaaaatataaaccttgagctaagcctcatatctcataaaatgaaaaaatcaaaatagatcatgggtgtaaagagaaaacaaaaaatactataaaaaactggtaaatcggatttcatcaaaaataaaaacttttggcccgacacggtggctcacgcctgtaatcccagcactttgggaggccaagtaaggcggatcacgaggtcaggagatggagaccatcctggcaaacactgtgaaaccccgtctctactaaaaatacaaaaaaattagccggatgtggtggtgggcgcctgtagtcccagctactcgggaggctgaggcaggagaatggcatg

SEQ ID NO: 96980 - DNA, 472 bp, Homo sapiens
attttgtgtagagacagagtctcactattttgcccaggctggtcttgaactcctgggctcaagcaatcctcctgcctcggcttcccaaagtgggattacaggagtgtgccacaagacccaggctgttattttgtttgagacagggtctctctctgttgcctacgttgtagtgcagtggcacaaacaaggctcactgcagcctcaacctcctggactcaagtgatcctcccaccccagcctcccaaagtagccaggattataggtacatgataccacactcggctattttttttttaatttttatttttgtagagacaggggtctcgccctgttgcccaggctagaaactgagtttcaaacgtttaaaaagaccttgtgaaagtccccactgccagtaacatgttcaaggtggtttagaggtccatggggctgaccagcctgagcctactcaccttcaaagtctatgcagcac

SEQ ID NO: 96981 - DNA, 783 bp, Homo sapiens
gaaaggcacaacaagaaaagaaaattactgaccaacatttctcatgagcatagatagatgcaaaaatcctcaaaaagtttgaaagtcagatataataatgcatacaaggcattatatttcatgattaagtgggatttattccagatatgcaaggcagtttcaccatttaaaaatcagttatgtcatccattgcatcaacaggaaaaaggagaaaaatcatgtgattatatcaacagatgaagaaaaatcacttgacaaaatccaatacctattcaagttaaaaactgttagcaaactaagaatagaggggaacttccttaacttcataatgaacgttttcaaaaatcctatagctagcatcatacttaatgatcagaaagatcaggaacaagctgagattgtccactctgaatagcactgagcatttcaaaaaagattaattttgacttgtgttctcctttgtcaagatttaggaatgtaggttaaaaatgacttcggttgtccaggatctcacagggctgacctagcaattacacatgttaatagatacaaaataaaaatggttataagaatgcatgggcaggaaagtatcttcaagtggtgataaattggaaagtagactgtactattagggaatgttaactaataagtgtttctttttatagatgatgagtaaatttttatacaacttaaagcaatttctatcagagctactcactttcatttgtttcagaatacgtttttgctttcagatttttctaaataaaacacagtagctaagaa

SEQ ID NO: 96982 - DNA, 381 bp, Homo sapiens
acaatattgacttgggaggtggaggccaagattgtaccactgtattccagcccgggtgacagagcaagactgtgtctcaaaaaaaaaaaatcctggtgggcacgtggctcacacctgcaatcccagcactttggaaggtcgaggtgggcgggccatttgaagtcgggaggccgggagatcgggagctcgagaccagcctgaccaatatgatgaaaccccgtctctactaaaaatacataaattagctgggcatgttgtcatgcgcctgtaatcccagcactttgggaggctgaggtgggtggatcacctgaggttgagagttggagaccagtctgaccaacatggtgaaatcctgtctctactaaaaatacaaaaaattag

SEQ ID NO: 96983 - DNA, 89 bp, Homo sapiens
cgagattgagccagagtgatctcgcccaatgcagtgagccactgcactccatccagcctggacaacagagggagattccgtctcaagag

SEQ ID NO: 96984 - DNA, 646 bp, Homo sapiens
gggaactagtactgggaaccagaagggtatcagcaatcaagatgactatctgcttctttctctgcagtggttattatcagttcagtttgtttctatctactccatttctttgcatacctattatgtactcatcatctggcttacagcttgctgtaagtcaccttccagcccaatagagagaacctgattgattgatctagctcatttggtcgagcctgacttccaaaattagaggttgctggtcagccagggaaatgggcccttgagactggtgactaatcatttatggctagagaagcttataggatcttttgagggtttcacatgaggaaaccgtgctaaggcctgtgccaaagcaatatagaatgtcttggtagcacatgtaggaggctgtacctaatgattgcggtatcttaagatggtttaccagaagacttggaaatttgagccttgaagaagagtggaattagcattcaaaatgggagttagcgaggacatcgtaaccaaatggaacagcatatatgaagacccatatgtttgtgatgtgttgctggaaccacaggtatcatttttgggtgcatttccatgacgaggcaagaacagaatagtacctttaaggaaatttgatatgtggagtgacacaatg

SEQ ID NO: 96985 - DNA, 1278 bp, Homo sapiens
gtagagatggggtctctctgtgttgcccaggctgttgttgaacttctggactcaagcaatcttcccaccttggccttccaaactgttgggattacagtgcttatttaacacatgcttgaggtcctcaattgaactccttgaagacctgatgccaaaagccctgagaagagactatgaactatgatatagaggtgttaaccccaaggacaattcttcaacgagatgctatacagcaaactctgtctcagaatctgtttcccagaaaatccaaccagcaatttttatgcctatgcaatgaacaattctgggggaaaaatacccatcaagtattttgtattggatggcttttattttattttatttaggcaccggtgcaaaatttctggcactgtcaggttctttcaaagtgggtatttgttagttttgttatcagataaaaatattaaagcagtttttatttgggaaaataaaaatccagtggtttggttttagtctggtcaaaatagctacctcaaagtctgtatcaaaatggcagcatctgacccatctagcgtgcatccttcttaacgggaagaactgaaagccatcatgcagtgctgttccccaattcaaaacacaagttcgaatcatcttaggctcaaactgagaactggcattagtccagttaaattaatctgcaagttgctccgaagtggggaagcggggcaggatggcttacatcttaaatggacaagtgttggacagcagagtccatctccctggagtttatctttgataacagatttcttctgaagaatagccaagtttgtgattttgtttttcaaaactctacttcagcaacatgtgaagaaaagaagaggctatggaaacacatctgattccagatatgatcatggaagacagccaccaggaaaccctctggggaaaacaggtcaaatcaatcatctgcatctccccagtcctcccccaaaggctggtggatgaggaaggtaaatatctactctaagaaatagacaactggacatgcacattcacagtagagagaaaccaccaaggagcggagggctgaccatgctggacaagtagatgaatgcatacatctaaacaaggattgctctgggtcttcacagattaatgagatcatgctgggaattccctttgcagggaactggctaactggcatgcagttctataaatgcacatctgtctcattatcttttttaatatactttactgaagtattcatatagttctaataagtaaatatttttagcttgc

SEQ ID NO: 96986 - DNA, 290 bp, Homo sapiens
ctataggcacaatgatgttcagcatcactggggattattgaaaggttgaagtttttaggtttaccttcatagcccactcaaatgataggtcagtgtttcctaaacgattcttcagattactcatgaccccacaggtgggaccagaaggcctttgaaaagacccttggcaagtagggtctcgagtcagtcgactttgggaaatgcctgtcttgttgatgcatagtacattattagtgtatcaaagatgttgaaaagccttggggaaacctagtgtttctcaggcttacttg

SEQ ID NO: 96987 - DNA, 552 bp, Homo sapiens
agcctcccaagtagctgggactacaggtgcccatgccaccatgcccggctaatttttggtatctttagtagacacaggctttcaccatgttggccaggctggtctcaaacttctgacctcttgatccacccacctccgcttcccaaagtactgggactacaggcatgagccactgcacctggcccatatgaatggtacaattctatgttagagtaatgttagctgctgtaacaaagggaccaagaatgcagtggctcagtcgacaagataaaagtgtatctcttgcacacgtgacagtcctggtgagatgtgcaggtcagcaggcagcacttctcagactttcagggactcaggctgatgctggttctgccgtcttcaacatatgactttcaaagttgttgttctccagctcacaggaaggtgataggcagaggtgcagggccagatattttctctgtggaggctgcacacattgcttctgctcatactcccctgggtgagacctttctcctgagttgcagtggggcagtaggtgcaggggctgaacgattc

SEQ ID NO: 96988 - DNA, 308 bp, Homo sapiens
gcgtatgagtcattgacggtgaatacaggtctggaagtctgaggtccaatataataaaaaatctagtcttcaccttctatcctagggatagacattaggaatatttgaggatgttgttcttggtcttcacgttcatgcattttccctctatttttataattggatcaatgaatcaataagcaaatatattttaactgcataaagataaaaataggcgttgtccaattatggaaatatatggtgaaataagaaatactattcacatttattaaaaacactgaggtcttctttctattaacaaataaatg

SEQ ID NO: 96989 - DNA, 1264 bp, Homo sapiens
aggatgagcatgttatctttatatttggtttaaaaattttttttaagttaaatctgtgtttgcgtatttcttaagaaagcagaagtaaaataagcatgtttggaatttgaattaaatatatcagaatttttgtcagttcaaagtatgatccatggtgatataatacaattgtatgatataaatgtaatacaaactgaaataatatctcttcatgagatactatcgaagattgttagcctcataggaaaggactgtatgtattgtctagcattttatggtctccaaagactccaaaggaaaaccatgttggctgttatttttatctcttttccctcaaagccaaattagttatattatgttaaataaaacaggcaggattttataaaacataccaaaaacacttgatcatttgcaatgaaaaacatctagaaagtttatactcatagaaaatttaacctaatagaaaaatatctttgaatcatttgcccagggactagagcatattttccttaagaatttttattttgaaaaaatagaggaactattcatggaataggccttagaggcaggctgcttgggttcaaataaaatagccctgccactcactacctgtgaccttggcaaattacttaacctttctgagtcttaatttcttttcctgtaaagaaagctgaaatgttctaccttagaagtttgttgtaaggtacagaacaagcgcatagtattcaatgaatgttagctatatgtacatgtatgtgtatgtgcaatacattgtattacgtgggtttcattaatgtcaaaacagattagggctgagtagtattatttttgcttctcaagttctgcacatttatttttaaagcaagttgtagaatgtaatgtgacatatttgagcctgaagttggctgaccaaggactgtggataagtgtagcatagttattttttctatcaaaaacaataacaaaaagattgagtacttttaatatacatgttgtcaaaagacaaaattacaacaaatttaatcatagatctaattggcttttattcaagatgcatgaatcggatcagcctccattctacaaaatagaatgagaggtctcactgggcagtggcaaagcagtgggttttgtaaggtgagaactgtaacaggaaaaaatgctgattggttaacatcagattacttttcttttaagggttaaaacagtgagcatttccgtattacactgattcgggtagactggaatctcctattttcaaaaaaaa

SEQ ID NO: 96990 - DNA, 174 bp, Homo sapiens
ggacatattggaaaagatgacgaagtcccaaaagaacagaatcccatgtaatgtgacttgaacacagaaagagaaagagagaaagggagaaagagccagaagaactgctgccactgccccttcttccccctctcccagctgaaagctgggcttggaggcaaaggacagattctg

SEQ ID NO: 96991 - DNA, 300 bp, Homo sapiens
aaaggctctgagaagtcctgcggtaaaggaatcagtgtttcccaaatttctttaatcaaagatccttttttccagtaccgcagtggaaaaacctgagagaccctggagctcttcagaacacagggtgggagacaagtctggcagtggtgactctgggtggattttttttctgggacctcgggctggatggccctagattctggagatctggagggagcgggaaagagaggctgctacctgctccatctttgttatacctgacgcagggaggccccatccataccctcgtgtgaggctctg

SEQ ID NO: 96992 - DNA, 328 bp, Homo sapiens
gatatgtgtctacagataaatgttacaatgtttattaagagtaacagtatttaaagcaaagtaagaaagtgagaatatccatatcttttagaagaaataaagcggttaaaatgatttaaaacagactaaagacatggaaaatattttaatggtacataataataataatattaaaaatatatccatttttgtgaactcaccatttctgtgattgttaatatatctttagacacatacaaacatggaattagataacatctaaaatttcaaaaattttaaataaatttaaacataattaaccttaaaagtatattaaataagacaatgt

SEQ ID NO: 96993 - DNA, 248 bp, Homo sapiens
tctctgatgcagagaatttcatgatcgtcggctcaggtaaaccctgaccaaagagtgaaggctttgagctctataataattcaactcacagatgtcgtctcctgagagtcctcgagctgccttgggactaatatatgtgaaccaaagaaattgccttgtgatgactggatgagttctcctcttgtgctctctgtgggcaggtgggagcccctcaaggaatatgcccatccaactcctccccagaaggc

SEQ ID NO: 96994 - DNA, 254 bp, Homo sapiens
ccatatctcttagtgtctccagagctgcagtacaagttggggggatggactgtaaaagccagaaatcccaagccacaagcacgctgcaggtagcaaccccacacccagcaaaacaccgcttcttcctgcccactttcccctctgcgccaactgtacacaccataccctatgcttgtccatttgggaaactggcttccaggacagcatctttcctggaaagacagcaggaagctgatggtcactcctcaactctc

SEQ ID NO: 96995 - DNA, 350 bp, Homo sapiens
catttgaattttaaatacttttatgaaatatggttacaaagtaatatatcatgtgacaaaagaaacaacatgaaaagaaatataccactctccataattatttttgcataaaaatatcaatacctaagagtgtggtgcacgaggactgtaccaactgcctcagatcctgttactcaagaatcatctgtacactctctaattatatttttacattctcctgggtattataaatattcattttttttctttcctctgcctgcatttattgaaagatacacaggcacaagaagtctagcattcaaacattcaaaagatacaaactataaaattcagaattgttgcatattaca

SEQ ID NO: 96996 - DNA, 507 bp, Homo sapiens
catgaagtcccaagagaaattaagacaaacgttcaacaatgaaaatgaaaatagaaattacaaaattttgtgggaagaaaaaaaaacagtgcttagaaaaatttgtagcattgactctatatcttagaaaaaaaggacaactctgaaatcaataatctaaccttcctcagtgggagactagagaaatatgggcgatttaaacatgaagcaactggagaaaataaaattttaaaagtcaaagcagaaatcagtgaaattcatatcaggaatacaatagagaaaaacaatgaaacaaaagctgtttctttgaacagaccaataaaattgatataattatagccagctgaccaagaaaaaaaaggagcgaagacacaagttacccacatgagaaatgaaggagtagagtccactacaaatctcacgaacagtaacaggatagtaaaagaatcctataaacaactatacccagtgaatctatcactttgatgaaatgggctgctatgttga

SEQ ID NO: 96997 - DNA, 156 bp, Homo sapiens
cccaactccagaggcctgcccaactccagaggcctgtccaactccagaggcctgttgaaattaaaggaagagaataaaacatctctccctaacccataaactgtgttctattcacagttgaaggtaaccactaaaatatgttattactatacccca

SEQ ID NO: 96998 - DNA, 368 bp, Homo sapiens
ggaattcagacaaacatgtcatgtgataattatatagccttgggtaatacattattattttttagttttaaagtactttaaaaattggcagagtatttttagtatactaagatttgaacagtttaaccagtagtgtcgggatttgattacgctgataaagatatgcaagaaataaagtaataaaagacaaaatgtaggtttggaaaattcaaattgtagttttatccattaatcatatactttactttgtgcttgtcattgtgataattacataaagataaataaaataacacacctagccccttaaagtagtagttctttactttttaaaggtcaggggtcccttgagaatctgaaaaattgagaat

SEQ ID NO: 96999 - DNA, 979 bp, Homo sapiens
cttgtaaaaatatatttattgcaaaagttatatcagtcttgtatgtaagcaccagccttctccagggaaagacaggggtggtagaatgaataaaattaactcagtattttgactgcttgctgcaatggaagagggaattatgtttcccaagctgggtatgaagagaaggaatatagccttggaggcaatggaaactaagccagagcagcttagaaaagtcacccctcctcctgattcaagaccaaagacagggaaaaaaaagtcactctcagtgtgaacatgaaagcaagtctcacccagcctagatgttggatgtcctgtgcggtcccgttcctccctggtagagcttgttctgtctcactgggattgccatttggatttgatgaatttctgaatcacccgagggcctggcgacccgaaggagggcggggagtgggggcgctggggtggacccgccatcctgcggaatccgggccagataacagcccccgagctggggaaatcggcttgcggatgtgatgcgggaccgcgaggacacctgcgctcccttgcgtgtcgcactcgtgcagctcccggtggcgacggggtgatgtgggggcgagggtgagaggaagtccaggcgccagagcgtcagaaacgcttccttagcttccctggcactttggaggttgtctcgagggaacacggacagtgcacgacggactttcaagttgctcccggcacaacgggaggtcgggagctcggagcccctacgggcggtccaagtgtccgcgagaagcccgcagcgcccaggaccgcgttgagcgctcggggcgcgccaagccgcacctaagcaaaagagaaacgctgacgggccggaggcgggttggctgggacgcggaatacgcgcggccccggagcgcctttcgttttaaggagccttacttctggaaagggacagggaactgtcaatcagcgagggagggagcgcaccggcgct

SEQ ID NO: 97000 - DNA, 6994 bp, Homo sapiens
gcagcggccaaggcggcacaccggagcctccgaggcgaggggcaagtgggcgaagggaggggggacgacggctgctgccgcagcagctgaaggccaaggaattgaaagggctgtagggggaggcagtgcgagccagccccgactgctcctcctcttcctcctcctcctccaaactcgcgagccccagagctcagctcagccgccgggagcacccagagggacgggaggcagccgcgcagccccgagctgggcagtgtccccagccgccatggatagcgacgacgagatggtggaggaggcggtggaagggcacctggacgatgacggattaccgcacgggttctgcacagtcacctactcctccacagacagatttgaggggaactttgttcacggagaaaagaacggacgggggaagttcttcttctttgatggcagcaccctggaggggtattatgtggatgatgccttgcagggccagggagtttacacttacgaagatgggggagttctccagggcacgtatgtagacggagagctgaacggtccagcccaggaatatgacacagatgggagactgatcttcaaggggcagtataaagataacattcgtcatggagtgtgctggatatattacccagatggaggaagccttgtaggagaagtaaatgaagatggggagatgactggagagaagatagcctatgtgtaccctgatgagaggaccgcactttatgggaaatttattgatggagagatgatagaaggcaaactggctacccttatgtccactgaagaagggaggcctcactttgaactgatgcctggaaattcagtgtaccactttgataagtcgacttcatcttgcatttctaccaatgctcttcttccagatccttatgaatcagaaagggtttatgttgctgaatctcttatttccagtgctggagaaggacttttttcaaaggtagctgtgggacctaatactgttatgtctttttataatggagttcgaattacacaccaagaggttgacagcagggactgggcccttaatgggaacaccctctcccttgatgaagaaacggtcattgatgtgcctgagccctataaccacgtatccaagtactgtgcctccttgggacacaaggcaaatcactccttcactccaaactgcatctacgatatgtttgtccacccccgttttgggcccatcaaatgcatccgcaccctgagagcagtggaggccgatgaagagctcaccgttgcctatggctatgaccacagcccccccgggaagagtgggcctgaagcccctgagtggtaccaggtggagctgaaggccttccaggccacccagcaaaagtgaaaggcctggctttggggttcagagacctggaatagaaacttggatctatgcactacgtttatctgacaatgggacaaccagggactgctcatgctgtgacgtcacatcctctcaccatgcgttagcaacgactttctcgcatactaactaggtttgactgtattactcataccagatttaaaattagctagccttgcaacaacgtcctactgagaggtattgtcgagcatttgacataagacagcgtgatgttctttggtggttcaagtctaaatctgtaccacattcggagatgccaaatgattagactgaaacagggaaacggggtttttcagtcatttttagtcagtggtttttccatagtgcttttttcctatggccagtgcaaattgtgttagcacacttgcatatgtgccgtattaagggttgacaattactacatctttattctctaaatgtagtataatttgccttttaacctttgatctgtatcttgcaatagaatggctttggtttttttcttagtaaataggagcccacttctaaagtcatttcacccctcagccctattctctttcttagataccctttacaagagaaaacttccaaatggatttttgcatcaatagcagtgtgtaggtctctctggttctttctatatcatcattttattattatgtcctaatataaagtactggctcatagggccagggtattattatagaatattattctcgcatgtaaacaaagatatctttgctttaagatgtgagaagaaatgaatttactttgtttgcattaagttatggaagagttgtaatatatactttaagaaagaagagaagaaaactagtatctctaagcggtaactatggcaattttgcaatattttcagtagtgctagtaattttttcctccttgagtacacattaaatgtacataacatagcgcggtcaggcttgtggcacagtgcattgaattcaaaagtcaaacagcaaatttgaattctaacagaattcaaaaaaaaatttttttagtcagtactactaaggcagacacactgattactaggtacaaatcaaaccttgatgctaaaactcttcatcattgtaatttcaaagcacttacctgcttcaaaacattgtaaactaagactgaacacctgtatagtttaaaagcaacactatcaatagcatttcagccattttgccagccatgtgtaatcacaactgcagaaataaggagaaaacccctgtttttttagtttagctaattagatctgtaacatcactgggattgctctgaatgaatcctgagagttttgttttttataagcaccctcaccacatgccatagctttgtctcttttagacacctcgatgcagcggctggaaggactggagagcagctgttgtgctgatctgtagctgtcagctgtgattcctgtcacctgagtcagtttggtctggaaagcgaaggccttccaagctgtagcagatagtgagctccagctgatgagagaaggcttcagtggaagaagagtgaggacataggcagaaggaagtttgctatttcttgtcagttgcacattgctttatgaagactacaacaaaagtgcttaatcccaggctgctcatgactttcatttcaggtggcccttgggcacattgacagagttgcccttcccttctttgcaacaccaggcttcctagagcacccggttgcatgctttgcagctaggtggcagtggtttcagggagatccagttggatccctgcttgaaagcttaagccaatggttcacccatgagaggaagttgtcagtgcttccaggaagattgcccaccaaaggaactgaatagtttttagatttaaaggcaccaggatagggtcactcttactctgtagaaagagaccgttctatacactgtgacggatgggccagggcctctggacttgcattctgataggtgctttaatttaaatgtgcccaaagggagtgactgtcttcaggagaaagatggcttgcattaacctcgatcaagtgggttgtgcagccaggtcagggaatgcggtcagggagaggatagtgctggtcatgcccccgatgcagctatgctctgaatgatttcattcctgagagtgatagcattctggtcctggctgcagtggggtacaatttacgtcctaagtgggggctactctaattatcccattcaaatggaatttttttcaaaattggatagaaggaattgaagagttgtaagtagtgattagtctgctaatcagttcttcagatgagatattgaatggtaacactctgagcttaaaactcagcagtgtgtctgtgacctccacgcaaatcagaggaagcaatgcatccacgctgagcctcaccatgtcttcctcccaactctcttcatactctctgtgtcttccagctcttctttctctggccggctctctttcctcttctctctgcatatgtgagaacgcctgggcatcctgggtaacagcagccccagctgccctctcctgttccctgttccaagtcccctgcactgacctttcttgagtctctctggctctgtgcatgtctttgggactctgctcatctggcttttcctctgtgtgtgcctctctgtttgcttatgtctctggctctgtcttccccacccctcccctcacacacacacatactcccaaatgtaaggctctgtggcaggttggaatcggagtaaggcttgagattcactgagttctgtaggtagggaaagaagtcaagggagtggaggttctataaggaattaacagctgaggacggaagggtttgtttcccgtttgaacctaaacgcaagtggaaaagaatactcagaatgtatttttctactttacatctgctggggaaggaaatgtgtcaggaagccgctgcatctggtcatttcatcgcatcagaatcacagcagacgtggaagattccatgtggtggggaataaagaaataactttatgctctcctgaaaaacagcgggagcctatgtgtgtgtgcgacactgtaatctcaaggagattcactcagagctgtctcagtccaactcctgcatgaccagatcttcccttagcatcttttctgtgatgaaatattatcttgtgttagagttaggaataggaactaacctgtaggagcatgtccccaaatggacatttgaatggactaacaaaaacaactggaaagactgaatttccgacacaaaggaatgatgggatcaaaaagaaagcagtgaggagttcttgagtcttgtagtacctattcttattttaacttgcttcatccttgatctacctgagacactaagaaggaaattagttttccaagagctctttgaacctgtctaggactgtagttaaacctatttgccctatgggggttcttcacactcgaaaaactatttccttatcaccaacgacccacccagaaaggccaatgaggccaaatgtaacaatttttaacatttaaatataactattaaaattgcattaattgtgaacagtgaattaaagggttgtcttctccaggagacagtatgtggcacttttcgtaaatttcatttaatatataaaaatttaaatcactcactgcaacatgcatttaaaatcttccaagaaggtagaggtatcattttctgttttgctttgttttaaaacagttgcctcaagcttctgtcttaagagtagtgacttagaatccagatatcttttgttttagaaaaacaagcaaaactatgttgcaagactgacagttgtaatgtttatttgccacagatcaaaggttcacaaagtatatcaaatttacatctacttggggtaccttgatagattattattgtttttcttttatctttcccttcaggaatttggaaactcgttgtcactttttttaattttaaaaatactaaattgtaatagttttcttttgccaaatgtgtgcgtacatattcaaagcaatgaaactatttcaagccatacaaccacaggggtgggaacccttttcacaaattttaatgtgtttgtatgtaaatagatgtttgtatgaaatattttcatgatagaatgaatatatttaaatgaagttgaattattccagtgctacttaaacacattacaaaaattttggtgagaattatctgagtctattgagatgtaatgcagatcaattttgatttttaaaaatcaaaagcctacaataactctgactctcagcaacttcctcggcgttgttgcacctgacgtggagagagctcgtaggcttccccagtgcctcagccgcttcctggtggaagttaggtgctaatggaggtgtgttcaccttttagtgatatcactgcaggcctttgaggggcctgagagtgaatcagaggcattagagacaccggtgcagttatctggagcacaatttctttgcagggcagcagaatcagaagccagacttggccatgtgaacctcgaaactcggtttcccggccgccatcaaccgccacccttactgcctagtcacacacgtcagggaggctgccctcagtggagttggggttgagaccccagggtgggacttcacagttttgccagcaatctctaccttctgacttctgcctcgcagagaggaaggagaggggagcatctggcaaggggcccatttctcagcacagtacatttcctgtctcagctctggaagactatgcacccaagcaccaaacttccaaccagagagagagacgtcctccgataacaaaaatccttgcttcctctgtctgtgactttacacacagttgttcaaagttgttaaatgtcaagagtcaatcacatccctaggacatacctcccaactctcctgactcttatgttattgaaaaaacaaacaaacaaaaactcctttatgatgatattcaacttgagtggggttttttttccactttggtcctggatataatgaaatgatacatattaggataaattttcactgtgtatagtagcaatacgaacacacatgccaatgtatcaacatatctacttggttacattttggtttatgataattaaccttgattcatgtattgggaagctacagggactacgtaatacctgcttatcacataggaaaattatgtccatgattctgagctcccttcttcaaaagtttcctcctgggtgttctatgttctctctttatcctgaaatacatttattaggttgtgaggtatgttgaagaagtagaagccaggggtatgctttcagcatttattgcaaccaaaagttaaccccatcacggttaacgagcatctttggtctcttgtggaatttgaactaaaactatgagccttattcaatatctataattctatgatttttttaaattatgggaaattaatgaaagatgtttacatgaataatgtttgcccttactgtgttatgaatgagttttttgtagtgtgtctgggtgcatgatgcaagagagtaggaaaaatgtttctgaaacaaaacttgacaaatatttgtaatgaaagtaaatttaaagattgctataattgcgctatagaaacaatgcaagtattaaacaaaatatacaatca

SEQ ID NO: 97001 - DNA, 811 bp, Homo sapiens
tacattgtgtacatttacatctgtttaatcggctatttacagtcgccctttaccgccacctgtaagaggcagcgccataacgacactaagtggccgggccggaagccgggtgcccagtggttttctccacttgaggacgcctgaatctgtgaagtggttggcacttggagaaacagagagacagctggggacatcacacgtacagggcgggaggcgcgggaaagaggcgcgccagacggagggtccttccttcctcgttagctccactcggcggctccttttccattaccacagcagcaaggaggaacctgccgagccttcggtgcggcttgtttcctgcctgacagagagcccgctgccatttggatttgatgaatttctgaatcacccgagggcctggcgacccgaaggagggcggggagtgggggcgctggggtggacccgccatcctgcggaatccgggccagataacagcccccgagctggggaaatcggcttgcggatgtgatgcgggaccgcgaggacacctgcgctcccttgcgtgtcgcactcgtgcagggcgcaggccgagaatggggctccgccaggccgggggcgctggaaacgcacggccgctccatcccgcccggccacagcctgcatccaccctcggagttgcgaaacctgccccgcgctctggcctttccgcctttgggcgcggagggtgggtgcactccgcagggcagccccttgaggccggcggactccgcggagcaatcccctagcccagttttggccaccccgatcccctcccggccgccagcccttccct

SEQ ID NO: 97002 - DNA, 6836 bp, Homo sapiens
gaggctgaggtgggtagattgcctgaggtcagaagttcgagaccagcctggccaatatagtgaaacctcatctctactaaaaatacaaaaaaataagctgggcttggtggcaggtgcctgtaatcccagctactagggaggctgaggcaggacaattgcttgcacccgggaggcggaggttgcagtgagccaagatcgcaccattgcactccagtctggacaaaaagagtaaaactctgtctcaaaaaggacgggggaagttcttcttctttgatggcagcaccctggaggggtattatgtggatgatgccttgcagggccagggagtttacacttacgaagatgggggagttctccagggcacgtatgtagacggagagctgaacggtccagcccaggaatatgacacagatgggagactgatcttcaaggggcagtataaagataacattcgtcatggagtgtgctggatatattacccagatggaggaagccttgtaggagaagtaaatgaagatggggagatgactggagagaagatagcctatgtgtaccctgatgagaggaccgcactttatgggaaatttattgatggagagatgatagaaggcaaactggctacccttatgtccactgaagaagggaggcctcactttgaactgatgcctggaaattcagtgtaccactttgataagtcgacttcatcttgcatttctaccaatgctcttcttccagatccttatgaatcagaaagggtttatgttgctgaatctcttatttccagtgctggagaaggacttttttcaaaggtagctgtgggacctaatactgttatgtctttttataatggagttcgaattacacaccaagaggttgacagcagggactgggcccttaatgggaacaccctctcccttgatgaagaaacggtcattgatgtgcctgagccctataaccacgtatccaagtactgtgcctccttgggacacaaggcaaatcactccttcactccaaactgcatctacgatatgtttgtccacccccgttttgggcccatcaaatgcatccgcaccctgagagcagtggaggccgatgaagagctcaccgttgcctatggctatgaccacagcccccccgggaagagtgggcctgaagcccctgagtggtaccaggtggagctgaaggccttccaggccacccagcaaaagtgaaaggcctggctttggggttcagagacctggaatagaaacttggatctatgcactacgtttatctgacaatgggacaaccagggactgctcatgctgtgacgtcacatcctctcaccatgcgttagcaacgactttctcgcatactaactaggtttgactgtattactcataccagatttaaaattagctagccttgcaacaacgtcctactgagaggtattgtcgagcatttgacataagacagcgtgatgttctttggtggttcaagtctaaatctgtaccacattcggagatgccaaatgattagactgaaacagggaaacggggtttttcagtcatttttagtcagtggtttttccatagtgcttttttcctatggccagtgcaaattgtgttagcacacttgcatatgtgccgtattaagggttgacaattactacatctttattctctaaatgtagtataatttgccttttaacctttgatctgtatcttgcaatagaatggctttggtttttttcttagtaaataggagcccacttctaaagtcatttcacccctcagccctattctctttcttagataccctttacaagagaaaacttccaaatggatttttgcatcaatagcagtgtgtaggtctctctggttctttctatatcatcattttattattatgtcctaatataaagtactggctcatagggccagggtattattatagaatattattctcgcatgtaaacaaagatatctttgctttaagatgtgagaagaaatgaatttactttgtttgcattaagttatggaagagttgtaatatatactttaagaaagaagagaagaaaactagtatctctaagcggtaactatggcaattttgcaatattttcagtagtgctagtaattttttcctccttgagtacacattaaatgtacataacatagcgcggtcaggcttgtggcacagtgcattgaattcaaaagtcaaacagcaaatttgaattctaacagaattcaaaaaaaaatttttttagtcagtactactaaggcagacacactgattactaggtacaaatcaaaccttgatgctaaaactcttcatcattgtaatttcaaagcacttacctgcttcaaaacattgtaaactaagactgaacacctgtatagtttaaaagcaacactatcaatagcatttcagccattttgccagccatgtgtaatcacaactgcagaaataaggagaaaacccctgtttttttagtttagctaattagatctgtaacatcactgggattgctctgaatgaatcctgagagttttgttttttataagcaccctcaccacatgccatagctttgtctcttttagacacctcgatgcagcggctggaaggactggagagcagctgttgtgctgatctgtagctgtcagctgtgattcctgtcacctgagtcagtttggtctggaaagcgaaggccttccaagctgtagcagatagtgagctccagctgatgagagaaggcttcagtggaagaagagtgaggacataggcagaaggaagtttgctatttcttgtcagttgcacattgctttatgaagactacaacaaaagtgcttaatcccaggctgctcatgactttcatttcaggtggcccttgggcacattgacagagttgcccttcccttctttgcaacaccaggcttcctagagcacccggttgcatgctttgcagctaggtggcagtggtttcagggagatccagttggatccctgcttgaaagcttaagccaatggttcacccatgagaggaagttgtcagtgcttccaggaagattgcccaccaaaggaactgaatagtttttagatttaaaggcaccaggatagggtcactcttactctgtagaaagagaccgttctatacactgtgacggatgggccagggcctctggacttgcattctgataggtgctttaatttaaatgtgcccaaagggagtgactgtcttcaggagaaagatggcttgcattaacctcgatcaagtgggttgtgcagccaggtcagggaatgcggtcagggagaggatagtgctggtcatgcccccgatgcagctatgctctgaatgatttcattcctgagagtgatagcattctggtcctggctgcagtggggtacaatttacgtcctaagtgggggctactctaattatcccattcaaatggaatttttttcaaaattggatagaaggaattgaagagttgtaagtagtgattagtctgctaatcagttcttcagatgagatattgaatggtaacactctgagcttaaaactcagcagtgtgtctgtgacctccacgcaaatcagaggaagcaatgcatccacgctgagcctcaccatgtcttcctcccaactctcttcatactctctgtgtcttccagctcttctttctctggccggctctctttcctcttctctctgcatatgtgagaacgcctgggcatcctgggtaacagcagccccagctgccctctcctgttccctgttccaagtcccctgcactgacctttcttgagtctctctggctctgtgcatgtctttgggactctgctcatctggcttttcctctgtgtgtgcctctctgtttgcttatgtctctggctctgtcttccccacccctcccctcacacacacacatactcccaaatgtaaggctctgtggcaggttggaatcggagtaaggcttgagattcactgagttctgtaggtagggaaagaagtcaagggagtggaggttctataaggaattaacagctgaggacggaagggtttgtttcccgtttgaacctaaacgcaagtggaaaagaatactcagaatgtatttttctactttacatctgctggggaaggaaatgtgtcaggaagccgctgcatctggtcatttcatcgcatcagaatcacagcagacgtggaagattccatgtggtggggaataaagaaataactttatgctctcctgaaaaacagcgggagcctatgtgtgtgtgcgacactgtaatctcaaggagattcactcagagctgtctcagtccaactcctgcatgaccagatcttcccttagcatcttttctgtgatgaaatattatcttgtgttagagttaggaataggaactaacctgtaggagcatgtccccaaatggacatttgaatggactaacaaaaacaactggaaagactgaatttccgacacaaaggaatgatgggatcaaaaagaaagcagtgaggagttcttgagtcttgtagtacctattcttattttaacttgcttcatccttgatctacctgagacactaagaaggaaattagttttccaagagctctttgaacctgtctaggactgtagttaaacctatttgccctatgggggttcttcacactcgaaaaactatttccttatcaccaacgacccacccagaaaggccaatgaggccaaatgtaacaatttttaacatttaaatataactattaaaattgcattaattgtgaacagtgaattaaagggttgtcttctccaggagacagtatgtggcacttttcgtaaatttcatttaatatataaaaatttaaatcactcactgcaacatgcatttaaaatcttccaagaaggtagaggtatcattttctgttttgctttgttttaaaacagttgcctcaagcttctgtcttaagagtagtgacttagaatccagatatcttttgttttagaaaaacaagcaaaactatgttgcaagactgacagttgtaatgtttatttgccacagatcaaaggttcacaaagtatatcaaatttacatctacttggggtaccttgatagattattattgtttttcttttatctttcccttcaggaatttggaaactcgttgtcactttttttaattttaaaaatactaaattgtaatagttttcttttgccaaatgtgtgcgtacatattcaaagcaatgaaactatttcaagccatacaaccacaggggtgggaacccttttcacaaattttaatgtgtttgtatgtaaatagatgtttgtatgaaatattttcatgatagaatgaatatatttaaatgaagttgaattattccagtgctacttaaacacattacaaaaattttggtgagaattatctgagtctattgagatgtaatgcagatcaattttgatttttaaaaatcaaaagcctacaataactctgactctcagcaacttcctcggcgttgttgcacctgacgtggagagagctcgtaggcttccccagtgcctcagccgcttcctggtggaagttaggtgctaatggaggtgtgttcaccttttagtgatatcactgcaggcctttgaggggcctgagagtgaatcagaggcattagagacaccggtgcagttatctggagcacaatttctttgcagggcagcagaatcagaagccagacttggccatgtgaacctcgaaactcggtttcccggccgccatcaaccgccacccttactgcctagtcacacacgtcagggaggctgccctcagtggagttggggttgagaccccagggtgggacttcacagttttgccagcaatctctaccttctgacttctgcctcgcagagaggaaggagaggggagcatctggcaaggggcccatttctcagcacagtacatttcctgtctcagctctggaagactatgcacccaagcaccaaacttccaaccagagagagagacgtcctccgataacaaaaatccttgcttcctctgtctgtgactttacacacagttgttcaaagttgttaaatgtcaagagtcaatcacatccctaggacatacctcccaactctcctgactcttatgttattgaaaaaacaaacaaacaaaaactcctttatgatgatattcaacttgagtggggttttttttccactttggtcctggatataatgaaatgatacatattaggataaattttcactgtgtatagtagcaatacgaacacacatgccaatgtatcaacatatctacttggttacattttggtttatgataattaaccttgattcatgtattgggaagctacagggactacgtaatacctgcttatcacataggaaaattatgtccatgattctgagctcccttcttcaaaagtttcctcctgggtgttctatgttctctctttatcctgaaatacatttattaggttgtgaggtatgttgaagaagtagaagccaggggtatgctttcagcatttattgcaaccaaaagttaaccccatcacggttaacgagcatctttggtctcttgtggaatttgaactaaaactatgagccttattcaatatctataattctatgatttttttaaattatgggaaattaatgaaagatgtttacatgaataatgtttgcccttactgtgttatgaatgagttttttgtagtgtgtctgggtgcatgatgcaagagagtaggaaaaatgtttctgaaacaaaacttgacaaatatttgtaatgaaagtaaatttaaagattgctataattgcgctatagaaacaatgcaagtattaaacaaaatatacaatca

SEQ ID NO: 97003 - DNA, 3823 bp, Homo sapiens
tcgactcgtacccacaccacctgcttccaggaagattgcccaccaaaggaactgaatagtttttagatttaaaggcaccaggatagggtcactcttactctgtagaaagagaccgttctatacactgtgacggatgggccagggcctctggacttgcattctgataggtgctttaatttaaatgtgcccaaagggagtgactgtcttcaggagaaagatggcttgcattaacctcgatcaagtgggttgtgcagccaggtcagggaatgcggtcagggagaggatagtgctggtcatgcccccgatgcagctatgctctgaatgatttcattcctgagagtgatagcattctggtcctggctgcagtggggtacaatttacgtcctaagtgggggctactctaattatcccattcaaatggaatttttttcaaaattggatagaaggaattgaagagttgtaagtagtgattagtctgctaatcagttcttcagatgagatattgaatggtaacactctgagcttaaaactcagcagtgtgtctgtgacctccacgcaaatcagaggaagcaatgcatccacgctgagcctcaccatgtcttcctcccaactctcttcatactctctgtgtcttccagctcttctttctctggccggctctctttcctcttctctctgcatatgtgagaacgcctgggcatcctgggtaacagcagccccagctgccctctcctgttccctgttccaagtcccctgcactgacctttcttgagtctctctggctctgtgcatgtctttgggactctgctcatctggcttttcctctgtgtgtgcctctctgtttgcttatgtctctggctctgtcttccccacccctcccctcacacacacacatactcccaaatgtaaggctctgtggcaggttggaatcggagtaaggcttgagattcactgagttctgtaggtagggaaagaagtcaagggagtggaggttctataaggaattaacagctgaggacggaagggtttgtttcccgtttgaacctaaacgcaagtggaaaagaatactcagaatgtatttttctactttacatctgctggggaaggaaatgtgtcaggaagccgctgcatctggtcatttcatcgcatcagaatcacagcagacgtggaagattccatgtggtggggaataaagaaataactttatgctctcctgaaaaacagcgggagcctatgtgtgtgtgcgacactgtaatctcaaggagattcactcagagctgtctcagtccaactcctgcatgaccagatcttcccttagcatcttttctgtgatgaaatattatcttgtgttagagttaggaataggaactaacctgtaggagcatgtccccaaatggacatttgaatggactaacaaaaacaactggaaagactgaatttccgacacaaaggaatgatgggatcaaaaagaaagcagtgaggagttcttgagtcttgtagtacctattcttattttaacttgcttcatccttgatctacctgagacactaagaaggaaattagttttccaagagctctttgaacctgtctaggactgtagttaaacctatttgccctatgggggttcttcacactcgaaaaactatttccttatcaccaacgacccacccagaaaggccaatgaggccaaatgtaacaatttttaacatttaaatataactattaaaattgcattaattgtgaacagtgaattaaagggttgtcttctccaggagacagtatgtggcacttttcgtaaatttcatttaatatataaaaatttaaatcactcactgcaacatgcatttaaaatcttccaagaaggtagaggtatcattttctgttttgctttgttttaaaacagttgcctcaagcttctgtcttaagagtagtgacttagaatccagatatcttttgttttagaaaaacaagcaaaactatgttgcaagactgacagttgtaatgtttatttgccacagatcaaaggttcacaaagtatatcaaatttacatctacttggggtaccttgatagattattattgtttttcttttatctttcccttcaggaatttggaaactcgttgtcactttttttaattttaaaaatactaaattgtaatagttttcttttgccaaatgtgtgcgtacatattcaaagcaatgaaactatttcaagccatacaaccacaggggtgggaacccttttcacaaattttaatgtgtttgtatgtaaatagatgtttgtatgaaatattttcatgatagaatgaatatatttaaatgaagttgaattattccagtgctacttaaacacattacaaaaattttggtgagaattatctgagtctattgagatgtaatgcagatcaattttgatttttaaaaatcaaaagcctacaataactctgactctcagcaacttcctcggcgttgttgcacctgacgtggagagagctcgtaggcttccccagtgcctcagccgcttcctggtggaagttaggtgctaatggaggtgtgttcaccttttagtgatatcactgcaggcctttgaggggcctgagagtgaatcagaggcattagagacaccggtgcagttatctggagcacaatttctttgcagggcagcagaatcagaagccagacttggccatgtgaacctcgaaactcggtttcccggccgccatcaaccgccacccttactgcctagtcacacacgtcagggaggctgccctcagtggagttggggttgagaccccagggtgggacttcacagttttgccagcaatctctaccttctgacttctgcctcgcagagaggaaggagaggggagcatctggcaaggggcccatttctcagcacagtacatttcctgtctcagctctggaagactatgcacccaagcaccaaacttccaaccagagagagagacgtcctccgataacaaaaatccttgcttcctctgtctgtgactttacacacagttgttcaaagttgttaaatgtcaagagtcaatcacatccctaggacatacctcccaactctcctgactcttatgttattgaaaaaacaaacaaacaaaaactcctttatgatgatattcaacttgagtggggttttttttccactttggtcctggatataatgaaatgatacatattaggataaattttcactgtgtatagtagcaatacgaacacacatgccaatgtatcaacatatctacttggttacattttggtttatgataattaaccttgattcatgtattgggaagctacagggactacgtaatacctgcttatcacataggaaaattatgtccatgattctgagctcccttcttcaaaagtttcctcctgggtgttctatgttctctctttatcctgaaatacatttattaggttgtgaggtatgttgaagaagtagaagccaggggtatgctttcagcatttattgcaaccaaaagttaaccccatcacggttaacgagcatctttggtctcttgtggaatttgaactaaaactatgagccttattcaatatctataattctatgatttttttaaattatgggaaattaatgaaagatgtttacatgaataatgtttgcccttactgtgttatgaatgagttttttgtagtgtgtctgggtgcatgatgcaagagagtaggaaaaatgtttctgaaacaaaacttgacaaatatttgtaatgaaagtaaatttaaagattgctataattgcgctatagaaacaatgcaagtattaaacaaaatatacaatca

SEQ ID NO: 97004 - DNA, 1202 bp, Homo sapiens
  misc_feature (20)..(20): n is a, c, g, or t
ggtgactctagcaggatctntagggttgacttcggggcaggcagcagaatcagaagccagacttggccatgtgaacctcgaaactcggtttcccggccgccatcaaccgccacccttactgcctagtcacacacgtcagggaggctgccctcagtggagttggggttgagaccccagggtgggacttcacagttttgccagcaatctctaccttctgacttctgcctcgcagagaggaaggagaggggagcatctggcaaggggcccatttctcagcacagtacatttcctgtctcagctctggaagactatgcacccaagcaccaaacttccaaccagagagagagacgtcctccgataacaaaaatccttgcttcctctgtctgtgactttacacacagttgttcaaagttgttaaatgtcaagagtcaatcacatccctaggacatacctcccaactctcctgactcttatgttattgaaaaaacaaacaaacaaaaactcctttatgatgatattcaacttgagtggggttttttttccactttggtcctggatataatgaaatgatacatattaggataaattttcactgtgtatagtagcaatacgaacacacatgccaatgtatcaacatatctacttggttacattttggtttatgataattaaccttgattcatgtattgggaagctacagggactacgtaatacctgcttatcacataggaaaattatgtccatgattctgagctcccttcttcaaaagtttcctcctgggtgttctatgttctctctttatcctgaaatacatttattaggttgtgaggtatgttgaagaagtagaagccaggggtatgctttcagcatttattgcaaccaaaagttaaccccatcacggttaacgagcatctttggtctcttgtggaatttgaactaaaactatgagccttattcaatatctataattctatgatttttttaaattatgggaaattaatgaaagatgtttacatgaataatgtttgcccttactgtgttatgaatgagttttttgtagtgtgtctgggtgcatgatgcaagagagtaggaaaaatgtttctgaaacaaaacttgacaaatatttgtaatgaaagtaaatttaaagattgctataattgcgctatagaaacaatgcaagtattaaacaaaatatacaatca

SEQ ID NO: 97005 - DNA, 968 bp, Homo sapiens
tacattgtgtacatttacatctgtttaatcggctatttacagtcgccctttaccgccacctgtaagaggcagcgccataacgacactaagtggccgggccggaagccgggtgcccagtggttttctccacttgaggacgcctgaatctgtgaagtggttggcacttggagaaacagagagacagctggggacatcacacgtacagggcgggaggcgcgggaaagaggcgcgccagacggagggtccttccttcctcgttagctccactcggcggctccttttccattaccacagcagcaaggaggaacctgccgagccttcggtgcggcttgtttcctgcctgacagagagcccgctgccatttggatttgatgaatttctgaatcacccgagggcctggcgacccgaaggagggcggggagtgggggcgctggggtggacccgccatcctgcggaatccgggccagataacagcccccgagctggggaaatcggcttgcggatgtgatgcgggaccgcgaggacacctgcgctcccttgcgtgtcgcactcgtgcagctcccggtggcgacggggtgatgtgggggcgagggtgagaggaagtccaggcgccagagcgtcagaaacgcttccttagcttccctggcactttggaggttgtctcgagggaacacggacagtgcacgacggactttcaagttgctcccggcacaacgggaggtcgggagctcggagcccctacgggcggtccaagtgtccgcgagaagcccgcagcgcccaggaccgcgttgagcgctcggggcgcgccaagccgcacctaagcaaaagagaaacgctgacgggccggaggcgggttggctgggacgcggaatacgcgcggccccggagcgcctttcgttttaaggagccttacttctggaaagggacagggaactgtcaatcagcgagggagggagcgcaccggcgct

SEQ ID NO: 97006 - DNA, 410 bp, Homo sapiens
aactggctacccttatgtccactgaagaagggaggcctcactttgaactgatgcctggaagtaagttgaatctgcttcagatgggttgctccaattccaaagcaggttgttagggctgatttgagacaagcttcttttcttttcctctctgtatagttctctttaatcgtgtttattagtcaggttttattgcataacagacactgcacctccccagtggtttacaacagcaaccacagctctgccgagcagctgtactccagctggctgaggctgggcttagggggccaggccagacttgaggcttctggtcaggtttgagtcagctctctttgtcttaattctggggcctaatctgaagggacaatggcaatgtggggcaacattttcccacagtggatcacagaagt

SEQ ID NO: 97007 - DNA, 247 bp, Homo sapiens
caaaggtagctgtgggacctaatactgttatgtctttttataatggagttcgaattacacaccaagaggtgagtggggctgacagtggaaaatcaactttgttggttaaagggctttgcttcaaacaaaatccctttaccttagtactcactagaaagttaaagaagcagattggcttttttgtaaaaatgattggacattttcatcctctttattttaagccttaatacgattttttttaaaagtt

SEQ ID NO: 97008 - DNA, 1022 bp, Homo sapiens
gcagcggccaaggcggcacaccggagcctccgaggcgaggggcaagtgggcgaagggaggggggacgacggctgctgccgcagcagctgaaggccaaggaattgaaagggctgtagggggaggcagtgcgagccagccccgactgctcctcctcttcctcctcctcctccaaactcgcgagccccagagctcagctcagccgccgggagcacccagagggacgggaggcagccgcgcagccccgagctgggcagtgtccccagccgccatggatagcgacgacgagatggtggaggaggcggtggaaggttattaccccaagaaaaagccagtagaataactactgccttcattttcacccacctctgcaaaatcagctcaccagaatgattgggaagacaccaataagggcacctggacgatgacggattaccgcacgggttctgcacagtcacctactcctccacagacagatttgaggggaactttgttcacggagaaaagaacggacgggggaagttcttcttctttgatggcagcaccctggaggggtattatgtggatgatgccttgcagggccagggagtttacacttacgaagatgggggagttctccagggcacgtatgtagacggagagctgaacggtccagcccaggaatatgacacagatgggagactgatcttcaaggggcagtataaagataacattcgtcatggagtgtgctggatatattacccagtaagccgtgtgactgttcactctgctggaaagtaacatactgtgactcttcacaatgaagagtaaaatgtattctgtgttagaacttgggagctgtgaaacctgagagtcaccacagctgacaccaagagtttatgaggcatgccctctcactgttactcactattggcttagattgttggcccttgaatccgttattaattatttttcagcgttgttttggaaagggagtaattaatcatgattaaacaaattgagacaaattggttttattgtatcac

SEQ ID NO: 97009 - DNA, 512 bp, Homo sapiens
tacttctggaaagggacagggaactgtcaatcagcgagggagggagcgcaccggcgctgggtgatgtcagcggatcagctgctcgataacaaagagagggtattacaggagaaagttgcagcagcggcagcggccaaggcggcacaccggagcctccgaggcgaggggcaagtgggcgaagggaggggggacgacggctgctgccgcagcagctgaaggccaaggaattgaaagggctgtagggggaggcagtgcgagccagccccgactgctcctcctcttcctcctcctcctccaaactcgcgagccccagagctcagctcagccgccgggagcacccagagggacgggaggcagccgcgcagccccgagctgggcagtgtccccagccgccatggatagcgacgacgagatggtggaggaggcggtggaaggtacaagcatttctccggggccgggggaggaggcgcagagggcctggagcgcggaaggagtggcgggctgcgaacagc

SEQ ID NO: 97010 - DNA, 2431 bp, Homo sapiens
gcggccgccccgtcccgccgccgccgcagcccgcctgccgcgcgcccacagcccggcccgagtcgcggggcccgagcgacagcgacggcgccggccggggccgcggcgcgcggaagccactttgcacggtcagcgccgggcacaagtttgttccgcggctcccgggggcctgggcgctgagggagaatcgcgctgagggggccaggaggagggggagagggaggcgccgaagggcacaagagtggggaaaagtgcggaaagaagcaacagccgctccacccgggaccagaaaagtggccagtgcgtcccggccgcccgccctgcgccggggatgcggcggcgtcggcgccggctaacggtccagggaggcggcaggggcggcgggagccgctaggcggagagagaccagggacgcctggtttccccccaagcgaaccgggatgggaagtgacttcaatgagattgaacttcagctggattgaaagagaggctagaagttccgcttgccagcagcctccttagtagagcggaatgagtaatacccacacggtgcttgtctcacttccccatccgcacccggccctcacctgctgtcacctcggcctcccacacccggtccgcgctccccgccctcttcctcgcgtagaaccgtgggatcctaggtggcaggactcagagctaaggtatccacaggccatgaattccttcctaaatgagcggtcatcgccgtgcaggaccttaaggcaagaagcatcggctgacagatgtgatctctgaacctgatagattgctgattttatcttattttatccttgacttggtacaagttttgggatttctgaaaagaccatacagataaccacaaatatcaagaaagtcgtcttcagtattaagtagaatttagatttaggtttccttcctgcttcccacctccttcgaataaggaaacgtctttgggaccaactttatggaataaataagctgagctgtatttcaagtaatatagttataaattaacaatgtagcagttattgatagagaaattgagaaaactgaaacgtgaccggagtattggaaataacgtagtacatcacctagcacaatgacacatagtaggtgctcaataaatttatgcttataatttttgtcacttctatggcaggatttttttattaggttaaaattatcttttaaacaccttccggaattttagaatattcattaataatgtcttcaaacctttcaactgaaataaatttacagctgaagtctgatgatttaaagttagaaagtttaatcttgaatataaatgaacattttctctcccacattttcttgggcattttgagaagtaaatgcgttatttattggtccatgaaatgtgactgtaaatattctttgctatacattatgtctatatatctgcattcatcctcaatgccaaaactagaatcattagtcttaatgatcattttaagtacaggcagtcctcgctttccttgataccatgttaaccgaaacttgtgtatgtcaacacggtgtccttgctttgcttggttaagtgtgagttcttcctccctttttttaagagttgtacaatgtttttcagtcgcctaccgaatcaggtcatagactatggaattgaccccaccccaccaacatttttacagctaccctgatttctgaccagaaaggaaaaaaaaactttccagctctatcacacattttacctactcttaaacttaggaggtattacaaatagcattttctcatgttctctttctggcctgtacctccctgctaagcttccttcagtgttcatcctcacctcatagagagatgaagtgaagagacaaacagaagtcattttcttccttactttagtggtttctggtttagttagtttgggccaaactgtggacaagtaccttttcaggtaacttttttttcttatttctatgtcctcaacacctagtggagtacgtagccaatagtagatgcttaataaacatttcttaaattaatattgttgaccttttctgaccctgttcttgacagtaaggtacataatctgccttcatccctttagtccttaggaacagataaagtcatggatatgaaagtgatcactgtcattaatatccacattaaaattgctcttgattttagtttctccataatcattttccctaaacaatgaactctgttcacctttttttttaaaatatgcacagtgaatattactggtagcccaaatcttctaacataaaatttccattttgtaaaagcttctgataagcatatatgttatgaattgaatgtttgattattatactttaatattcttgaaaatattgatacctggactggaaagaaaacagacaaaagtaaatctcagaataaattactgctttaaacatgaaaaaaaaaa

SEQ ID NO: 97011 - DNA, 2200 bp, Homo sapiens
ctacggccggaaccttgttgctagggaccgggcggtttgcggcaaccgtgggcactgctgaatttgaattgaggggcgagggaaaagttttcctcaggtgtggtggggagagggaggcggatgccgggaaaccgtagggacgcggtcagaaaggcgacgggctgtcggagttggaaagggacgcctggtttccccccaagcgaaccgggatgggaagtgacttcaatgagattgaacttcagctggattgaaagagaggctagaagttccgcttgccagcagcctccttagtagagcggaatgagtaatacccacacggtgcttgtctcacttccccatccgcacccggccctcacctgctgtcacctcggcctcccacacccggtccgcgctccccgccctcttcctcgcgtagaaccgtgggatcctaggtggcaggactcagagctaaggtatccacaggccatgaattccttcctaaatgagcggtcatcgccgtgcaggaccttaaggcaagaagcatcggctgacagatgtgatctctgaacctgatagattgctgattttatcttattttatccttgacttggtacaagttttgggatttctgaaaagaccatacagataaccacaaatatcaagaaagtcgtcttcagtattaagtagaatttagatttaggtttccttcctgcttcccacctccttcgaataaggaaacgtctttgggaccaactttatggaataaataagctgagctgtatttcaagtaatatagttataaattaacaatgtagcagttattgatagagaaattgagaaaactgaaacgtgaccggagtattggaaataacgtagtacatcacctagcacaatgacacatagtaggtgctcaataaatttatgcttataatttttgtcacttctatggcaggatttttttattaggttaaaattatcttttaaacaccttccggaattttagaatattcattaataatgtcttcaaacctttcaactgaaataaatttacagctgaagtctgatgatttaaagttagaaagtttaatcttgaatataaatgaacattttctctcccacattttcttgggcattttgagaagtaaatgcgttatttattggtccatgaaatgtgactgtaaatattctttgctatacattatgtctatatatctgcattcatcctcaatgccaaaactagaatcattagtcttaatgatcattttaagtacaggcagtcctcgctttccttgataccatgttaaccgaaacttgtgtatgtcaacacggtgtccttgctttgcttggttaagtgtgagttcttcctccctttttttaagagttgtacaatgtttttcagtcgcctaccgaatcaggtcatagactatggaattgaccccaccccaccaacatttttacagctaccctgatttctgaccagaaaggaaaaaaaaactttccagctctatcacacattttacctactcttaaacttaggaggtattacaaatagcattttctcatgttctctttctggcctgtacctccctgctaagcttccttcagtgttcatcctcacctcatagagagatgaagtgaagagacaaacagaagtcattttcttccttactttagtggtttctggtttagttagtttgggccaaactgtggacaagtaccttttcaggtaacttttttttcttatttctatgtcctcaacacctagtggagtacgtagccaatagtagatgcttaataaacatttcttaaattaatattgttgaccttttctgaccctgttcttgacagtaaggtacataatctgccttcatccctttagtccttaggaacagataaagtcatggatatgaaagtgatcactgtcattaatatccacattaaaattgctcttgattttagtttctccataatcattttccctaaacaatgaactctgttcacctttttttttaaaatatgcacagtgaatattactggtagcccaaatcttctaacataaaatttccattttgtaaaagcttctgataagcatatatgttatgaattgaatgtttgattattatactttaatattcttgaaaatattgatacctggactggaaagaaaacagacaaaagtaaatctcagaataaattactgctttaaacatgaaaaaaaaaa

SEQ ID NO: 97012 - DNA, 2555 bp, Homo sapiens
ctacggccggaaccttgttgctagggaccgggcggtttgcggcaaccgtgggcactgctgaatttgaattgaggggcgagggaaaagttttcctcaggtgtggtggggagagggaggcggatgccgggaaaccgtagggacgcggtcagaaaggcgacgggctgtcggagttggaaaggtaaagttggaggctcggcggcgtcctgcctccgcgctggccacacccgccgcggctgcccggggcagggagggatctggctgattctccctgtaccctgtgccctcggagctgcccctccgagcgcccagaggtccccgcctgcctgcttcctggaggcagggctaccatcagtcccacgcctcgcgtgtccgccccccgcaccccggggccaaggaaagggatcgcggtctggactccccggggagttcccttgatgaggggaagggcaggtttggggacggcgaggacacgcggcgaccggagagaggctacctgacccgcgcagcccggactcccttcccttcccttccagggacgcctggtttccccccaagcgaaccgggatgggaagtgacttcaatgagattgaacttcagctggattgaaagagaggctagaagttccgcttgccagcagcctccttagtagagcggaatgagtaatacccacacggtgcttgtctcacttccccatccgcacccggccctcacctgctgtcacctcggcctcccacacccggtccgcgctccccgccctcttcctcgcgtagaaccgtgggatcctaggtggcaggactcagagctaaggtatccacaggccatgaattccttcctaaatgagcggtcatcgccgtgcaggaccttaaggcaagaagcatcggctgacagatgtgatctctgaacctgatagattgctgattttatcttattttatccttgacttggtacaagttttgggatttctgaaaagaccatacagataaccacaaatatcaagaaagtcgtcttcagtattaagtagaatttagatttaggtttccttcctgcttcccacctccttcgaataaggaaacgtctttgggaccaactttatggaataaataagctgagctgtatttcaagtaatatagttataaattaacaatgtagcagttattgatagagaaattgagaaaactgaaacgtgaccggagtattggaaataacgtagtacatcacctagcacaatgacacatagtaggtgctcaataaatttatgcttataatttttgtcacttctatggcaggatttttttattaggttaaaattatcttttaaacaccttccggaattttagaatattcattaataatgtcttcaaacctttcaactgaaataaatttacagctgaagtctgatgatttaaagttagaaagtttaatcttgaatataaatgaacattttctctcccacattttcttgggcattttgagaagtaaatgcgttatttattggtccatgaaatgtgactgtaaatattctttgctatacattatgtctatatatctgcattcatcctcaatgccaaaactagaatcattagtcttaatgatcattttaagtacaggcagtcctcgctttccttgataccatgttaaccgaaacttgtgtatgtcaacacggtgtccttgctttgcttggttaagtgtgagttcttcctccctttttttaagagttgtacaatgtttttcagtcgcctaccgaatcaggtcatagactatggaattgaccccaccccaccaacatttttacagctaccctgatttctgaccagaaaggaaaaaaaaactttccagctctatcacacattttacctactcttaaacttaggaggtattacaaatagcattttctcatgttctctttctggcctgtacctccctgctaagcttccttcagtgttcatcctcacctcatagagagatgaagtgaagagacaaacagaagtcattttcttccttactttagtggtttctggtttagttagtttgggccaaactgtggacaagtaccttttcaggtaacttttttttcttatttctatgtcctcaacacctagtggagtacgtagccaatagtagatgcttaataaacatttcttaaattaatattgttgaccttttctgaccctgttcttgacagtaaggtacataatctgccttcatccctttagtccttaggaacagataaagtcatggatatgaaagtgatcactgtcattaatatccacattaaaattgctcttgattttagtttctccataatcattttccctaaacaatgaactctgttcacctttttttttaaaatatgcacagtgaatattactggtagcccaaatcttctaacataaaatttccattttgtaaaagcttctgataagcatatatgttatgaattgaatgtttgattattatactttaatattcttgaaaatattgatacctggactggaaagaaaacagacaaaagtaaatctcagaataaattactgctttaaacatgaaaaaaaaaa

SEQ ID NO: 97013 - DNA, 346 bp, Homo sapiens
gcaatgcattgtgttctgcaccttaccttagagatcttttccacattcaaatggcctgagtattcttctttgaagcttatgtataatgttgcattatataagttactataatttatttaaccagtgttctgttgatgggcatttaggttattccccatcttttgcttttacaaacattctgcaatgaataatcttgcatatgtcttttggagcatgttcaaatgtaggtgaatgacatattactagatgtacaatctctggatcaaaggattacatttgtagtttagatgcaatcaccaagttgccctccatggtgcctgtaacaatgtacacattgtgttatcaa

SEQ ID NO: 97014 - DNA, 248 bp, Homo sapiens
tctttgttcagtcgcatgagtggatttgaaacattggcatcctttgaaactgtatctaaagcatctctttaagacatgtgtcctaatatttttacttctagaactctgcaaagctctataaaatcactctgtcaagtgctggatgaaaggaaaaataaacatccatcaccagccagtaactgcttacctggaacaaacactcctgtcatatgcccctgagactcctgaaatacctttgagatgtgtca

SEQ ID NO: 97015 - DNA, 530 bp, Homo sapiens
agatataattcaagaaaattttcctaaaataaataagagtccaatccaatttgtgaaacacaatgatatatactagggagaaaagatcaatactgaggtggagcctgataaagataataaacttgaaagataaagaaggaatcctttaaaacaaaaagcaaaaagatcaagtatggcatcagatttctttatatgaaattaaacttgagaggacaatcgagcagcacttacaagatcctcccaaaaagaaagaccaagccaagattttacttccaaccaaactgttattcaagtataaacagataaacagttttgaacatgcgagagctcagggactattgtttccacaagttgttgagcaaaattctagatgatgaacttcagtcatttagataattggggaaagggaggcaaaacaattggcagtgaacactgaacatctttatctagagaatgaatgctttaaaagacaaagaaggcagcccagcgcgatggctcacgcctgtaatcacagcactttgggaggccca

SEQ ID NO: 97016 - DNA, 275 bp, Homo sapiens
atgggagtttaagatttcacaggtggaactgtgctgagcaaggtcataaagaatgaaaagagttctccacacagatgctaaaatcagtcaagaaaagggactgtggtgagccagggccaaagtcctcagtgactgggggaaaatgagctggaggttagtagatggcaacacctgcatgtgaaatgatgtaacctggaagcagtggtgagaagtgagactacagacactggatccttgactgtgaaaatggagatgagggaaaatatgtactatcc

SEQ ID NO: 97017 - DNA, 311 bp, Homo sapiens
gagtagctgggactacaggcgcctgccaacacgcccggctaattttttgtatttttagtagagacggggtttcaccgtgttagccgggatggtcttggtctcctgacctcgtgatcctcccgcctcggcctcccaaagtgctgggattataggcgtgagccaccgtgcccggccaattgctgttgttgttaataaacaatctttattttagagtaggtgtaggttccaaagttgagcagaaaggacggggagttcccatatactatttgccccaccccaacatataaccttccctattatcaatatcccat

SEQ ID NO: 97018 - DNA, 924 bp, Homo sapiens
ggcactatctcggctcactgcaatctcttcctccctggttgtatttttagtagagacagtgtttcgccatgttggccaggctggtctcgaactccggacctcaggcgatccacctgcctcggcgtcccaaagtgctgggattacaggcatgagccaccgtgcccggcctattattattaagtcttagcttttgactacatgtctttttaatttttaagaatttgtgattaaataaacatggataaagcatttatgctgcctagggaggtgtgattgttgtcatgaaggaaaagcatttgtgagattgggttgtgaatgaatggcttatttcatggagtagcatttttacttgaaagaacgactagcagactatggtttttcacacttagtatttggcagatatttcttgaaaatgaagtgagcttgtcacttttaggaaaacaactgacagtatttattaccagtgataaaatttgggtgaaaattagaatttttaaaaagttgacagctggagtttgacagcttcctagtacttaaaagactttccttatgatatcagtggttaaggactgcaatattttaaaatgttgtttaatgaaatatgttatttggaagatgggcataactcagtaaatctaggctttgcaaatgaccaatgcatgatgttgcaaaatcaagcaaaggcaaaagatcctttgaaaattccagatatagcaatggattttaacagtaaaaaagtggattgatgtggtttcagattccaaaatgttaactgtcctttaagaaactactatttggcctagcgtggtggctcactcctgtaatcccagcactttgggaggccaaggtggaaggattgtgtgagcccaggagttggagttgagcctggtcagcatggtgagaccctgtctctatttattaaaa

SEQ ID NO: 97019 - DNA, 568 bp, Homo sapiens
atggggtggctttgagatggtgtgtcccttggtttaaagaagtcacaaccgctgtcatcgccgactaggtgtctccaagacactctttttccaagttctggcaattgcttttttccctcacctcattaggcttagagctagtgacagctctcctgttactagctctggggtacagcactatctcagatggtttcctattctctgtacactctttgtaaattgattatttcctgaacctgtatcaaattattccaggttgactttatcatctgtttccttttagaaccctgaatgatatttgtaataatacaatataaagcctggatgaatgcatcataattgactcaatttttttcctattagtgttatttataattatttattagtttaatgctatagcaaaccttttgccaatggctcattctctcctcttctgtttcttccttttcctaacatttaaaaaaatttttgcggctgggtacggtggctcacacctgtaaccccagcactgtgggacaccaagacggatcacgtgaggtcaggagttcgagaccagtctggccaacat

SEQ ID NO: 97020 - DNA, 315 bp, Homo sapiens
attaaatcgccatccctataccccttaagtaattacgccccctttctcccttccctcattgtctaatctactttctgtctctggatttgcctcttctggatatatcatatagaataagtcatataacatgtgactttatatgtctgcttctttaacttagcctgatgttactgagcttcatatattagtacttcatttctttctgtggctgaatagtatttcattgtatgtatatactgcagtttattcatttgtcgatggacacttgagtttctgccttttgattattacagcaaatgctactacagacattca

SEQ ID NO: 97021 - DNA, 414 bp, Homo sapiens
atttccactagaggatcctttcttgatcgctccgtgatatggaagagacttggagacgtgggaagtgtcccacacagctgatcagccaggcgcggaggtccacccacctgcagaagggtcaccaggctcagaaacatcctgtccacacctgcaaatctatccatgcctcctgttcatgcccagcccatacattcgatttttacaaattcattgttttcaaaataattaaaagtttcttgctcactctgacaaaataagctgccatgttgtgagatgttctgcggagaggcctacgtggcaaggaccaagggaagcctccagctgacagctcatgagcaactgaatcctaccaataagcatgtgagtgagccagtgttccgcaaaggggctggatatgcagagcgacccccaaat

SEQ ID NO: 97022 - DNA, 303 bp, Homo sapiens
gtgaaaggcacagttaaaacaatgaaaagacaacctagagagtggaagaaatatttgcaaaacacctatctggtaaaaaattggaatccggccgggcgcggtggctcaagcctgtaatcccagtactttgggaggctgaggcaggcggatcaggaggtcaggagatcgagaccatcctgcctaacacagtgaaactctgtctctactaaaaatacaaaaaattagccgggcgtggtggtgggcgcctgtagtcccagccactcgggaggctgaggcaggagaattggtgcaacttgggaggtg

SEQ ID NO: 97023 - DNA, 385 bp, Homo sapiens
ttttttttttgagacagagtcttgctgtgtcatccaggctggagtgcagtggcaccatccacctcctgggttcaagcaacctccacctcctgggttcaaacaattctcctgccacagcctcccaagtagctgggattacaggcacccgccaccacgccaggctcattttttgtatttttagtagagatgggatttcaccatgttggccaggctggtctttaactctcgacctcaggtgatccgcctgcctcagcctcccaaagttctgggattacaggcgtgagccacagcgcccggccggcaattttttaaataataaaaaattccattattttacatagcattgagatacacttacaatatttaattctgcctctcggtggtg

SEQ ID NO: 97024 - DNA, 377 bp, Homo sapiens
tggccagactggtctcaaactcttgacctcaggtgatccacccacctcagcctcccaaagtgctgggattacaggcgtgagccatcgtgcctggcccattcctttttttgatgtggctactagaaaattttaaaattgcatttggggctgacattagatttctattagacagcgctgctccaacgcctctcatcccggccagtagtgagacactgcttgcaaaggaaagcaagtggatccagctgtgagtccagcagtcactgggggtgggggtgaggtcctctcagactcagcatctgcccagccacgactttgactccttgacaaaaacctcatgagccctccctgaagatggagccactgcctccaccctgggc

SEQ ID NO: 97025 - DNA, 830 bp, Homo sapiens
  misc_feature (18)..(18): n is a, c, g, or t
  misc_feature (23)..(23): n is a, c, g, or t
acttagctagtagaggcngggtnttaatcggccgaggaacgaaccgcagtgtccaccggcgaggagccagccctgtcccggtcagagaaagacgacgaggatacctgggagcgggcggcggccgggctgggccgcgccggtgcgggctggcgactctgctcctccgcttgctgctgtctctgggaactgggtgccagcgctgaggggcttccagcggacagggacccccttccccggctcccctgcccaccctgccggggagggcggaagatgccggtgaagaagaagagaaaatcccctggggtggcagcagcagtagcggaagacggaggcctcaaaaagtgtaaaatctccagctattgcagatcccaaccccctgctagactaataagtggagaggaacatttttcaagcaagaagtgcctggcttggttttatgaatatgcaggtcctgatgaagttgtagggccagaaggaatggaaaaattttgtgaagacattggtgttgaacctgaaaatattattatgttagttttagcgtggaaattggaggctgaaagcatgggattttttaccaaggaagaatggttaaagggaatgacttcattacaacggagtcttgctttgtcgccaggccactgcactccagcctgggcgacagagcgagactccgtctcaaaaaaaaaaaatgttcctcaagtccatagctggtccccagggtccgtggcagaagccaaattgtaaccctttcttgaaggataggttcccacggggcgggtaacacaggctccagaacgggggtctcaccctgtggcgtccacactggccac

SEQ ID NO: 97026 - DNA, 775 bp, Homo sapiens
  misc_feature (18)..(18): n is a, c, g, or t
  misc_feature (23)..(23): n is a, c, g, or t
acttagctagtagaggcngggtnttaatcggccgaggcgattcgcctccgggttaggctgagcctcttgcttgctgtgactggtggagctgccgcgctgtccgcgttatctcctcccggtgagaacgaaccgcagtgtccaccggcgaggagccagccctgtcccggtcagagaaagacgacgaggatacctgggagcgggcggcggccgggctgggccgcgccggtgcgggctggcgactctgctcctccgcttgctgctgtctctgggaactgggtgccagcgctgaggggcttccagcggacagggacccccttccccggctcccctgcccaccctgccggggagggcggaagatgccggtgaagaagaagagaaaatcccctggggtggcagcagcagtagcggaagacggaggcctcaaaaagtgtaaaatctccaggtaccatctccccccacccttcaagcttccctcctccctcctttgctggacaactggaggaaaaggagtcgggcccggcctgccgggctggggctggagacagctattgcagatcccaaccccctgctagactaataagtggagaggaacatttttcaagcaagaagtgcctggcttggttttatgaatatgcaggtcctgatgaagttgtagggccagaaggaatggaaaaattttgtgaagacattggtgttgaacctgaaaatattatatgtagttaagcgtggaaatggggtggagcatggatttttccaggagatggttagggatgcc

SEQ ID NO: 97027 - DNA, 473 bp, Homo sapiens
ataaggtgtctagaagcagaacacccaaagaaaggaagggtcattcctctgtcattgcagagctcgtggggagtttgttttataattggagagatgagttcactgaattctgacaaaaatggtttctttttttctagggcctgttcttcttgatgaatttgttgagtggcaaaaagtccgtcagacatcatagcaagaactatgtgaagaaaatgcaaacctttcaattcccacgtgtatacaagctaatgtgatgagggggaaaaaaatccaacgggtgcattttcattcatatgaaagacttctcatagtacttttttttcctttttttaaaggaggtttttcttgttacatgtgatgggcattgagccacacctcttcttagactgaatattgaagtttttgttttgagttatgtttataacatttatttcagaacaataaagattcagatttgtgacaaaggccttaaa

SEQ ID NO: 97028 - DNA, 1539 bp, Homo sapiens
  misc_feature (18)..(18): n is a, c, g, or t
  misc_feature (23)..(23): n is a, c, g, or t
acttagctagtagaggcngggtnttaatcggccgaggcgattcgcctccgggttaggctgagcctcttgcttgctgtgactggtggagctgccgcgctgtccgcgttatctcctcccggtgagaacgaaccgcagtgtccaccggcgaggagccagccctgtcccggtcagagaaagacgacgaggatacctgggagcgggcggcggccgggctgggccgcgccggtgcgggctggcgactctgctcctccgcttgctgctgtctctgggaactgggtgccagcgctgaggggcttccagcggacagggacccccttccccggctcccctgcccaccctgccggggagggcggaagatgccggtgaagaagaagagaaaatcccctggggtggcagcagcagtagcggaagacggaggcctcaaaaagtgtaaaatctccagctattgcagatcccaaccccctgctagactaataagtggagaggaacatttttcaagcaagaagtgcctggcttggttttatgaatatgcaggtcctgatgaagttgtagggccagaaggaatggaaaaattttgtgaagacattggtgttgaacctgaaaatattattatgttagttttagcgtggaaattggaggctgaaagcatgggattttttaccaaggaagaatggttaaagggaatgacttcattacagtgtgactgcacagaaaagttacaaaacaaatttgactttttgcgctcacagttgaatgatatttcgtcatttaagaatatctacagatatgcctttgattttgcaagggataaagatcagagaagccttgatattgatactgctaaatctatgttagctcttctgcttgggaggacatggccactgttttcagtattttaccagtacctggagcaatcaaagtatcgtgttatgaacaaagatcaatggtacaatgtattagaattcagcagaacagtccatgctgatcttagtaactatgatgaagatggtgcttggcctgttcttcttgatgaatttgttgagtggcaaaaagtccgtcagacatcatagcaagaactatgtgaagaaaatgcaaacctttcaattcccacgtgtatacaagctaatgtgatgagggggaaaaaaatccaacgggtgcattttcattcatatgaaagacttctcatagtacttttttttcctttttttaaaggaggtttttcttgttacatgtgatgggcattgagccacacctcttcttagactgaatattgaagtttttgttttgagttatgtttataacatttatttcagaacaataaagattcagatttgtgacaaaggccttaaactcgtgccgaattcggcacgagttttttttttttttttcaaaaaagcccattttttttttttttgtaaaggctttgccctaaaacttctagcgtgtgccaatgggtaaccctgccacaatttgcacaagggtgtccggtgtagcccgcaaaacaaattcgggccatcaacaaaccaggccagggaaggg

SEQ ID NO: 97029 - DNA, 1319 bp, Homo sapiens
  misc_feature (18)..(18): n is a, c, g, or t
  misc_feature (23)..(23): n is a, c, g, or t
acttagctagtagaggcngggtnttaatcggccgaggcgattcgcctccgggttaggctgagcctcttgcttgctgtgactggtggagctgccgcgctgtccgcgttatctcctcccggtgagaacgaaccgcagtgtccaccggcgaggagccagccctgtcccggtcagagaaagacgacgaggatacctgggagcgggctggcgactctgctcctccgcttgctgctgtctctgggaactgggtgccagcgctgaggggcttccagcggacagggacccccttccccggctcccctgcccaccctgccggggagggcggaagatgccggtgaagaagaagagaaaatcccctggggtggcagcagcagtagcggaagacggaggcctcaaaaagtgtaaaatctccagctattgcagatcccaaccccctgctagactaataagtggagaggaacatttttcaagcaagaagtgcctggcttggttttatgaatatgcaggtcctgatgaagttgtagggccagaaggaatggaaaaattttgtgaagacattggtgttgaacctgaaaatattattatgttagttttagcgtggaaattggaggctgaaagcatgggattttttaccaaggaagaatggttaaagggaatgacttcattacagtgtgactgcacagaaaagttacaaaacaaatttgactttttgcgctcacagttgaatgatatttcgtcatttaagaatatctacagatatgcctttgattttgcaagggataaagatcagagaagccttgatattgatactgctaaatctatgttagctcttctgcttgggaggacatggccactgttttcagtattttaccagtacctggagcaatcaaagtatcgtgttatgaacaaagatcaatggtacaatgtattagaattcagcagaacagtccatgctgatcttagtaactatgatgaagatggtgcttggcctgttcttcttgatgaatttgttgagtggcaaaaagtccgtcagacatcatagcaagaactatgtgaagaaaatgcaaacctttcaattcccacgtgtatacaagctaatgtgatgagggggaaaaaaatccaacgggtgcattttcattcatatgaaagacttctcatagtacttttttttcctttttttaaaggaggtttttcttgttacatgtgatgggcattgagccacacctcttcttagactgaatattgaagtttttgttttgagttatgtttataacatttatttcagaacaataaagattcagatttgtgacaaaggccttaaa

SEQ ID NO: 97030 - DNA, 1453 bp, Homo sapiens
  misc_feature (18)..(18): n is a, c, g, or t
  misc_feature (23)..(23): n is a, c, g, or t
acttagctagtagaggcngggtnttaatcggccgaggcgattcgcctccgggttaggctgagcctcttgcttgctgtgactggtggagctgccgcgctgtccgcgttatctcctcccggtgagaacgaaccgcagtgtccaccggcgaggagccagccctgtcccggtcagagaaagacgacgaggatacctgggagcgggcggcggccgggctgggccgcgccggtgcgggctggcgactctgctcctccgcttgctgctgtctctgggaactgggtgccagcgctgaggggcttccagcggacagggacccccttccccggctcccctgcccaccctgccggggagggcggaagatgccggtgaagaagaagagaaaatcccctggggtggcagcagcagtagcggaagacggaggcctcaaaaagtgtaaaatctccaggtaccatctccccccacccttcaagcttccctcctccctcctttgctggacaactggaggaaaaggagtcgggcccggcctgccgggctggggctggagacagctattgcagatcccaaccccctgctagactaataagtggagaggaacatttttcaagcaagaagtgcctggcttggttttatgaatatgcaggtcctgatgaagttgtagggccagaaggaatggaaaaattttgtgaagacattggtgttgaacctgaaaatattattatgttagttttagcgtggaaattggaggctgaaagcatgggattttttaccaaggaagaatggttaaagggaatgacttcattacagtgtgactgcacagaaaagttacaaaacaaatttgactttttgcgctcacagttgaatgatatttcgtcatttaagaatatctacagatatgcctttgattttgcaagggataaagatcagagaagccttgatattgatactgctaaatctatgttagctcttctgcttgggaggacatggccactgttttcagtattttaccagtacctggagcaatcaaagtatcgtgttatgaacaaagatcaatggtacaatgtattagaattcagcagaacagtccatgctgatcttagtaactatgatgaagatggtgcttggcctgttcttcttgatgaatttgttgagtggcaaaaagtccgtcagacatcatagcaagaactatgtgaagaaaatgcaaacctttcaattcccacgtgtatacaagctaatgtgatgagggggaaaaaaatccaacgggtgcattttcattcatatgaaagacttctcatagtacttttttttcctttttttaaaggaggtttttcttgttacatgtgatgggcattgagccacacctcttcttagactgaatattgaagtttttgttttgagttatgtttataacatttatttcagaacaataaagattcagatttgtgacaaaggccttaaa

SEQ ID NO: 97031 - DNA, 1258 bp, Homo sapiens
  misc_feature (18)..(18): n is a, c, g, or t
  misc_feature (23)..(23): n is a, c, g, or t
acttagctagtagaggcngggtnttaatcggccgaggcgattcgcctccgggttaggctgagcctcttgcttgctgtgactggtggagctgccgcgctgtccgcgttatctcctcccggtgagaacgaaccgcagtgtccaccggcgaggagccagccctgtcccggtcagagaaagacgacgaggatacctgggagcgggcggcggccgggctgggccgcgccggtgcgggctggcgactctgctcctccgcttgctgctgtctctgggaactgggtgccagcgctgaggggcttccagcggacagggacccccttccccggctcccctgcccaccctgccggggagggcggaagatgccggtgaagaagaagagaaaatcccctggggtggcagcagcagtagcggaagacggaggcctcaaaaagtgtaaaatctccagctattgcagatcccaaccccctgctagactaataagtggagaggaacatttttcaagcaagaagtgcctggcttggttttatgaatatgcaggtcctgatgaagttgtagggccagaaggaatggaaaaattttgtgaagacattggtgttgaacctgaaaatgtgtgactgcacagaaaagttacaaaacaaatttgactttttgcgctcacagttgaatgatatttcgtcatttaagaatatctacagatatgcctttgattttgcaagggataaagatcagagaagccttgatattgatactgctaaatctatgttagctcttctgcttgggaggacatggccactgttttcagtattttaccagtacctggagcaatcaaagtatcgtgttatgaacaaagatcaatggtacaatgtattagaattcagcagaacagtccatgctgatcttagtaactatgatgaagatggtgcttggcctgttcttcttgatgaatttgttgagtggcaaaaagtccgtcagacatcatagcaagaactatgtgaagaaaatgcaaacctttcaattcccacgtgtatacaagctaatgtgatgagggggaaaaaaatccaacgggtgcattttcattcatatgaaagacttctcatagtacttttttttcctttttttaaaggaggtttttcttgttacatgtgatgggcattgagccacacctcttcttagactgaatattgaagtttttgttttgagttatgtttataacatttatttcagaacaataaagattcagatttgtgacaaaggccttaaa

SEQ ID NO: 97032 - DNA, 1124 bp, Homo sapiens
tttgcactgtgttatatcctaaacttttaaaactactcatgactaatgtctttcaccaaactgttacctacgaactttctaaagaaatgtgtgacaaaggcgtgattagtttcatttgctctgccatttttagctgtatatgtgataaaacatgttttaatacatctctttttaacttcgattttatttggaatttttgaatgagctgtttgtttgtttttaagcaaagtaattggagtgaactttctttgattcccaggttttcttttttccccttttttctttttttattgcattggtagatgcagggcaagaaatttattactctaaatttgtgactcagaattttaaaactaaattaacttcataaatgcgctcacttttttcttaatgcattacgtctaacccccagtgatacttttatttgattttcttgattatgtaatttgtttgatatttcttttatttaaggtgtgactgcacagaaaagttacaaaacaaatttgactttttgcgctcacagttgaatgatatttcgtcatttaagaatatctacagatatgcctttgattttgcaagggataaagatcagagaagccttgatattgatactgctaaatctatgttagctcttctgcttgggaggacatggccactgttttcagtattttaccagtacctggagcaatcaaagtatcgtgttatgaacaaagatcaatggtacaatgtattagaattcagcagaacagtccatgctgatcttagtaactatgatgaagatggtgcttggcctgttcttcttgatgaatttgttgagtggcaaaaagtccgtcagacatcatagcaagaactatgtgaagaaaatgcaaacctttcaattcccacgtgtatacaagctaatgtgatgagggggaaaaaaatccaacgggtgcattttcattcatatgaaagacttctcatagtacttttttttcctttttttaaaggaggtttttcttgttacatgtgatgggcattgagccacacctcttcttagactgaatattgaagtttttgttttgagttatgtttataacatttatttcagaacaataaagattcagatttgtgacaaaggccttaaa

SEQ ID NO: 97033 - DNA, 602 bp, Homo sapiens
gctctagaggacccgtcattttctacacatctacagatatgcctttgattttgcaagggataaagatcagagaagccttgatattgatactgctaaatctatgttagctcttctgcttgggaggacatggccactgttttcagtattttaccagtacctggagcaatcaaagtatcgtgttatgaacaaagatcaatggtacaatgtattagaattcagcagaacagtccatgctgatcttagtaactatgatgaagatggtgcttggcctgttcttcttgatgaatttgttgagtggcaaaaagtccgtcagacatcatagcaagaactatgtgaagaaaatgcaaacctttcaattcccacgtgtatacaagctaatgtgatgagggggaaaaaaatccaacgggtgcattttcattcatatgaaagacttctcatagtacttttttttcctttttttaaaggaggtttttcttgttacatgtgatgggcattgagccacacctcttcttagactgaatattgaagtttttgttttgagttatgtttataacatttatttcagaacaataaagattcagatttgtgacaaaggccttaaa

SEQ ID NO: 97034 - DNA, 916 bp, Homo sapiens
  misc_feature (18)..(18): n is a, c, g, or t
  misc_feature (23)..(23): n is a, c, g, or t
acttagctagtagaggcngggtnttaatcggccgaggcgattcgcctccgggttaggctgagcctcttgcttgctgtgactggtggagctgccgcgctgtccgcgttatctcctcccggtgagaacgaaccgcagtgtccaccggcgaggagccagccctgtcccggtcagagaaagacgacgaggatacctgggagcgggcggcggccgggctgggccgcgccggtgcgggctggcgactctgctcctccgcttgctgctgtctctgggaactgggtgccagcgctgaggggcttccagcggacagggacccccttccccggctcccctgcccaccctgccggggagggcggaagatgccggtgaagaagaagagaaaatcccctggggtggcagcagcagtagcggaagacggaggcctcaaaaagtgtaaaatctccagctattgcagatcccaaccccctgctagactaataagtggagaggaacatttttcaagcaagaagtgcctggcttggttttatgaatatgcaggtcctgatgaagttgtagggccagaaggaatggaaaaattttgtgaagacattggtgttgaacctgaaaatattattatgttagttttagcgtggaaattggaggctgaaagcatgggattttttaccaaggaagaatggttaaagggaatgacttcattacaacggagtcttgctttgtcgccaggccactgcactccagcctgggcgacagagcgagactccgtctcaaaaaaaaaaaatgttcctcaagtccatagctggtccccagggtccgtggcagaagccaaattgtaaccctttcttgaaggataggttcccacggggcgggtaacacaggctccagaacgggggtctcaccctgtggcgtccacactggccac

SEQ ID NO: 97035 - DNA, 815 bp, Homo sapiens
  misc_feature (18)..(18): n is a, c, g, or t
  misc_feature (23)..(23): n is a, c, g, or t
acttagctagtagaggcngggtnttaatcggccgaggcgattcgcctccgggttaggctgagcctcttgcttgctgtgactggtggagctgccgcgctgtccgcgttatctcctcccggtgagaacgaaccgcagtgtccaccggcgaggagccagccctgtcccggtcagagaaagacgacgaggatacctgggagcgggcggcggccgggctgggccgcgccggtgcgggctggcgactctgctcctccgcttgctgctgtctctgggaactgggtgccagcgctgaggggcttccagcggacagggacccccttccccggctcccctgcccaccctgccggggagggcggaagatgccggtgaagaagaagagaaaatcccctggggtggcagcagcagtagcggaagacggaggcctcaaaaagtgtaaaatctccagctattgcagatcccaaccccctgctagactaataagtggagaggaacatttttcaagcaagaagtgcctggcttggttttatgaatatgcaggtcctgatgaagttgtagggccagaaggaatggaaaaattttgtgaagacattggtgttgaacctgaaaatattattatgttagttttagcgtggaaattggaggctgaaagcatgggattttttaccaaggaagaatggttaaagggaatgacttcattacaattccgcgtgcctgcccacaaagtcacaatttgacttttggcctcaagtggatgttttctgcattaggatatttcagattgccttggttttgaaggataccaggcttgttttgtctgt

SEQ ID NO: 97036 - DNA, 1350 bp, Homo sapiens
  misc_feature (18)..(18): n is a, c, g, or t
  misc_feature (23)..(23): n is a, c, g, or t
acttagctagtagaggcngggtnttaatcggccgaggcgattcgcctccgggttaggctgagcctcttgcttgctgtgactggtggagctgccgcgctgtccgcgttatctcctcccggtgagaacgaaccgcagtgtccaccggcgaggagccagccctgtcccggtcagagaaagacgacgaggatacctgggagcgggcggcggccgggctgggccgcgccggtgcgggctggcgactctgctcctccgcttgctgctgtctctgggaactgggtgccagcgctgaggggcttccagcggacagggacccccttccccggctcccctgcccaccctgccggggagggcggaagatgccggtgaagaagaagagaaaatcccctggggtggcagcagcagtagcggaagacggaggcctcaaaaagtgtaaaatctccagctattgcagatcccaaccccctgctagactaataagtggagaggaacatttttcaagcaagaagtgcctggcttggttttatgaatatgcaggtcctgatgaagttgtagggccagaaggaatggaaaaattttgtgaagacattggtgttgaacctgaaaatattattatgttagttttagcgtggaaattggaggctgaaagcatgggattttttaccaaggaagaatggttaaagggaatgacttcattacagtgtgactgcacagaaaagttacaaaacaaatttgactttttgcgctcacagttgaatgatatttcgtcatttaagaatatctacagatatgcctttgattttgcaagggataaagatcagagaagccttgatattgatactgctaaatctatgttagctcttctgcttgggaggacatggccactgttttcagtattttaccagtacctggagcaatcaaagtatcgtgttatgaacaaagatcaatggtacaatgtattagaattcagcagaacagtccatgctgatcttagtaactatgatgaagatggtgcttggcctgttcttcttgatgaatttgttgagtggcaaaaagtccgtcagacatcatagcaagaactatgtgaagaaaatgcaaacctttcaattcccacgtgtatacaagctaatgtgatgagggggaaaaaaatccaacgggtgcattttcattcatatgaaagacttctcatagtacttttttttcctttttttaaaggaggtttttcttgttacatgtgatgggcattgagccacacctcttcttagactgaatattgaagtttttgttttgagttatgtttataacatttatttcagaacaataaagattcagatttgtgacaaaggccttaaa

SEQ ID NO: 97037 - DNA, 1398 bp, Homo sapiens
  misc_feature (18)..(18): n is a, c, g, or t
  misc_feature (23)..(23): n is a, c, g, or t
  misc_feature (1389)..(1389): n is a, c, g, or t
acttagctagtagaggcngggtnttaatcggccgaggcgattcgcctccgggttaggctgagcctcttgcttgctgtgactggtggagctgccgcgctgtccgcgttatctcctcccggtgagaacgaaccgcagtgtccaccggcgaggagccagccctgtcccggtcagagaaagacgacgaggatacctgggagcgggcggcggccgggctgggccgcgccggtgcgggctggcgactctgctcctccgcttgctgctgtctctgggaactgggtgccagcgctgaggggcttccagcggacagggacccccttccccggctcccctgcccaccctgccggggagggcggaagatgccggtgaagaagaagagaaaatcccctggggtggcagcagcagtagcggaagacggaggcctcaaaaagtgtaaaatctccagctattgcagatcccaaccccctgctagactaataagtggagaggaacatttttcaagcaagaagtgcctggcttggttttatgaatatgcaggtcctgatgaagttgtagggccagaaggaatggaaaaattttgtgaagacattggtgttgaacctgaaaatattattatgttagttttagcgtggaaattggaggctgaaagcatgggattttttaccaaggaagaatggttaaagggaatgacttcattacagtgtgactgcacagaaaagttacaaaacaaatttgactttttgcgctcacagttgaatgatatttcgtcatttaagaatatctacagatatgcctttgattttgcaagggataaagatcagagaagccttgatattgatactgctaaatctatgttagctcttctgcttgggaggacatggccactgttttcagtattttaccagtacctggagcaatcaaagtatcgtgttatgaacaaagatcaatggtacaatgtattagaattcagcagaacagtccatgctgatcttagtaactatgatgaagatggtgcttggcctgttcttcttgatgaatttgttgagtggcaaaaagtccgtcagacatcatagcaagaactatgtgaagaaaatgcaaacctttcaattcccacgtgtatacaagctaatgtgtggcggggcgacaacccacggggcgttcattctataagactctcctagactcttttccctccttacgagcgggtcctgttcacttcgggggtggtgcgcccctttttgatgattgtgagtctgtcggggggggttacactatttcgaccacagtccgtttgtggaacaaaaacggctttgtggagcgacaggaaggcggttgccccttaagatgctagtgcccaacaagcactcagagcgatgtccagccgaatatcancgcacacgc

SEQ ID NO: 97038 - DNA, 1621 bp, Homo sapiens
  misc_feature (18)..(18): n is a, c, g, or t
  misc_feature (23)..(23): n is a, c, g, or t
acttagctagtagaggcngggtnttaatcggccgaggcgattcgcctccgggttaggctgagcctcttgcttgctgtgactggtggagctgccgcgctgtccgcgttatctcctcccggtgagaacgaaccgcagtgtccaccggcgaggagccagccctgtcccggtcagagaaagacgacgaggatacctgggagcgggcggcggccgggctgggccgcgccggtgcgggctggcgactctgctcctccgcttgctgctgtctctgggaactgggtgccagcgctgaggggcttccagcggacagggacccccttccccggctcccctgcccaccctgccggggagggcggaagatgccggtgaagaagaagagaaaatcccctggggtggcagcagcagtagcggaagacggaggcctcaaaaagtgtaaaatctccaggtaccatctccccccacccttcaagcttccctcctccctcctttgctggacaactggaggaaaaggagtcgggcccggcctgccgggctggggctggagacaggtgaggcccctttgatcgagctaggctgtaggtgccgaacaccgcgagtctccgcgcccgacccgacctcgtgttcgagtgtgtgcacgctggcgtttatggagagactagaagagccgcccacgttaagagtctacgtgccctgcagggtggggaacagatgcatatctattgcagatcccaaccccctgctagactaataagtggagaggaacatttttcaagcaagaagtgcctggcttggttttatgaatatgcaggtcctgatgaagttgtagggccagaaggaatggaaaaattttgtgaagacattggtgttgaacctgaaaatattattatgttagttttagcgtggaaattggaggctgaaagcatgggattttttaccaaggaagaatggttaaagggaatgacttcattacagtgtgactgcacagaaaagttacaaaacaaatttgactttttgcgctcacagttgaatgatatttcgtcatttaagaatatctacagatatgcctttgattttgcaagggataaagatcagagaagccttgatattgatactgctaaatctatgttagctcttctgcttgggaggacatggccactgttttcagtattttaccagtacctggagcaatcaaagtatcgtgttatgaacaaagatcaatggtacaatgtattagaattcagcagaacagtccatgctgatcttagtaactatgatgaagatggtgcttggcctgttcttcttgatgaatttgttgagtggcaaaaagtccgtcagacatcatagcaagaactatgtgaagaaaatgcaaacctttcaattcccacgtgtatacaagctaatgtgatgagggggaaaaaaatccaacgggtgcattttcattcatatgaaagacttctcatagtacttttttttcctttttttaaaggaggtttttcttgttacatgtgatgggcattgagccacacctcttcttagactgaatattgaagtttttgttttgagttatgtttataacatttatttcagaacaataaagattcagatttgtgacaaaggccttaaa

SEQ ID NO: 97039 - DNA, 827 bp, Homo sapiens
  misc_feature (18)..(18): n is a, c, g, or t
  misc_feature (23)..(23): n is a, c, g, or t
acttagctagtagaggcngggtnttaatcggccgaggcgattcgcctccgggttaggctgagcctcttgcttgctgtgactggtggagctgccgcgctgtccgcgttatctcctcccggtgagaacgaaccgcagtgtccaccggcgaggagccagccctgtcccggtcagagaaagacgacgaggatacctgggagcgggcggcggccgggctgggccgcgccggtgcgggctggcgactctgctcctccgcttgctgctgtctctgggaactgggtgccagcgctgaggggcttccagcggacagggacccccttccccggctcccctgcccaccctgccggggagggcggaagatgccggtgaagaagaagagaaaatcccctggggtggcagcagcagtagcggaagacggaggcctcaaaaagtgtaaaatctccagctattgcagatcccaaccccctgctagactaataagtggagaggaacatttttcaagcaagaagtgcctggcttggttttatgaatatgcaggtcctgatgaagttgtagggccagaaggaatggaaaaattttgtgaagacattggtgttgaacctgaaaatattattatgttagttttagcgtggaaattggaggctgaaagcatgggattttttaccaaggaagaatggttaaagggaatgacttcattacaacggagtcttgctttgtcgccaggctacagtacagtggcgcgatcttggctcactgcaacctccgcctcctgggttcaagcgattctcctgcctcagcctcccgagctgggactacgggcgtgtgcctcc

SEQ ID NO: 97040 - DNA, 513 bp, Homo sapiens
tgacacagagaaaatatcctacaatgaacaagccagagggacctggtagaggactataaaattgtggaagcaaaattgctgagaatgtcaaatgatattacagggatcctccctggcatttagctgaaggaagcaactcttgttttctaatttgctgggtcattggccatttagttttaggttaatataattctctgatccttttagggccatccaggttatgcactagtacattcctacattcaattgaaataaattgagggacggcaagtgtgttggaaagaacaccgacttcattgagaaggtaaagtatttgagtcctggccctgacgcttaatttggccagactttcatcttctcccagcctcaagttttacctacctcacaaggttgttgtgaggatctaaaaatacacacacacacacacacacacacacacacacactttgttggttaactataaatgtaatatctctatgttataattctgttgctaatgtcttttttccaaga

SEQ ID NO: 97041 - DNA, 666 bp, Homo sapiens
agctgacagtcaggatgtcagctgcagctccagtcctctgaaggcttccccaggactggggaatctgctcccaagctctctcatatagctgttggcaaggagacctcttccttgttggctgtgggtcagaggcttctgttcctcaccatgtggcctgtccatagaacaacatggcagtgggaaaaatcgaagggagagagaggtggaagccacaatgtcttttacaacctaatcttgcctccgaagtaacatatcatcacatttgtactcttttggtcactggtcacacagaccaacccttgtacaatgtgggagggcaccttggaaattcatgcccaaaagggcatgaataccagcaggtggggatcaccgagggcaccttggagatggctctgtctatctcaccagcctgactgaactcggccttgtgcctcttgctactccctagccctggcttattatagttttgcataataatatgaaataccaataagaattgtttgcatcttaaatgatcaataagggctgattagcttactaactcttgctacataggatgagaggcataagaaaagaatgtctgagctctccaggcttcagaaaaccattctacaacaaggaagggtgtgggcagataagtggatggatggaagaattaaaagttgg

SEQ ID NO: 97042 - DNA, 738 bp, Homo sapiens
agggcggggcgcgcccggcgcgacgcggagcaggccagcccccgactactgcccgcggaatgggcaagattagtttgttaataatctttcctcctctcctcctcctcctccctcacctaaaaatagaacgtaagtggggaggccaagtctcacaaaacatcccccgcgagaaaacaagtgtctgcttgggcaccctgaaacatacacttgaaagagtcgcctgaatatagactctttagtgtccaaggaattggggtaaggacggaaagaggtgcttgattggtgttgccaaaatgtaaaaactgcaaaagactaagcttcctggagtgctactttcatacttaaagttatttatcgtgtttatgttatgaatgaaaatgaattgtgaaaggatatttaatctggaaatttcacattgaagttggactttggtgagggagaatagaggaaacaattgggacaatgtggagatagttgcttggattttggtgagacagcatgatacaagaaacaaatgatgtcagggttcaaaactttttaaagccagctttggcattccgttttgttatgtttaaattctcattagcaaaaatactcaaattctatccaaaaccagacacaatgtgacagacctatcaagcagcattgttcccctaaatgttacatctgaactatacatataagtaaggcttccaatattttattgtacttggctatgctctgaagaacaagttagaa

SEQ ID NO: 97043 - DNA, 115 bp, Homo sapiens
gtcacgcccacagactctcttctgcctagttcccaaaagctgcccaaacccgtcagcctcccaggaccctaaactgagggaatagaagcagccccttgacctctactccttttta

SEQ ID NO: 97044 - DNA, 487 bp, Homo sapiens
tatgtcattcacttaaaatcacaatttccaagaacctatagacaatgttaagtgaatacttactgtatatattatgtacacatagaatgttacatattatatatatggttttaggtgtatatatatgtataagaatgcattaaaaataataatcatatatttatgaataaagatgttttaaacatagaacattggttggaataataacacattaataacaatttaaaatttcaataataaggggctataatttggaatattatacaaatttaaattcatgctttgagacttctttaaaatatggaaatactcaagctgtgtttgcagtttaaagagttataaaatagtacatatatcattggttcccttttaatttgaatgcatttggataaaataaagatataattttgaatatatttggacagaataaaatcccaaattcaagataggaattgttgggtttggtagatattcagcaactttattt

SEQ ID NO: 97045 - DNA, 395 bp, Homo sapiens
  misc_feature (382)..(382): n is a, c, g, or t
gcagtcctcaccagtccattcagtcattctacagcaagatggtccctctgtggtgagtgggatataaggcagtgcatctttcatgatcacaaagaaagcctatgttgtggatagcattgcgtctcttgatgtaggcattgttatggcaaataatagcactgtggccacatctgtaaggccattccagcctaaatttagtgtctcccataatcccaacccatgcactaggctgggtgttctctcagaatatagaggcaatgaatcagcttaagaccctgggacacacaaaggaaaaggaagaagaatatttagaagttgttatggaatcctgtgtcccctaaagtgtggtaaccatgttacccattccagctgggttaaagtngggggagggatct

SEQ ID NO: 97046 - DNA, 1953 bp, Homo sapiens
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctccttttccgagaagagaaagacctgctgatgtctttgtttgtgtctttgattctcttcagtgatttttcatctttaaagagccattctttttcttctaatttcattttgctaagtttctcttctttgaagaaataaaatccatgatggaagagatggtggcatctgtatatttaattgtcttctatacagcctagaccagaattataaactagaattcc

SEQ ID NO: 97047 - DNA, 856 bp, Homo sapiens
taaatgttaacattttatttaaaccagtacaggcaccatgcttaacaaaagcctgtccaaaataaacatgcaataggacctagcagagactgaaaccacagcttaaggggttgtgtcagtggttggttttgttaaacgatgccagagaactgttaaaattcacaagactaacccgttaatgtttcaaccctccggaatgagattaccttggaccatctaaaccagggggaacggcccctgaattttcagcgcagtccatcacaatcacaccccctgaccgctatgacagcctgggcttactggagctggaccagcggacccacttcccccagttctcctccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagac

SEQ ID NO: 97048 - DNA, 379 bp, Homo sapiens
  misc_feature (221)..(221): n is a, c, g, or t
cgtggacctatggacagtcaacaatatgtacttaaaagttgcactattgcaaaacgggtgtattatccaggtactcggtacactatttttttgtactgctggtcctgtaccagaaacattttcttttattgttacttgctttttaaactttgtttagccacttaaaatctgcttatggcacaatttgcctcaaaatccattccaagttgtatatttgtttnccaataaaaaaattacaatttaaaaaaaaaaaaaaaaaaaaaaactggagactagctctgtgtgcgatgttgttatctgacagttctccgtccctactggcctttctcctcgtcttcatatttgtacggtacaagcaataaagacactcatttcagac

SEQ ID NO: 97049 - DNA, 556 bp, Homo sapiens
  misc_feature (21)..(21): n is a, c, g, or t
aagtatgactagtacgagccnggtgttaatcggacgaggccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagac

SEQ ID NO: 97050 - DNA, 752 bp, Homo sapiens
  misc_feature (713)..(713): n is a, c, g, or t
acttctctgggcgccaccgtagctcccgacctgctgtccgcaaataaccccaggctgggaaaggcaaaggcgccttggtctctgtggaccctggccaggccccaggctccaggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactcgctgaantatgccttcagacccactggatgaggggtaccgagctcg

SEQ ID NO: 97051 - DNA, 5317 bp, Homo sapiens
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaataaattttgagtagaataatcgtcttttgcaatgtacattttaaaaatttcacacattcttttttgtatataaagaacagtgactgggcacagtggctcatgcctgtaatcccagcaatttgggaggccgaggcgggcgggtctcttgaggccaggggttcgagaccagcctgggcatcatagggagaccttcatctctacaaaaaatacaaaaattagctgggcatggtggtgcatgcctgcaatcccagctaacttggaaggctgaggtgaggtgggaagatcacttgagcccaggagtttgaggctgcagtgagctatgattgcggcactgcactgcagcctgggacaatgagactgtgtctctaaaaataaaaaaaaaaaaaacatgatacatgctattaaaaaagacagcaaagcaggagtataagaaaggaaattcacccgaggtcgcagggccttgagtactcattttggtgctgattacctctctgcaaatggacacggcatcataaattggtagtttcctgctctttttgtgtaatcttttccagttaatgtgaagcctctgggggctgccctcgtgcactgatggttgtgtggagtcgggggcggcagtgcgattcccttttagctgctgcatggggggaactcaggctttccagctgcttcctggggttccatggggtagacccctcaaccgcttcagctgccccgttaacaggaattgacttggtttcgtttggtgctaccagcagtcctgtaataaactagctatccatctgtaaa

SEQ ID NO: 97052 - DNA, 3299 bp, Homo sapiens
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagac

SEQ ID NO: 97053 - DNA, 3469 bp, Homo sapiens
  misc_feature (3356)..(3356): n is a, c, g, or t
  misc_feature (3362)..(3362): n is a, c, g, or t
  misc_feature (3367)..(3367): n is a, c, g, or t
  misc_feature (3385)..(3385): n is a, c, g, or t
  misc_feature (3402)..(3403): n is a, c, g, or t
  misc_feature (3406)..(3407): n is a, c, g, or t
  misc_feature (3423)..(3423): n is a, c, g, or t
  misc_feature (3433)..(3433): n is a, c, g, or t
  misc_feature (3435)..(3435): n is a, c, g, or t
  misc_feature (3437)..(3437): n is a, c, g, or t
  misc_feature (3440)..(3440): n is a, c, g, or t
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagacaaaaaaaaaaaaaaaaaaaaaaggggggataaaggggggggggggaaaaaggggtantggaangggcntgggtaaagtggttccgnacccattttttggtaannggnnaaattggggggccccnaaaagggggngnanaantgaaaagcggtaactgtaagatgggaaaa

SEQ ID NO: 97054 - DNA, 3497 bp, Homo sapiens
  misc_feature (3384)..(3384): n is a, c, g, or t
  misc_feature (3390)..(3390): n is a, c, g, or t
  misc_feature (3395)..(3395): n is a, c, g, or t
  misc_feature (3413)..(3413): n is a, c, g, or t
  misc_feature (3430)..(3431): n is a, c, g, or t
  misc_feature (3434)..(3435): n is a, c, g, or t
  misc_feature (3451)..(3451): n is a, c, g, or t
  misc_feature (3461)..(3461): n is a, c, g, or t
  misc_feature (3463)..(3463): n is a, c, g, or t
  misc_feature (3465)..(3465): n is a, c, g, or t
  misc_feature (3468)..(3468): n is a, c, g, or t
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagacaaaaaaaaaaaaaaaaaaaaaaaaaaaaaaaaaaaaaaaaaaaaaaaaaaggggggataaaggggggggggggaaaaaggggtantggaangggcntgggtaaagtggttccgnacccattttttggtaannggnnaaattggggggccccnaaaagggggngnanaantgaaaagcggtaactgtaagatgggaaaa

SEQ ID NO: 97055 - DNA, 4683 bp, Homo sapiens
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgagggtgtctggggttggtgggggtaggaacgtgtgaggccaagggtagggggatcccccagacctgtgtgtttccagcccagatgccctgagggcaggactgtgatgccagcctcagggccacgggcccagccctcatttctcctccatcctcaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaata

SEQ ID NO: 97056 - DNA, 4653 bp, Homo sapiens
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctttagggagggctttctagaggaggaagcaaacgtgtcagctggccggaggaatgacgtgtgggatgccagcaatgggagaagcatggcatagctaaggaccggcagcagccagggagatggtgatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaata

SEQ ID NO: 97057 - DNA, 4474 bp, Homo sapiens
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaagatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaata

SEQ ID NO: 97058 - DNA, 5440 bp, Homo sapiens
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagaggttagtggcagggtgtgcgccaggctgacctgtggcatgcacaccacatgggactcacactggggaagttgggctgagcttctgccctcattcgccaggctccccaccaaggtccagggtggtggctgccctcattcgccaggctccccaccaaggtccagggtggtggctgccctcattcaccaggctccccaccaaggtccagggtggtggctctgtggcaagttgccccaagtagggaccttcccaagcctcccatgagcgctcctaggccactagcggagtgtcaactgccacaatacctactttatttgtatttatttatttatttatttttgaggagtcttactctattgagtgcagtggtgtgatctcggctcgctgcaacctctgcctcccgggttcaagcgattgtcctgcctcagcctcccgaataggtgggattacaggtgcccgccaccatgcccagctaatttttgtatttttagtagagacggggtttcatcatattggccaggctggtctcaaactcctgaccttgtgatccacccacctcagcctcccaaagtgcttggattacaggcatgagcccccgcgcccggccaagtttagaagatagtttggcagtgtccaccaaagctgagcaccagccatctgccctagctgtgtgcacaggagaagtggggacacacactcaccttagaaagtgtccccctcactcagcagcaggacttactctagccccaactggaacaacccaagtatccactgtgagaggaacagtcagatccactgtggagtgttctcacagtgggacgccacacagcagttaggaatgagctacagctacacacgacagtgtggacgcgtctcataggctaatgtcgagggaaagccgcacagaggagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaata

SEQ ID NO: 97059 - DNA, 3485 bp, Homo sapiens
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaata

SEQ ID NO: 97060 - DNA, 3586 bp, Homo sapiens
cagctggcccttacctcccgctggacctctgggcctggcctgtgcccactgggggctatgggctgggctcaccctctcctctgcgggggtggagggccaccagccttggctgttacaatcttacaccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaata

SEQ ID NO: 97061 - DNA, 3293 bp, Homo sapiens
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcaccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaata

SEQ ID NO: 97062 - DNA, 2993 bp, Homo sapiens
ccggtcgctcggacactgggtagacgtggtcgagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaata

SEQ ID NO: 97063 - DNA, 3228 bp, Homo sapiens
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaata

SEQ ID NO: 97064 - DNA, 2424 bp, Homo sapiens
  misc_feature (2311)..(2311): n is a, c, g, or t
  misc_feature (2317)..(2317): n is a, c, g, or t
  misc_feature (2322)..(2322): n is a, c, g, or t
  misc_feature (2340)..(2340): n is a, c, g, or t
  misc_feature (2357)..(2358): n is a, c, g, or t
  misc_feature (2361)..(2362): n is a, c, g, or t
  misc_feature (2378)..(2378): n is a, c, g, or t
  misc_feature (2388)..(2388): n is a, c, g, or t
  misc_feature (2390)..(2390): n is a, c, g, or t
  misc_feature (2392)..(2392): n is a, c, g, or t
  misc_feature (2395)..(2395): n is a, c, g, or t
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagacaaaaaaaaaaaaaaaaaaaaaaggggggataaaggggggggggggaaaaaggggtantggaangggcntgggtaaagtggttccgnacccattttttggtaannggnnaaattggggggccccnaaaagggggngnanaantgaaaagcggtaactgtaagatgggaaaa

SEQ ID NO: 97065 - DNA, 2100 bp, Homo sapiens
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctccttgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagac

SEQ ID NO: 97066 - DNA, 1988 bp, Homo sapiens
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgccatcaaggatgaaactcaacaggtgttactttcttcatgaatcagcgaaacatgagattgcagagaattcatttccctcccaagagcggatggacagtgccttgtcatgtcgctgctggg

SEQ ID NO: 97067 - DNA, 1918 bp, Homo sapiens
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctctaactggagctggaccagcggagcgcctcccgggacaggcgacgacgcagcaaaaccttggaccagaggcgctaaagaggagcacggtggactgattcgttccccccgccatgagaagaagacgacaggtccgtaaatactgggccgtgccacccccaaggatttgagcacctcaccccaatgcagtacaaggccatgcaagctgcgggtcagatacctgccagctgtgcctcagca

SEQ ID NO: 97068 - DNA, 1842 bp, Homo sapiens
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgcttgcacgtgggttctcggtcagcatctgctgagtgagaggaagtgggcagtcctggccatacccaagtctctttcaggtcctcgtcccagtgtggtatatagacacggcttccccactggacccagggaaggagctgcaggagtccacccagtcagggaggct

SEQ ID NO: 97069 - DNA, 1937 bp, Homo sapiens
  misc_feature (1897)..(1897): n is a, c, g, or t
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagagtggtttgtggtcaagacagaatcattaagggccatacagggcctgcctgctccgaaagcccgtctgcccgaacccagctgctccgggaggcaggtgctgacggccgtctctgcacaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgcctggctaattttttttttcatattaagaaatatggagatggggtctcgctgtgttgcccaggctggtctcaaactcatgggttcaagcaatcctgncacctaagtcccccaaattgctgggattacaggtgtgagc

SEQ ID NO: 97070 - DNA, 1299 bp, Homo sapiens
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgagagttgttgaagaccattaactatgc

SEQ ID NO: 97071 - DNA, 2863 bp, Homo sapiens
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagaggttagtggcagggtgtgcgccaggctgacctgtggcatgcacaccacatgggactcacactggggaagttgggctgagcttctgccctcattcgccaggctccccaccaaggtccagggtggtggctgccctcattcgccaggctccccaccaaggtccagggtggtggctgccctcattcaccaggctccccaccaaggtccagggtggtggctctgtggcaagttgccccaagtagggaccttcccaagcctcccatgagcgctcctaggccactagcggagtgtcaactgccacaatacctactttatttgtatttatttatttatttatttttgaggagtcttactctattgagtgcagtggtgtgatctcggctcgctgcaacctctgcctcccgggttcaagcgattgtcctgcctcagcctcccgaataggtgggattacaggtgcccgccaccatgcccagctaatttttgtatttttagtagagacggggtttcatcatattggccaggctggtctcaaactcctgaccttgtgatccacccacctcagcctcccaaagtgcttggattacaggcatgagcccccgcgcccggccaagtttagaagatagtttggcagtgtccaccaaagctgagcaccagccatctgccctagctgtgtgcacaggagaagtggggacacacactcaccttagaaagtgtccccctcactcagcagcaggacttactctagccccaactggaacaacccaagtatccactgtgagaggaacagtcagatccactgtggagtgttctcacagtgggacgccacacagcagttaggaatgagctacagctacacacgacagtgtggacgcgtctcataggctaatgtcgagggaaagccgcacagaggaggtgagtccacagttcacaggtgtgtctgtgtgcagtggtacagatgggaagtagaggttaattcttgtgggggatggtcagtaaccgggaggggcacacagggccttccagggggagatgccacctcagcctcgcaagtagctgggactataggtgtgtgccaccatgcctggctaattttttttttcatattaagaaatatggagaccttcatctctacaaaaaatacaaaaattagctgggcatggtggtgcatgcctgcaatcccagctaacttggaaggctgaggtgaggtgggaagatcacttgagcccaggagtttgaggctgcagtgagctatgattgcggcactgcactgcagcctgggacaatgagactgtgtctctaaaaataaaaaaaaaaaaaacatgatacatgctattaaaaaagacagcaaagcaggagtataagaaaggaaattcacccgaggtcgcagggccttgagtactcattttggtgctgattacctctctgcaaatggacacggcatcataaattggtagtttcctgctctttttgtgtaatcttttccagttaatgtgaagcctctgggggctgccctcgtgcactgatggttgtgtggagtcgggggcggcagtgcgattcccttttagctgctgcatggggggaactcaggctttccagctgcttcctggggttccatggggtagacccctcaaccgcttcagctgccccgttaacaggaattgacttggtttcgtttggtgctaccagcagtcctgtaataaactagctatccatctgtaaa

SEQ ID NO: 97072 - DNA, 2407 bp, Homo sapiens
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagaggttagtggcagggtgtgcgccaggctgacctgtggcatgcacaccacatgggactcacactggggaagttgggctgagcttctgccctcattcgccaggctccccaccaaggtccagggtggtggctgccctcattcgccaggctccccaccaaggtccagggtggtggctgccctcattcaccaggctccccaccaaggtccagggtggtggctctgtggcaagttgccccaagtagggaccttcccaagcctcccatgagcgctcctaggccactagcggagtgtcaactgccacaatacctactttatttgtatttatttatttatttatttttgaggagtcttactctattgagtgcagtggtgtgatctcggctcgctgcaacctctgcctcccgggttcaagcgattgtcctgcctcagcctcccgaataggtgggattacaggtgcccgccaccatgcccagctaatttttgtatttttagtagagacggggtttcatcatattggccaggctggtctcaaactcctgaccttgtgatccacccacctcagcctcccaaagtgcttggattacaggcatgagcccccgcgcccggccaagtttagaagatagtttggcagtgtccaccaaagctgagcaccagccatctgccctagctgtgtgcacaggagaagtggggacacacactcaccttagaaagtgtccccctcactcagcagcaggacttactctagccccaactggaacaacccaagtatccactgtgagaggaacagtcagatccactgtggagtgttctcacagtgggacgccacacagcagttaggaatgagctacagctacacacgacagtgtggacgcgtctcataggctaatgtcgagggaaagccgcacagaggaggtgagtccacagttcacaggtgtgtctgtgtgcagtggtacagatgggaagtagaggttaattcttgtgggggatggtcagtaaccgggaggggcacacagggccttccagggggagatgccacctcagcctcgcaagtagctgggactataggtgtgtgccaccatgcctggctaattttttttttcatattaagaaatatggagatggggtctcgctgtgttgcccaggctggtctcaaactcatgggttcaagcaatcctgccacctaagtcccccaaattgctgggattacaggtgtgagccactttgcctggctgcatatttcataattaaaggacagaaagtctag

SEQ ID NO: 97073 - DNA, 1546 bp, Homo sapiens
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagaggttagtggcagggtgtgcgccaggctgacctgtggcatgcacaccacatgggactcacactggggaagttgggctgagcttctgccctcattcgccaggctccccaccaaggtccagggtggtggctgccctcattcgccaggctccccaccaaggtccagggtggtggctgccctcattcaccaggctccccaccaaggtccagggtggtggctctgtggcaagttgccccaagtagggaccttcccaagcctcccatgagcgctcctaggccactagcggagtgtcaactgccacaatacctactttatttgtatttatttatttatttatttttgaggagtcttactctattgagattgcaccactgtagcctgggcgacagagcaagactgtcta

SEQ ID NO: 97074 - DNA, 1215 bp, Homo sapiens
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagtttccctcacgaaacacggtttgccactagctggggtacctgcccgcggtttccctcaggaacagctata

SEQ ID NO: 97075 - DNA, 1000 bp, Homo sapiens
  misc_feature (961)..(961): n is a, c, g, or t
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactcgctgaantatgccttcagacccactggatgaggggtaccgagctcg

SEQ ID NO: 97076 - DNA, 789 bp, Homo sapiens
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatggatgacagtctaccgggtaccgagctga

SEQ ID NO: 97077 - DNA, 458 bp, Homo sapiens
ctgagggggtcgctgccacctccccaatgagcctccgcagcaccaggaaggagccccacccaccagctccagctccaagagacgcagatctctgcttccccacctgcctccctagcccatctgtgctgtctggcatcaaaaccaggtcagtgagagggggcgagagaaaaaggacttagtaagtggcaaggaaaggaattgagcttattttgagcctgttctgggcacagggcttcactctgtacatgttcattccacagatacttattaagtacccactccactctgtgcccaacaccctacaaagctctggggatccagctgtggctaaggcagccaagagtcctgcctttgtcgtgctgacattccagtgtgggtggtgggctgtcagcgtaagcaaacacatacagtaacatcggtggtgatgggtgcttaggggaaaatgaagggtaagggta

SEQ ID NO: 97078 - DNA, 1186 bp, Homo sapiens
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacaggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggtgcgtgccccgggaattgcgctcgcgagcctctgtgggggctgcggtctggagcctgaccctgaggcctggacgcttacccgcgctttctgctgctgtgggcttatttcccccacaaattccccctagtcagaaaagggggagcctgaggcccagagaggagcagcaggccttgctgctgagtccccacctccaccctatgttaggggctgggggtgcctgtggagagagagagcctcggggccccacccagcaggtactgtcaagggaggctggggcctgttggggaggacgtcgctgttggggagtcccgggctttgctcagggtatcccaggtggaggccgggccaggagtggaattctactttttcccttatttgaattttttgtagtggaagattccaaagacattcaaaaatttaaaaagaa

SEQ ID NO: 97079 - DNA, 4530 bp, Homo sapiens
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaata

SEQ ID NO: 97080 - DNA, 4486 bp, Homo sapiens
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtccgcccgagtgcccgtgctgtctcacccggtgttccgtcgtttgtgggcgggctggtccctctttaggccttcctccggggtcccgtgcgagggccattgctgtgtccggactccggggggtggttaatcccaaaaacggctttggaggggtgggtgtcctttgtgctttgtcttcttcttcgtaggg

SEQ ID NO: 97081 - DNA, 3536 bp, Homo sapiens
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggcagatatcatgctgtccaagagatgttaatagatgtaagaaaaaaagtgtgtgtgtgttg

SEQ ID NO: 97082 - DNA, 4464 bp, Homo sapiens
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaata

SEQ ID NO: 97083 - DNA, 4568 bp, Homo sapiens
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgagggccacgggcccagccctcatttctcctccatcctcaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaata

SEQ ID NO: 97084 - DNA, 4553 bp, Homo sapiens
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacaggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgagggtgtctggggttggtgggggtaggaacgtgtgaggccaagggtagggggatcccccagacctgtgtgtttccagcccagatgccctgagggcaggactgtgatgccagcctcagggccacgggcccagccctcatttctcctccatcctcaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaata

SEQ ID NO: 97085 - DNA, 3522 bp, Homo sapiens
gcagtatgagatatcgaagtcattcatggtcactttagcccgtgccttgctgacgccacttccacctggtgcgggagaaggccactggccgctactacgccatgaagatcctgcggaaggaagtcatcattgccaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaata

SEQ ID NO: 97086 - DNA, 1316 bp, Homo sapiens
gcaggctgtcggtccaagtccttgatggtagcgggggctgggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggtgcgtgccccgggaattgcgctcgcgagcctctgtgggggctgcggtctggagcctgaccctgaggcctggacgcttacccgcgctttctgctgctgtgggcttatttcccccacaaattccccctagtcagaaaagggggagcctgaggcccagagaggagcagcaggccttgctgctgagtccccacctccaccctatgttaggggctgggggtgcctgtggagagagagagcctcggggccccacccagcaggtactgtcaagggaggctggggcctgttggggaggacgtcgctgttggggagtcccgggctttgctcagggtatcccaggtggaggccgggccaggagtggaattctactttttcccttatttgaattttttgtagtggaagattccaaagacattcaaaaatttaaaaagaa

SEQ ID NO: 97087 - DNA, 1304 bp, Homo sapiens
  misc_feature (8)..(8): n is a, c, g, or t
  misc_feature (104)..(104): n is a, c, g, or t
  misc_feature (150)..(150): n is a, c, g, or t
  misc_feature (157)..(157): n is a, c, g, or t
  misc_feature (212)..(212): n is a, c, g, or t
  misc_feature (1256)..(1256): n is a, c, g, or t
aaatggcncagtttttccgatgaagcgggcagttagccacgatttaaatggagtagtcacataggggcaccaggctttttccctagcggtctccgctttgttgntggtgggaattgtaacgatccattcaccccaggaaccagtatgggncatgatncgatttaatcgctcctcttaagggggaattgggcctcgaggcccaagattcggcnccgagttctgttttcctgcgcaggagccgcagggccgtaggcagccatggcgcccagccggaatggcatggtcttgaagccccacttcacaaaggactggcagcggcgcgtggccacgtggttcaaccagccgggcccgtaagatccgccagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggtaaggttgggctggtgctcacagctgtaatcccagcactttgagattggctgggagttcaagaccagcctggccnacatgtcaaactactaaaaataaagaaatcagcatgaaaaaacaaaaa

SEQ ID NO: 97088 - DNA, 676 bp, Homo sapiens
agcggcttttccgctcggctgttttcctgcgcaggagccgcagggccgtaggcagccatggcgcccagccggaatggcatggtcttgaagccccacttcacaaaggactggcagcggcgcgtggccacgtggttcaaccagccgggcccgtaagatccgccagacgtaaggcccggcaagccaaggcgcgccgcatcgccccgcgccccgcgtcgggtcccatccggcccatcgtgcgctgccccacggttcggtaccacacgtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatca

SEQ ID NO: 97089 - DNA, 464 bp, Homo sapiens
agcttgcacgccggcagctgatctatcgaggatgacctacgacaaggcgggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatca

SEQ ID NO: 97090 - DNA, 1445 bp, Homo sapiens
  misc_feature (8)..(8): n is a, c, g, or t
  misc_feature (104)..(104): n is a, c, g, or t
  misc_feature (150)..(150): n is a, c, g, or t
  misc_feature (157)..(157): n is a, c, g, or t
  misc_feature (212)..(212): n is a, c, g, or t
  misc_feature (1397)..(1397): n is a, c, g, or t
aaatggcncagtttttccgatgaagcgggcagttagccacgatttaaatggagtagtcacataggggcaccaggctttttccctagcggtctccgctttgttgntggtgggaattgtaacgatccattcaccccaggaaccagtatgggncatgatncgatttaatcgctcctcttaagggggaattgggcctcgaggcccaagattcggcnccgagttctgttttcctgcgcaggagccgcagggccgtaggcagccatggcgcccagccggaatggcatggtcttgaagccccacttcacaaaggactggcagcggcgcgtggccacgtggttcaaccagccgggcccgtaagatccgccagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctcttccccagggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggtaaggttgggctggtgctcacagctgtaatcccagcactttgagattggctgggagttcaagaccagcctggccnacatgtcaaactactaaaaataaagaaatcagcatgaaaaaacaaaaa

SEQ ID NO: 97091 - DNA, 848 bp, Homo sapiens
  misc_feature (800)..(800): n is a, c, g, or t
agcttgcacgccggcagctgatctatcgaggatgacctacgacaaggcgggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggtaaggttgggctggtgctcacagctgtaatcccagcactttgagattggctgggagttcaagaccagcctggccnacatgtcaaactactaaaaataaagaaatcagcatgaaaaaacaaaaa

SEQ ID NO: 97092 - DNA, 831 bp, Homo sapiens
  misc_feature (8)..(8): n is a, c, g, or t
  misc_feature (104)..(104): n is a, c, g, or t
  misc_feature (150)..(150): n is a, c, g, or t
  misc_feature (157)..(157): n is a, c, g, or t
  misc_feature (212)..(212): n is a, c, g, or t
aaatggcncagtttttccgatgaagcgggcagttagccacgatttaaatggagtagtcacataggggcaccaggctttttccctagcggtctccgctttgttgntggtgggaattgtaacgatccattcaccccaggaaccagtatgggncatgatncgatttaatcgctcctcttaagggggaattgggcctcgaggcccaagattcggcnccgagttctgttttcctgcgcaggagccgcagggccgtaggcagccatggcgcccagccggaatggcatggtcttgaagccccacttcacaaaggactggcagcggcgcgtggccacgtggttcaaccagccgggcccgtaagatccgccagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtgggcctctatgattgagatcct

SEQ ID NO: 97093 - DNA, 794 bp, Homo sapiens
agccgcagggccgtaggcagccatggcgcccagccggaatggcatggtcttgaagccccacttcacaaaggactggcagcggcgcgtggccacgtggttcaaccagccgggcccgtaagatccgcaggtgagccctgcgctcggggctgcccctggggctcgtgcccgcggctgcgccttggcttgcgggtggccgatgccaggcggggggcgctgtctgcaaccgtcgcggagcgctggcctggcggccttaggcaagggtgaccgccgctgcgcttctctccaccagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtgagtactggcagcgctgcggtgtcaggaaggccccgaagtcccctctgttggcctcagtcgcgtgatgacattctccggaatcgctgtacggccttgatgaaagcacatttgaacccttttccatctgattgctgaggcttttcatccaggcctcggggctggagaaagcccgggcctgtctccatctctctctggttctggggccaggtggccgggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagc

SEQ ID NO: 97094 - DNA, 920 bp, Homo sapiens
  misc_feature (8)..(8): n is a, c, g, or t
  misc_feature (104)..(104): n is a, c, g, or t
  misc_feature (150)..(150): n is a, c, g, or t
  misc_feature (157)..(157): n is a, c, g, or t
  misc_feature (212)..(212): n is a, c, g, or t
aaatggcncagtttttccgatgaagcgggcagttagccacgatttaaatggagtagtcacataggggcaccaggctttttccctagcggtctccgctttgttgntggtgggaattgtaacgatccattcaccccaggaaccagtatgggncatgatncgatttaatcgctcctcttaagggggaattgggcctcgaggcccaagattcggcnccgagttctgttttcctgcgcaggagccgcagggccgtaggcagccatggcgcccagccggaatggcatggtcttgaagccccacttcacaaaggactggcagcggcgcgtggccacgtggttcaaccagccgggcccgtaagatccgccagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatca

SEQ ID NO: 97095 - DNA, 1060 bp, Homo sapiens
  misc_feature (1012)..(1012): n is a, c, g, or t
agcggcttttccgctcggctgttttcctgcgcaggagccgcagggccgtaggcagccatggcgcccagccggaatggcatggtcttgaagccccacttcacaaaggactggcagcggcgcgtggccacgtggttcaaccagccgggcccgtaagatccgccagacgtaaggcccggcaagccaaggcgcgccgcatcgccccgcgccccgcgtcgggtcccatccggcccatcgtgcgctgccccacggttcggtaccacacgtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggtaaggttgggctggtgctcacagctgtaatcccagcactttgagattggctgggagttcaagaccagcctggccnacatgtcaaactactaaaaataaagaaatcagcatgaaaaaacaaaaa

SEQ ID NO: 97096 - DNA, 875 bp, Homo sapiens
gccagcgccatcggcctggcgcttcagccaacgcgggagtggatgggccccttcttcttcgcagacagcgttcggccgctgcccgggctctaggcgcggccggacggcccagtctggagggttcggggcggaggcccgggggggtgcgcgcgcccggggtccggcctctcactcgctcccctctcgtccgcagccgcagggccgtaggcagccatggcgcccagccggaatggcatggtcttgaagccccacttcacaaaggactggcagcggcgcgtggccacgtggttcaaccagccgggcccgtaagatccgccagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatca

SEQ ID NO: 97097 - DNA, 1030 bp, Homo sapiens
  misc_feature (8)..(8): n is a, c, g, or t
  misc_feature (104)..(104): n is a, c, g, or t
  misc_feature (150)..(150): n is a, c, g, or t
  misc_feature (157)..(157): n is a, c, g, or t
  misc_feature (212)..(212): n is a, c, g, or t
aaatggcncagtttttccgatgaagcgggcagttagccacgatttaaatggagtagtcacataggggcaccaggctttttccctagcggtctccgctttgttgntggtgggaattgtaacgatccattcaccccaggaaccagtatgggncatgatncgatttaatcgctcctcttaagggggaattgggcctcgaggcccaagattcggcnccgagttctgttttcctgcgcaggagccgcagggccgtaggcagccatggcgcccagccggaatggcatggtcttgaagccccacttcacaaaggactggcagcggcgcgtggccacgtggttcaaccagccgggcccgtaagatccgccagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcaaaaaacaacgaaaaacactccggaggcaatcaatagggggagtagggaaacaaacacgggacagaacaacggggccacgagggacacaaagcaggggaaccatgaacacc

SEQ ID NO: 97098 - DNA, 690 bp, Homo sapiens
  misc_feature (8)..(8): n is a, c, g, or t
  misc_feature (104)..(104): n is a, c, g, or t
  misc_feature (150)..(150): n is a, c, g, or t
  misc_feature (157)..(157): n is a, c, g, or t
  misc_feature (212)..(212): n is a, c, g, or t
aaatggcncagtttttccgatgaagcgggcagttagccacgatttaaatggagtagtcacataggggcaccaggctttttccctagcggtctccgctttgttgntggtgggaattgtaacgatccattcaccccaggaaccagtatgggncatgatncgatttaatcgctcctcttaagggggaattgggcctcgaggcccaagattcggcnccgagttctgttttcctgcgcaggagccgcagggccgtaggcagccatggcgcccagccggaatggcatggtcttgaagccccacttcacaaaggactggcagcggcgcgtggccacgtggttcaaccagccgggcccgtaagatccgccagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggccccgggccattcaacgcctccgggccattcaa

SEQ ID NO: 97099 - DNA, 181 bp, Homo sapiens
ttccagctcttgaagacgacataatccttcatgccttagtcttcacatatgttgaaccctctgaccagatatctgttccttatttctctgcctgttcaacagtcgcaattcacctccaatgattactgtctgaagtcattcttcagaattcaactcttctttattggtctcttactgtggc

SEQ ID NO: 97100 - DNA, 329 bp, Homo sapiens
taagaaatgtgaacaggcaagtcacagaaaggaaaacataaaagacaatttaaaaactataatagaatgctcactctcagttgtaatcagtaattataaattaatataacaccaagatatcattttatctttagtagattgggaaacatttataaagttggaatgtgcagaaaagagttagtggcagctggatggaatgctaaggtggcccttggctggcatctgggaacttgcatttcagggaatttcttctattctgataactggtaagagtggctcactatgtctagactgcatgcccaaatgctatcatttatgctttttttccc

SEQ ID NO: 97101 - DNA, 174 bp, Homo sapiens
gggtgtctagaggatcccaggtgttgtgggcagcccgagcacttacccatgtcagagaactggcccatgtctcctgcgcacttgccaggtctcagagctcttcccagggatctttttccacaggtcacccctccttcttctggcattcaaggctcctcagcctgtgcttgcctt

SEQ ID NO: 97102 - DNA, 829 bp, Homo sapiens
tgaggacctagtgcttcattcttaaagtcagtgagatcaagaacccaccaattctggacacacctggactatgttctcacgactccatcggtgttgcctccggtgtgaagaggtgatgcctggagtcccgcaaacccctcccacgtgactcccgtgttgcagctgcccacgccccctcagaggcagtgtatgctttcctagccatgggtggctgaaaccttaccagtctccagcttagatgtcctttctcctcctgccgtgcagggttccctgtggtggggatgggatcaagcattcttggctcttccttgccactttgctggcataatggagaattttttctgccttagggaaatgacttgaaagttactcagttggagtcacgtgtgactaaacacagatttggtttatcccagaaatagatgaagttctcagagaggaggattgttttcaatcttatggatcgtggggatttctaaagatttccctgtgttcagacttgcaactctcctagggtctcatcaccatcgtggacagatacagaacatcgggcagcttatggagtggggctgtcccccaggccacatgccggttcctcagaggttgctgggtaggattctgctgctttaacaaacttgcctggctaacaccactggctcacccttgaatgccttcctgggtgaagccatgaaccctccagggttaagccccaattttggggctcacctgccctgcatcagattgatggttaacttgtaaagaaactggcagctttccagagtgctaggaaaaaggaaaattatcattaaacaaaatcattgtcatagtt

SEQ ID NO: 97103 - DNA, 907 bp, Homo sapiens
gctgtaaaaggtcatttaaggtgctgtgatagcattccacccagggacccaggcaagtcccccggataaataggggctgagggaaggcgttcctgaggaatgatgtttgctcaaagacctataatgaccccattaattgaatatttggaagacagagggagggcaggccctgggctatcctgtaacagtatgtgggctacagcctgcaagccaattggtacacttggtaaaaagaattgtttctaaatttagaggaagtgttgaagcttctgggaagcaggtggtgacaatgacattcaaagaaaaaaattgttttgttttgttttttgagatggagtctcactcttgttactcaggctggagtgcagtggcacagtctcagctcactgcagcctctgccgcccaggctcgagcgattctcctgcctcagcttcccaagtaggggactacaggcgcctgccaccatgattggctaatttttatatttttggtagaggtggggtttcagcctagccaacatagcgaaaccccatctctactatataagaataaactggccaccgcacctggcctgaagccatagttcttaacctcagttgtgcaatagaattatctggggaatttaaaaattagaaaaaacccatgccctgaagattgtgatctaactggtcttgcgtagcgcctgggcaatggtattttttaaattgtttcccaactgatactaatggtggccattctgcaaagccacagtggaaagggcttattcaagcatcctgttgcgtgaatgcatgtcgttctttaccacatgactctggaggtttctggtattctggatgtggctgcccggttgaaggccggcccttagagtggagattatcccttgagaaagtggctggatatgtcccag

SEQ ID NO: 97104 - DNA, 434 bp, Homo sapiens
caagtggatatgtggagccttttgcggcctaaggtggaaaaggaaatatcttcacataaaaactacacagaagcattctgacaaactaccttgtgatgtgtgcattcatctgacagagttgaacctttattttgattgagcagttttgaaacactcttttgtagaatctgcaagtggatctttggagagctttgaggcctattgtaaaaaagaaaatatcttcacataaaaactacacagaaggagtctgagatactttttgcaacgtgtgcgttcatttcacctttcttttgactatgcagtttggaaatactcttttagtgtgatctgcaagtggctatttgcagtgctaggaggcatattgaggaaaaggaaatatcttcccataaaaaatacacagaagcattctgagaaacttatttgtgatgtgtgca

SEQ ID NO: 97105 - DNA, 300 bp, Homo sapiens
gagggttaagtaagataatggaggtgaaggccctggcacagggcctggaacataatgggagctcagtaggggaggtagtcattattattactatgggagcggtactgaccttgagggatcaaccacagcggctgtgatttaaaggtgccatttgttgtccaaagtgtaggcacggtatgtgttttagcacacacctgccacgtgctgcatatgcaataattatggtctaatattaccattgtgttgatgtgcatggccatgcaatggcaaagatccagaggttaacaatgccttgcattc

SEQ ID NO: 97106 - DNA, 452 bp, Homo sapiens
gaaagtaggaaacccaactaggcagtcagaaacacaagctggagctcaggaaagaggactgagtaagagacataaatgcaaagttgttggcatagaaggggaattcaaagctatataactggatgaactgattgaagggagtgagtttggtgtcctgaaaggcaagagaagtccacttgaagaggcagtagtattcaatggtgtccagtactgctgagaggtcaagtaaggaccaagaattgttgactgtatttagcagtgtggaagtcattgttttccttggcaagatcagttttactgatgctttgggagtaaaaccctgattcaattaagtttaagatgggggtgggggatgaattggagacaatgagtagagacaattattttgagatccattcatagtagaagcaggcaggaaggtggagtatatgggtacgaattcataggcagtt

SEQ ID NO: 97107 - DNA, 519 bp, Homo sapiens
cctcaggtgatccacccacctcaagcctcccaaagtgctgggattataggcatgagccaccatgtccggcaagtttctttttacttaatttgtatttatttatttatttgagaccgggtcttgccctgttgccctggctagagtgtagtggcgtgatcatgggtcactgcagcctgaacctcctgggctcaagcaatcctcccaccttagcttcctgagtagctgggactacgggctgtcactactacacctggctaaatgttgtatttttagtagagacagggtttcatcatgttggccaggctggtctcgaactcctggcctcaagtgatatgcttgtcaaagtgctgggattacaggtgtgagccactaggcccagcctcagtttcttttatggactcacttacctctgcagattggctcaaatgtcattattctcaggcttctctcctgtttacaggtgtcctgggccatccagtccagtctcatgatatttgccacccaatgtgctcatgtttc

SEQ ID NO: 97108 - DNA, 412 bp, Homo sapiens
ttagtagagacaggttttcaccatgtggtccaggctggtcttaaactcttgacctcaagaaattcacttgcctcagcctcccaaagtgctaagattacaggcatgagccatcacaccccacctctgttagcttttgtacttccagagttctagtcatgaaactgaatcaagtcctagatttctcacaacttatctggagactccatgaatcctctcttatgcttctagtccctggaattagaccaaactcttggggctctgagactctgactcttccctttccctatgctctgtatttctcctgagatgggcgcttgaacaaggaacaatttcataggaagcagcaagtatgggcatggattggccactgagagtgagagatagttaggctgttcagcccgaattgtacaca

SEQ ID NO: 97109 - DNA, 282 bp, Homo sapiens
tctagcaggatcctccccagctactcaggaggcagcccttatttgttagtctctgggtcagtgggctgctgaatacaatgaccagctggagccaaagaggacacatggcctgtgatggagtccaagtggggtagaatttcatgtccgtggttaaggtttccactcgcacataacaattcggtcaagaaggttttttttgttgttttttggttttggggtttttggggttttgtttttgtttttatttttgttttgagacagagtctcgctctgtcgcccagg

SEQ ID NO: 97110 - DNA, 515 bp, Homo sapiens
aggcagtcaggtcagttggatataggaatctgattctgcgagacagaggagcaggtcagcaatagagatatacacatgtacacataaagaaatataagtgagtgtgtgtgtgtcaattatctgcatatacttgatatttaaaaccatgaaacagtattgggagaagaaatgaggattaactgagctttgaggtgtagaaaggtttagcaaatcaggatgtcgaggaaacctcaaagagacagaaggaggtgacaacgaggaaggaagataatcaagagagtataatgtccgggaatctaaatgaacactgaataaaatgtaaagcctttcctgcatattcatttattcattcaaaaaatatcacctgacacttactatgtgtcagtccctgtggaaacaaacatggtccctgctcttatagggactgcaatccaagggggatatagataaacttgtaactggtattcctgaaagtgcagggtgttttgagagaatacactaggggcaactgaaag

SEQ ID NO: 97111 - DNA, 194 bp, Homo sapiens
gagaaagagacagaagggaaactaactcatccttggttatagttaagatataaccataagacaaggaacctaaaatcctcacttcttcatttatgttcactgagccctgtaattgacttcagatttgctgcttatctgacatctaaatgtctagtgctattaagagggtttttttttttgcaaagataacattt

SEQ ID NO: 97112 - DNA, 676 bp, Homo sapiens
agcggggtgtgagtaccagcagaagccgcctggacagcaaccggaagtgcggtggctctggtgggcgtggtggctgagtaccagcagaagccgcgtggacagcaaccggaagtgccgtggctctggactctgggctgtcgtagccaaacacgccttcttggccgagtggtggcattctgcctgccccctgtgggcatcattgagattctgctccccagcttccgcagtgctccgttttgtgatggaaagtcagcatcccttgccttaggagaaacccaggtatctggtgatggaagaacttttgagggaagcttgagactggccagtccacactctgcttaaccaagggaagggcaccacttctaccaccaggagatacctgctgtgggacacagtgctgctccagccatgcagaagctcacacaggcctgcagcagttattcatccgtgcacagctgccactggccagcagagcctgtgatggggccttcacaggtaattcccaagatcaaaacagcctcttgtacttaaaataattgctttgccaccatttccaaggtgctgcagagtgcttctgaattctgttcatttcaaagaacccacttcctctatttgaaaaacgggtattttaatgtctgccaggccacaattccatgaggcatgatggtgtgcagaa

SEQ ID NO: 97113 - DNA, 305 bp, Homo sapiens
atgacccaggggtgtcctcctgaggccctgcctggcagcatctcccacacagtaggtggctgacatggggagggcggatgggggagctgctggctcacagagcccctagcagtgtctgcaggaggtaaacaacaggaggatcgacagaaaccaacgcccaacccagccaggatgaatgcaaggcagagaccaggctcacctcctgaagcggccaacacgagttgccagggagaaacagcggggtcacggggccgcagcttggaccgtgccggcccgctctgtgggcacacctgcgatcccccacc

SEQ ID NO: 97114 - DNA, 386 bp, Homo sapiens
ggaagaattgtcagggcctggcacccatgagctgggatggcacacttgagaaagaaggaagttctgtagcttggactgtagtaatggaaacaaaggatgacagagagaatgacaagaaggcagacatccaaaggaataagcaaaggggagggtgtagttacataatgttgaggccagggtgtggtgagtgtgtgacatctatggccttgagcttctgatgtccgtgtgtatatgttaacatggtttggatgaaaataaatgtaaaggaaaggagtgattgatgaatatcccacaccccaggatttgatatgagattaatggaacatgcatggcagaagtgcaaactttctctcttggtattctccccacctgccctcattcttcta

SEQ ID NO: 97115 - DNA, 498 bp, Homo sapiens
gggtgttgcttgaccactgtagtttttctacgtagtgccaccttatttattataaaacatttgttaacgtttttagggttccagaatcctttgggaatctgatgaaagttgtaagcttttcccccacatagctaatatgtactcatctataataatggactttaggttaagaactcgagccctaaagaggttttcattccttccctaaattttaattgttactttattaacaaagaaaatactatattttacttttcgaactacattaaactcttggacaccaaagcctccaaggaaaagagaaataaaattaattccagtcttttttttttttcaaactaaattttcaactgcatttaaaaagtgaatcaaatgggccgggtgcggtggctcacgcctgtaatcccagcactttgggaggccgaggcggacagatcacgaagtcaggagatcgagaccatcctggctaacatggtgaaaccccgtctctactaaaaa

SEQ ID NO: 97116 - DNA, 566 bp, Homo sapiens
aaatgaagggacgcggctgctgggacacggcctccgtgcgctccttctgcagctccggctgcctgaataaatttaagaagggttagtgcttgccgggcttccacccggagggaggccaggctccccgcgcatgcacgcccggtgcctggctttgctgcgtgatcgatccacgggagcctctgatgtcactccctcgcggcgtggggagcgcggggagcctcggggaacccctgtccccgcaccccgccggcgtgcgctcccggcttgcttcacgcgcggggcattttggagagggggctgcggctagagacttgtccgtctaattaacctatgcaaaaagaaaatgaaatataatctatatctttatgaaaagaagggggaagcggtggtcggtgttttatccacccatctacctcttcttccccagagtcggcctggggtccgcatgcccctggagcccctgtagagtcgctgatttgcccacaagggcctcgtcctggggccaccagtggtgtcggctttgctcagtgtgtgattctccgagtggccgcctgggtttgagcaac

SEQ ID NO: 97117 - DNA, 384 bp, Homo sapiens
cagtgaaatacagtaaatcacccttatgctattaatgaaaataaatgaccgccagcccacatcaatcaagtgatatttccaaggttattaatttacatattatttgaagtccactagacaccatgactacaggtggtgattctagaaccagtgactgaaactaagtagaaatttaaatgcatgctcaggttcctaattaaaatctacatgagaaaatacatcatatgtctcaaaacacagatataaaaatagtcatttgaaacagatcttataagttgttgattgcctgtggattactgttactattgtagtttttaaaatttattttacttaaattttaaagaattctcttgagagaaagcacaaaaatcaggtagttgtttt

SEQ ID NO: 97118 - DNA, 427 bp, Homo sapiens
ctttagtgtgtggcttattcttcttatgtgtaaaatttctactacagtttataaattttattgtacatagttgccacggagccccaaaatgcatataaattaaaagccatctgctgttgtcctcttctctacagaactttcaacttttccttaccttcttgtagacatattcctccatattgatggttagctggtatttaaggaatccctaataacagttttgggttgttgatttacatacataatggaccttgcaacctctgtgtatacgtaatagttctctgggactgcatattttaacatgagattcctgaatcctactcctagaaattcttatgtctgggatggggcccaggaacttggttcaccaatcatacctaacatctttaatgagagaaataatcatatcttaagttgattttcttta

SEQ ID NO: 97119 - DNA, 403 bp, Homo sapiens
attgttattgtttacttttcctcaaaggtagccaaacagagttccctaggtcaaattttatttatagtcaacatatctcttcctctctcttcaacaacaaaagcaaaactgtggagcgtgtgatgcttttgttaaaaaaaaaaaaaagataggaagctatatgcactatatgtagaaatctatttcacagagggaaaaaagaaaaaagagtattattttacaaagcttggtggagaaccatgtggttagttaaaattatgaggcataaagcaggcaagatccagaatttagccttctggcatcattcaattagaatggaagtctgcactgatcatgatgttaaaattcaatgtaaaattcttcaaaaagaactgtctaagtacttttttggaggtttctccct

SEQ ID NO: 97120 - DNA, 378 bp, Homo sapiens
tgttgttggttgtttgcttgtttataagttacccagtctggtagtcttttatagcagcacaaaatgaagtaatatatacagcttttattgtgttgatgtaacttccttctattcttagtttgttgggggttttttaaattatgaaaatgtgttgaatttgtcaaatgctttttctgcataaattgagatgatcatgtgggttttgtatcattaattttattaatgacatttattgcattgatcaatttttgttgaaccatctttggattccaggaataaattccaatttgtcttgatgcataatcattttaatatgctgctgaattccatttgctagtattttgttgaggatttatacatcagtgttcataaggaata

SEQ ID NO: 97121 - DNA, 264 bp, Homo sapiens
tctcatatagtcaccccctctcccactagtgccgaagaggctatctgggaagctcatcatccagctcaggaagagatgaaaccaggaggcaggagaatgtcaggcatgaccccacacttgtgcaacagccacgtcctgctcctgccattagcatggctcatccgaggcccagccccaggatccatacaaagtgtgttcctgctgctggcttctcatctgctctgcttcctaagggacgtatctgttgctgcgtctgaacccacg

SEQ ID NO: 97122 - DNA, 750 bp, Homo sapiens
aaatggggaagttgtccccaccagctcttcagtttctgttctgcactatgtgggcctgggcagtcttaactggttccaattttagcaagttccattaatactgctcaaaggatttacatatcttctgttttacagtactggatagggggaacatttcccagtcagataaaatgtctcttcccataatgcagtcaggtaaaagagataaaaccatttcacatgaagtatgttcaaatatggcagctttcataatcctaacaaccgttacacttttatgttctagtcccaggaatttccccttttcatccccagatcattttaccctttcttctgcaaaaggctttgggtccccagcctggagtcccaccaggagaccctggcctctctcttaattgttaccttgattaaccagtctaacagggtaattatagatggggtttctcattttaatctttatcttcttgtctttaaaagttctccaaactgggggaaatgcagcaaactggtttgggcccttaaatgttgagagatcagccaggggtccctttcctccactcagtctttaataatgttgtattaagacttttgttttaaccccatcaatttctactttattcattccattttttaataaccacctaaatatgtccaccctcctggggtgagtcccatggctctcccctttctttttcctcttactttcattcctatgaatgttttctgtattcatcttatttcttacaaaccatt

SEQ ID NO: 97123 - DNA, 766 bp, Homo sapiens
aggctgcgctgtgggacttccaggagtccgagtcccatgctctgcctctgaggctggtggctggggtaaagctgggcagggctgagccaggcagggctgtactcaggctccccaatggtaggtacaagcaacggccataacatggatcagaaggcagtgctcaggccactggggcaatgcttcaaggaggagcataacaacttattttgtgccaaagagtcagcatgggaaaagagaagcagtttgtgttccacaacctagcagatggtagtgacacctgcctcactcccacacccttgacccagcaaggctccctcccataacccactcctggcagcaagctgaaacagtaagtcaagacacaagcaatctgtcttcagattacaaaactgtcctatgccacaaaactccctgccagggacaaaaacttggactcccaggccacacccctccgactccagtcctgcatcctgcagtgggactgcccaacgcttatgcccgtgtttcaaacccatgctacactcatctctcagatctggccatggggctcttcctcctcttaagactagattgcaaatctcattcttgagattctctaaaccgatgactaatgcttgttctggatgacagatttccgcacagccccctatgagttaagatcaggaatgatctcctattagcatcaaggtctgggagcatgtgcaaagtacttcctgctgcctcttctcacagtctcttcactgatcccagaattgtatcagttgga

SEQ ID NO: 97124 - DNA, 231 bp, Homo sapiens
catgaacaaaggaattagggcaacatttaaaagctggttaaggcaagaaaatggattctccctctagagattccagaatgaaacagccctgctgacatcttgatttttgcctagtgggactcgttttagttttctcatccccagaacagtaacataataaatttgttttcctttaagccaccaaattatggtaatttgttatgacagtcatagaaaaataataacaccacc

SEQ ID NO: 97125 - DNA, 413 bp, Homo sapiens
tcaaataccttctacatagcccttacatcacagagggcctggaagaagtgttctccagtggagggctacttttcccccacagcatatggcaaaaagggggttaagccagagactcatgaagactctggttggagggcccagaatgaacccattatccctgggcataagccctgagagggagaaaaccccaacagcagtcacgagaaaaatgacgattttggcaaccgttccccaagttcttacctccccaagaggaacagtggacaatgatgcggacacaatagtaaagaagacaggacaccagcagcgcccagcaggagaggggctgaccttccaaattcactgctgctccgagttaaggagccctggaccgggggctactgaacacttaaaaaacaactcttttgaccagg

SEQ ID NO: 97126 - DNA, 312 bp, Homo sapiens
atatgtttctggtttctcttcaagtcatataaatctttcaccttttactattttagactttttctatccccattctatttcattcaagtgtattggatcatattgatgacagacaaatctcagtgtggtcaaactactgaataccaatcaatatcatatggaaaatttgttacactttaagagtttcgtgtcacaaacatacatcttaattttcccattaattattctaaaacttttcatatttatatatgcttgtgtacctttgacttgttctgaatcctaaaatggtatattaaagtcctgtatcatatg

SEQ ID NO: 97127 - DNA, 595 bp, Homo sapiens
atggtggtgcgtgcctgtggtcctagctacgcgagaggctgaggaaggaggatcacttgagccagggaggtggaggtttcactgaaccatattcacgccactccactgcagcctgggcaacagagctagaccttgtctcaaaaaattaagttagttaaattaaacataaagttgcattgtatctaagaaattgggaaagcaggaaatgcttctgtttttcttttgagttgaacaatgagaacacatggacacagggaggggaacatcacataccggggcctgtcaggggggtgggaggctgggggagtgatagcattaggagaaatacctaatgtagatgatgggttgatgggtgcagtaaaccaccatggcatgtgtatacctatgtaacaaacctccacgttctgtacatgtatctcagaacttaaaatgtaataataacaataataaaaacgacaaaaaaaggaaatgcttcttgttagaacagattacataacctcattgctttttataatagcctataataacagaatatccacaaggtggcagtaatatatcagtttcatcctctgaaattaaaacttttgcctattca

SEQ ID NO: 97128 - DNA, 275 bp, Homo sapiens
tggatgagatgctgctcttttgttattcagacaaactgattgacgtgagtcttgtgctgtgaaatactgaagagctttccgagaattcacacaagagatttctggagcctgtcacatcctccctacctgtcctcatctcagctctctagaactccttgtagcctaatcagtaatgtcatcaaacctcaacaaaccattactctggtatttcctgttacaccatatcttagtttgctagggctaccataacaaaataccaaagactgggaaacttt

SEQ ID NO: 97129 - DNA, 214 bp, Homo sapiens
ggtccacttgaatctaagcctgagctcccatcctgccatgctggtgagaaattctaccttagttatcattgagcatttcctctccatccagggttgtacaaagtttctagggcttgaattattatagaagtacctggaattatctcaaattacttggtcatctctccacattgatttggtgctgggattcccttttgtgccatcttcacttcag

SEQ ID NO: 97130 - DNA, 735 bp, Homo sapiens
cctaaacacacaaacaccctcatcccttccctgctttaggttcctcctagcacctgtcactgttttaatgtagccatttttgaaaaacgtattcttatttattgtctgtctctacatcccctaactagattatatactccatgagggctagaattgttttctccaatgctgaattccagtgctaatagcatctggcaaataataggcacaaacaaatatttcttgaatagattatcgaacctactttccagcttttctatgtctttggaaaagcctgctcacagtaagatagagaagtgactcctttagagagtggaaattaggaagataagaactaatatgccaatttacatgatttcttaaccaattaacactagcttcatgtaatgtgctgtttttcaaatgtttctttaaagaattcttaggccaaaggggaaataaagcatttcaactagagaatatattaaaatacaatgactcaagaactgaagaaagtggaaaataaaataagtaaaggtgaagaaagcatttaagtaataaaaataaaaatataagtagaagtgaatcatacaaacaggaaagatagaattcataaacctatgtggcagttgcttaataaaactaatgatgccatgatggcaaatttaaataaagtgaaataacctcagatgtggatgaagttaaaatgactagactttgcataaatttatggtaaaagaattgaaattctagatg

SEQ ID NO: 97131 - DNA, 556 bp, Homo sapiens
ccaggatggtctcgatctcctgacctcaggtgatctgcccgcctcggcctcccaaagtgctgggattgcacgtggcctcaaccatattactgtgtattagttcagaaagtgctttcattagattcatttgatttaacaatcaaatcttgaattccttcaactaaaccaggattctaattaaaattgcagcttgcagggaatgcaactgtcagatttaaaccattctaatatcccattttagaactaaagactgtctcctatgcagataatggggctatgacaacacaggacgacacagacaacaggataagacagtgacaacaagggctatatctttttaagcattcccagcttctagtacaaggaatggtcttaataaacatctgttgactagatggagatacaaagtcttggctgacccccaacaccagtctccttacttcaactgttccctatttgctctgacgtacactacctagtgtctctcccacaatccagccctgttggcatggggtgagaattttcactggtatcttcttgacaggcagaatctttt

SEQ ID NO: 97132 - DNA, 181 bp, Homo sapiens
ccccttggccgagaggagggttcattcagtcttttgggggacttagaatattacttttggtctacaccagggaggacatggaagcttcctggctgttttctatacattgccctgtgcatgtcttccatctggctattctagagttctttccttttataataaaccagcaatctagtaagta

SEQ ID NO: 97133 - DNA, 387 bp, Homo sapiens
gtggtgggcgcctgtaatcccagctactcgggaggctgaggcaggagaatcgcttgaatccaggaggcggaggttgcagtgagcgagatggcgccattgcactccagcctgggcgacagtgcgagactctgtctcaaaaaagaaaaagttaatgagcaaaatattaatgatgaaggtagtaaagcaaatcagcttaaccatgactgtcacattattatttctaattggtttattattttgttctccctgcctgccctccaaagctcccttgtgtatttttgtcagcagtcaacctgggaggtagcagctgtttgggttttaggcttagaagtaggagggaattttccccctgtgggtgtggttggtttggtttttattttctttttc

SEQ ID NO: 97134 - DNA, 632 bp, Homo sapiens
aaccaggcctagggggtgggggtgtgcctggatgtgtgttgcgggggtctgaacccttagttaggaccgggggccctcctttccacttcgtgcagtccctggggtctggggcatcctagccatgcgtggggcctccctgctgggattggagaccccctgacagctggggctggtcccagcattttcgctcttcccccagaaggactcagatgcagggtcttctctgctccccgtcacacagagggtggcacccccgatgggaactctcatttatcaccaaaccagaagataatggagaaactgacagagaagggctgcaagcagctaccgcagggcggtgtgtggatgcagatgggatgggcagatggaggcgggggccagcatcgctgccttcttgcccctcccagaggaccccaggtccccagctcgggcgccccaccagactgctttcattaaggttttctatagataagatcatgtcaagacaccctcagaccacagggcggcgccaccagcccggccgagtgcagctggagcgccgacgtccccgaggatacacagtgctgaggcagaacgcagaagtcaatgacaggattctatttgcaaagctgtattatgaagctaaaggaatc

SEQ ID NO: 97135 - DNA, 1354 bp, Homo sapiens
taaaaaaacggcagcgtaatacaatatttggacacgctatactatgggctttgaagaacgcctgtccagaacacccaacaagctccattatgtcaaacgctcccgcgcctctgtgatgtcaccacgacgcgctgggcgctctgcgacttggcagacgtcgtgcgtcattaccaacgaggcgcaggggtcaggacgactctcggcagcgccattgcgcgccctctagtggcagccggttttgaggccggcctccggctttgaagttcctcaccgcgtctccttccctctccccaaagcctggatcaccgcccagcgtcaggcgaggggcgacgtctcgaggtaaaacggaggaggtgcgggacgcggagactgcgcgggcccggtagccctggagaggccgaggctctaggccgcgaggggcgggtgcaatggcggaggaacaggtgaaccgcagcgccggcctggcccccgactgtgaggcctcggcgactgcagaaactacggtttcctcagtggggacctgtgaagccgctgccaagtcaccagagcccaaggactacgacagcacctgcgtgttctgccggatcgcggggcggcaggacccgggcaccgaactcctgcactgcgagaatgaggacctaatttgcttcaaagatatcaaaccagcagcaactcatcattatcttgtggtgccaaagaagcatattggaaactgcagaactctaaggaaagatcaagtagaactggttgagaacatggtaactgttggaaaaaccattcttgaaagaaataatttcactgacttcacgaatgtgaggatgggttttcatatgccaccattctgttccatttcccacttgcaccttcatgttctggcaccagtggatcagcttggcttcttatccaagttggtttatagagtcaattcctattggtttatcacagctgatcacttgattgaaaaactaagaacatgaaaatgtcaagagtggaagatttttctaatcttggttcagcatgaagtggtatttaggtcccttttaagtctaattgcaattttaagatttgttgggttttatgagaggctgttacttagtggccttaaatcttttctgaatgtctgtttcctaagatctgtgatacagttatgtgaatattttgttactgacttgtttcaatggttacttgtataaggattttatatatatgatactatagataaaatcctatttaagacaaattctgttaatcaacaagggctctgtatttttttaagttaaaatattttcatttctcagtaagtagtcagttataatagtgatttatttatgaagaataaactactatagaaagt

SEQ ID NO: 97136 - DNA, 3899 bp, Homo sapiens
taaaaaaacggcagcgtaatacaatatttggacacgctatactatgggctttgaagaacgcctgtccagaacacccaacaagctccattatgtcaaacgctcccgcgcctctgtgatgtcaccacgacgcgctgggcgctctgcgacttggcagacgtcgtgcgtcattaccaacgaggcgcaggggtcaggacgactctcggcagcgccattgcgcgccctctagtggcagccggttttgaggccggcctccggctttgaagttcctcaccgcgtctccttccctctccccaaagcctggatcaccgcccagcgtcaggcgaggggcgacgtctcgaggtaaaacggaggaggtgcgggacgcggagactgcgcgggcccggtagccctggagaggccgaggctctaggccgcgaggggcgggtgcaatggcggaggaacaggtgaaccgcagcgccggcctggcccccgactgtgaggcctcggcgactgcagaaactacggtttcctcagtggggacctgtgaagccgctgccaagtcaccagagcccaaggactacgacagcacctgcgtgttctgccggatcgcggggcggcaggacccgggcaccgaactcctgcactgcgagaatgaggacctaatttgcttcaaagatatcaaaccagcagcaactcatcattatcttgtggtgccaaagaagcatattggaaactgcagaactctaaggaaagatcaagtagaactggttgagaacatggtaactgttggaaaaaccattcttgaaagaaataatttcactgacttcacgaatgtgaggatgggttttcatatgccaccattctgttccatttcccacttgcaccttcatgttctggcaccagtggatcagcttggcttcttatccaagttggtttatagagtcaattcctattggtttatcacagctgatcacttgattgaaaaactaagaacatgaaaatgtcaagagtggaagatttttctaatcttggttcagcatgaagtggtatttaggtcccttttaagtctaattgcaattttaagatttgttgggttttatgagaggctgttacttagtggccttaaatcttttctgaatgtctgtttcctaagatctgtgatacagttatgtgaatattttgttactgacttgtttcaatggttacttgtataaggattttatatatatgatactatagataaaatcctatttaagacaaattctgttaatcaacaagggctctgtatttttttaagttaaaatattttcatttctcagtaagtagtcagttataatagtgatttatttatgaagaataaactactatagaaagtactttgtgggaacctttattactgtgaaggagaaaaatagctatttcttgacagttctatagttttacacataaattttcaaaataaagaataccatactacacaatgatctctgattttgctgagggaaggaattatatatgtgccactttttcctcaaatttcagatgccagttttcactttttgaagcattgcatctttttaataaatctatcctgaaagctatataatatatataatttatatcaatgaatttacaataactatcaaattggctatcagaattcactgtaatggaattttgcctctaataacataaagggggaagaaacataaagtggttctcttaataaaactagcagaaaatgttgctttatggcatgtttttgtatcaaagagaaatcagaggttaaactttgcttttatcatgaaaagggcctgatttgaaggtagagataggcttagatgagaaaaattgataacgcaatgttaatactattgatatttcataggtatattttgttagaaattggttttttggtgctaatctataggcacaatagtgaatatgaatgaagagtaggtgctgcaagttaatcctacattgtgccagtgtatattagtaccatgtaaatgaatatgaataaatgaacatgaggattaacgaactgttgaaaataggctgagatactagttttctttcttttttagagggggcatgatattaaagatagttttaagtaacaaattacttattacaaagttacaacatgtggaatcaatactgttttatttgttcattaatttattcattcagcaaacatttgttgaacatttaatgtgtaccagatattgccaggatcaggaaataaagaactaaaaatggacattcagactgcaattgctagtacaggggtcaaacaaaatcagtgattagaatttagtgcgttaagttccctgatgccttcacagccagaagaggctgtgaagggataaacacttctgagagtgggtggtagtagaactgagtattcaagactgaatgttaggcaggtagacagtgactggttaagctgagaaacttacaagtattttcgttgagttctgcttccactattatttactttacaatggatatgaagttcagatttcatcttatttactgaaggtggagaaaggatgtggaagtaggggttatgggctctcaaaagtagatttagagagatttttttatcactgttttatgatatagttcactgagcacttacatagattaacagttacaagtttccataaatcagttagaatatgactagcttcagggaaggaattttcaacaactgcaatctttgattgttttactgtgggaacttgcagtgatataattgacaacattatttaacaataataggtaaagtaggccgggtgtggtggctcacgcctgtaatcctagcactttgggaggccgaggtgggtggatcacaaggtcaggagttcgagaccagcctggccaatatggtgaaaccccgtctcttctaaaaaaatacaaaaattagccgggtatggtggcgcatgcctgtagtcccagctactggggaggctgaggcaagagaattgcttgaactcgggaggcggaggtcgcagtgagccgagatcgtgccactgcactccagcctgggtgacagagtgagactttgtctcaaagaaaaaaaaacaataataggtaaagtatttaaggaattctcagatgccttatggacctcttcaagaatgtggttagccaattgattcaacttttataggtttatatgctctcatgtaaacctatttgtttccgagatcagacgagatcgggcgcgttcagggtggtatggccgtagacaacctatttgttaaaaacccttggaaacacatcttttagtagaggttcttatttacttataaagattaataatcaaattactacaattaatatccatttagccttttcagtagtctaaatatttggtaactccctagccatctataacactagttcaaaacaaggctaattcataacctgtcttaaaaatgtttgaagtggtatcaagagcattgtttatgcatgttgtgatactatttgtggaactgtttaatgagctatttcaaactgctagaagaaaatgaaataaaaatggaaaaatactgtcaaaaaaaaaaatataaaattcaaatcaatgtcaattggtaaacttatatgcctgttattagctcctgtatagtttagatataccagcgattttcataatattgttatgctacatgtactatcttttatttcctatatttattatgtttacgtgcctttaaattaatcttgattttctttgtactctatatacatgcttcatgtcaatacctacgttatcatctatctcactctcttatgctcactcctgctatcattgttttattctctatattaattttcttcacttttatgtatctcatccttatctatcataatcttctactttcattttgtacaatatcgaccttcatccc

SEQ ID NO: 97137 - DNA, 3547 bp, Homo sapiens
taaaaaaacggcagcgtaatacaatatttggacacgctatactatgggctttgaagaacgcctgtccagaacacccaacaagctccattatgtcaaacgctcccgcgcctctgtgatgtcaccacgacgcgctgggcgctctgcgacttggcagacgtcgtgcgtcattaccaacgaggcgcaggggtcaggacgactctcggcagcgccattgcgcgccctctagtggcagccggttttgaggccggcctccggctttgaagttcctcaccgcgtctccttccctctccccaaagcctggatcaccgcccagcgtcaggcgaggggcgacgtctcgaggtaaaacggaggaggtgcgggacgcggagactgcgcgggcccggtagccctggagaggccgaggctctaggccgcgaggggcgggtgcaatggcggaggaacaggtgaaccgcagcgccggcctggcccccgactgtgaggcctcggcgactgcagaaactacggtttcctcagtggggacctgtgaagccgctgccaagtcaccagagcccaaggactacgacagcacctgcgtgttctgccggatcgcggggcggcaggacccgggcaccgaactcctgcactgcgagaatgaggacctaatttgcttcaaagatatcaaaccagcagcaactcatcattatcttgtggtgccaaagaagcatattggaaactgcagaactctaaggaaagatcaagtagaactggttgagaacatggtaactgttggaaaaaccattcttgaaagaaataatttcactgacttcacgaatgtgaggatgggttttcatatgccaccattctgttccatttcccacttgcaccttcatgttctggcaccagtggatcagcttggcttcttatccaagttggtttatagagtcaattcctattggtttatcacagctgatcacttgattgaaaaactaagaacatgaaaatgtcaagagtggaagatttttctaatcttggttcagcatgaagtggtatttaggtcccttttaagtctaattgcaattttaagatttgttgggttttatgagaggctgttacttagtggccttaaatcttttctgaatgtctgtttcctaagatctgtgatacagttatgtgaatattttgttactgacttgtttcaatggttacttgtataaggattttatatatatgatactatagataaaatcctatttaagacaaattctgttaatcaacaagggctctgtatttttttaagttaaaatattttcatttctcagtaagtagtcagttataatagtgatttatttatgaagaataaactactatagaaagtactttgtgggaacctttattactgtgaaggagaaaaatagctatttcttgacagttctatagttttacacataaattttcaaaataaagaataccatactacacaatgatctctgattttgctgagggaaggaattatatatgtgccactttttcctcaaatttcagatgccagttttcactttttgaagcattgcatctttttaataaatctatcctgaaagctatataatatatataatttatatcaatgaatttacaataactatcaaattggctatcagaattcactgtaatggaattttgcctctaataacataaagggggaagaaacataaagtggttctcttaataaaactagcagaaaatgttgctttatggcatgtttttgtatcaaagagaaatcagaggttaaactttgcttttatcatgaaaagggcctgatttgaaggtagagataggcttagatgagaaaaattgataacgcaatgttaatactattgatatttcataggtatattttgttagaaattggttttttggtgctaatctataggcacaatagtgaatatgaatgaagagtaggtgctgcaagttaatcctacattgtgccagtgtatattagtaccatgtaaatgaatatgaataaatgaacatgaggattaacgaactgttgaaaataggctgagatactagttttctttcttttttagagggggcatgatattaaagatagttttaagtaacaaattacttattacaaagttacaacatgtggaatcaatactgttttatttgttcattaatttattcattcagcaaacatttgttgaacatttaatgtgtaccagatattgccaggatcaggaaataaagaactaaaaatggacattcagactgcaattgctagtacaggggtcaaacaaaatcagtgattagaatttagtgcgttaagttccctgatgccttcacagccagaagaggctgtgaagggataaacacttctgagagtgggtggtagtagaactgagtattcaagactgaatgttaggcaggtagacagtgactggttaagctgagaaacttacaagtattttcgttgagttctgcttccactattatttactttacaatggatatgaagttcagatttcatcttatttactgaaggtggagaaaggatgtggaagtaggggttatgggctctcaaaagtagatttagagagatttttttatcactgttttatgatatagttcactgagcacttacatagattaacagttacaagtttccataaatcagttagaatatgactagcttcagggaaggaattttcaacaactgcaatctttgattgttttactgtgggaacttgcagtgatataattgacaacattatttaacaataataggtaaagtaggccgggtgtggtggctcacgcctgtaatcctagcactttgggaggccgaggtgggtggatcacaaggtcaggagttcgagaccagcctggccaatatggtgaaaccccgtctcttctaaaaaaatacaaaaattagccgggtatggtggcgcatgcctgtagtcccagctactggggaggctgaggcaagagaattgcttgaactcgggaggcggaggtcgcagtgagccgagatcgtgccactgcactccagcctgggtgacagagtgagactttgtctcaaagaaaaaaaaacaataataggtaaagtatttaaggaattctcagatgccttatggacctcttcaagaatgtggttagccaattgattcaacttttataggtttatatgctctcatgtaaacctatttgtttccgagatcagacgagatcgggcgcgttcagggtggtatggccgtagacaacctatttgttaaaaacccttggaaacacatcttttagtagaggttcttatttacttataaagattaataatcaaattactacaattaatatccatttagccttttcagtagtctaaatatttggtaactccctagccatctataacactagttcaaaacaaggctaattcataacctgtcttaaaaatgtttgaagtggtatcaagagcattgtttatgcatgttgtgatactatttgtggaactgtttaatgagctatttcaaactgctagaagaaaatgaaataaaaatggaaaaatactgtcaaa

SEQ ID NO: 97138 - DNA, 3257 bp, Homo sapiens
taaaaaaacggcagcgtaatacaatatttggacacgctatactatgggctttgaagaacgcctgtccagaacacccaacaagctccattatgtcaaacgctcccgcgcctctgtgatgtcaccacgacgcgctgggcgctctgcgacttggcagacgtcgtgcgtcattaccaacgaggcgcaggggtcaggacgactctcggcagcgccattgcgcgccctctagtggcagccggttttgaggccggcctccggctttgaagttcctcaccgcgtctccttccctctccccaaagcctggatcaccgcccagcgtcaggcgaggggcgacgtctcgagaatgaggacctaatttgcttcaaagatatcaaaccagcagcaactcatcattatcttgtggtgccaaagaagcatattggaaactgcagaactctaaggaaagatcaagtagaactggttgagaacatggtaactgttggaaaaaccattcttgaaagaaataatttcactgacttcacgaatgtgaggatgggttttcatatgccaccattctgttccatttcccacttgcaccttcatgttctggcaccagtggatcagcttggcttcttatccaagttggtttatagagtcaattcctattggtttatcacagctgatcacttgattgaaaaactaagaacatgaaaatgtcaagagtggaagatttttctaatcttggttcagcatgaagtggtatttaggtcccttttaagtctaattgcaattttaagatttgttgggttttatgagaggctgttacttagtggccttaaatcttttctgaatgtctgtttcctaagatctgtgatacagttatgtgaatattttgttactgacttgtttcaatggttacttgtataaggattttatatatatgatactatagataaaatcctatttaagacaaattctgttaatcaacaagggctctgtatttttttaagttaaaatattttcatttctcagtaagtagtcagttataatagtgatttatttatgaagaataaactactatagaaagtactttgtgggaacctttattactgtgaaggagaaaaatagctatttcttgacagttctatagttttacacataaattttcaaaataaagaataccatactacacaatgatctctgattttgctgagggaaggaattatatatgtgccactttttcctcaaatttcagatgccagttttcactttttgaagcattgcatctttttaataaatctatcctgaaagctatataatatatataatttatatcaatgaatttacaataactatcaaattggctatcagaattcactgtaatggaattttgcctctaataacataaagggggaagaaacataaagtggttctcttaataaaactagcagaaaatgttgctttatggcatgtttttgtatcaaagagaaatcagaggttaaactttgcttttatcatgaaaagggcctgatttgaaggtagagataggcttagatgagaaaaattgataacgcaatgttaatactattgatatttcataggtatattttgttagaaattggttttttggtgctaatctataggcacaatagtgaatatgaatgaagagtaggtgctgcaagttaatcctacattgtgccagtgtatattagtaccatgtaaatgaatatgaataaatgaacatgaggattaacgaactgttgaaaataggctgagatactagttttctttcttttttagagggggcatgatattaaagatagttttaagtaacaaattacttattacaaagttacaacatgtggaatcaatactgttttatttgttcattaatttattcattcagcaaacatttgttgaacatttaatgtgtaccagatattgccaggatcaggaaataaagaactaaaaatggacattcagactgcaattgctagtacaggggtcaaacaaaatcagtgattagaatttagtgcgttaagttccctgatgccttcacagccagaagaggctgtgaagggataaacacttctgagagtgggtggtagtagaactgagtattcaagactgaatgttaggcaggtagacagtgactggttaagctgagaaacttacaagtattttcgttgagttctgcttccactattatttactttacaatggatatgaagttcagatttcatcttatttactgaaggtggagaaaggatgtggaagtaggggttatgggctctcaaaagtagatttagagagatttttttatcactgttttatgatatagttcactgagcacttacatagattaacagttacaagtttccataaatcagttagaatatgactagcttcagggaaggaattttcaacaactgcaatctttgattgttttactgtgggaacttgcagtgatataattgacaacattatttaacaataataggtaaagtaggccgggtgtggtggctcacgcctgtaatcctagcactttgggaggccgaggtgggtggatcacaaggtcaggagttcgagaccagcctggccaatatggtgaaaccccgtctcttctaaaaaaatacaaaaattagccgggtatggtggcgcatgcctgtagtcccagctactggggaggctgaggcaagagaattgcttgaactcgggaggcggaggtcgcagtgagccgagatcgtgccactgcactccagcctgggtgacagagtgagactttgtctcaaagaaaaaaaaacaataataggtaaagtatttaaggaattctcagatgccttatggacctcttcaagaatgtggttagccaattgattcaacttttataggtttatatgctctcatgtaaacctatttgtttccgagatcagacgagatcgggcgcgttcagggtggtatggccgtagacaacctatttgttaaaaacccttggaaacacatcttttagtagaggttcttatttacttataaagattaataatcaaattactacaattaatatccatttagccttttcagtagtctaaatatttggtaactccctagccatctataacactagttcaaaacaaggctaattcataacctgtcttaaaaatgtttgaagtggtatcaagagcattgtttatgcatgttgtgatactatttgtggaactgtttaatgagctatttcaaactgctagaagaaaatgaaataaaaatggaaaaatactgtcaaa

SEQ ID NO: 97139 - DNA, 557 bp, Homo sapiens
tgttcactctgctcccaaccccttggaggtaaccaacttcattgctttctaattaatctttcttgaactccttttgtaaggataagcaggtaaattcatgctttcttgttttcctctttctttcttacagaaaaggcacatactctgtgtattgttttgtactgtgcttttttcagttaacaatatctcctgaaaattctccatataagttcatattgttctttttctttttcatagctgtgcaatactccatatgtgtatgtatcatagtttttttaaatctcttatgcccaacatttggatagcttccaatattttgccatgatagataatgctgcaataaatagcctcttccacacatgtatttccatatgttggagagctatcttcacagtaaatttctagatgtggagttgctggataaatagctaaatgcatatgtacttttattagatattgaaaaactcccctccatagagactgtattatttcttgtgtccctcctgcaatccatttgagggaatgaaatctctactaccttacaagacaatgtattg

SEQ ID NO: 97140 - DNA, 282 bp, Homo sapiens
taagaaataaaatctcagaagacctgagctctcctgtcagcatgacttgcacttgtacttttcctttttgtagagaagctaaattataatcagaaagttgttttggtgagcttggaatcagaaaataggagtttaagtcatctgttcaacatgcagctttcctcagctgtgatagctttttcctgctgtccagtcttcatgtggagcctggtcaatagcaccagaattctaagtctgctggccaaggtgctgcctcctgcagagagagaaagcccatcaaag

SEQ ID NO: 97141 - DNA, 375 bp, Homo sapiens
gagctgggacaccacctggcactgtggtggcagtgggggtgacactcagacaagggccatcgagggcccctggaccagaaagcgaagagggcgttgggggcaggaggcctgtggggccatgtgtgggggccgtctgggtggcgggagctgttggggcggggctgagcgccctcagcagcccactggagaaagcgctgctggggtcctcgtgtggggcccagggcccgacgtggaagcaatggagggctgcagggggtggcagtggggatgaatgagtaaggacagagtgcagcctgggtctcagacagggggtgggggacaggccacagagattccctatctcagcagagaggagacaggctcaggctgccacgc

SEQ ID NO: 97142 - DNA, 466 bp, Homo sapiens
cataaattatattgtggaaaggagagaaaccagccgcttagtttggactgtggttgatgccaatgtgcagactctcagctgcaaggttactaagcttcttgaaggcaatgaatatactttccgtataatggcagtaaacaaatatggtgttggtgaacctcttgaatctgagccagtagttgccaagaatccatttgtagtaccagatgcaccaaaagctccagaagtcacaacagtgaccaaggactcaatgattgttgtatggaaagaccagcatctgatggtggtagtgaaattcttggatatgttcttgagaaacgggataaagaaggcattagatggacaagatgccataagcgtctgattggagagttgcgcctgagagtaactggactcatagaaaatcacgattatgagttcagagtttctgctgagaatgctgctggacttagtgaaccaagccctc

SEQ ID NO: 97143 - DNA, 211 bp, Homo sapiens
ccccaactgttataaatgcaattcaaatggaaaaaagtgtagaacaactgctgtaggcttaggatcccagaggctgggccaatcattgtgtcaacaaatactcagcaagctcccgctgggaggccattcagggtggctgctgagagcaccaactaccaaggatctggcaccagccaagcctgatgtgactgctggctcagccagttgctgt

SEQ ID NO: 97144 - DNA, 354 bp, Homo sapiens
ttctatttgtgaagtgagcccaggcaggagagtcaaatcaggtatttgacaggggcatatgtcaaaatcacaccttcaaaaaaattcagggatgagattaccaatccctcacatgtcctgtttctaggtctgagagtcaacatgtcttgtatgtttggtgaagtacatgagtcaaaatctcaactgtgaactggatctgtgcagcagcttctcaatgttttttgggcattatgccccttagataagtcataaccagccatgtgtgctaaattttggtttgagggtcaccaaatccatgcataacaaatccatgtatgagagtcaacattgcaactcttgactgcctctagatat

SEQ ID NO: 97145 - DNA, 437 bp, Homo sapiens
ggccctgacctgtgtgctttcagcctctgagccgcccctctcctgactgcttacaaagttatatcgatactgaaatctgaacattgaaagttcactaggagaatgccatttccagggatgttactgtgaaccttccgtaaaggaccttatgtaggataatgaattgccttttaatgcaggtaccaaacaggctccctgggataattcattccatataaactttttaaaaaaatgttcccaactagctatcctataattctctttctgctaagagaggtgctccgttctcctttgcgctttagtgatatgccgtgtttgctttgcatgccccttggcttttcagaagaaaactgcgtttgcagatgcacttggagtacaacgttctttttcctatgagtgtatttatggtgaaggctccattggaggagatatgctca

SEQ ID NO: 97146 - DNA, 480 bp, Homo sapiens
cagtgcattaagcagcctggtcaggtactgctgagtcaacctcgttctgggactctccttgcttgtgaatgcaacatgcaggccttgagatgtcattattccgacgttatgataaggcactcacttatgctgctttacaggagaaagaaccagagtttaaaagccatagccaccgatttatattatgctactgtaacactcttgaacagaatctcattttaaaagacagtgcctgcaagagaaaatcttcactggcttaatccatgattatgaatttggtggtcatttgaaaggtgtctcttctttttttttttctgttattttgttttaccatcaatagtttaattttcattagaaatcacagtcttggtactaagtcagcaccaatttatttgtagcacaaagcgcaaaggtgatcttctttttttttgtttgcttgttgtttgtttgttttttttttgagacggagtctcactctgt

SEQ ID NO: 97147 - DNA, 271 bp, Homo sapiens
aatttaattctataatatataagcagatacttttctctagattcacagaataaacacaggaaatatcacacaaatctgatgactgccaagaaagggcatgattttccctaaactgcccctcacatcattgtagcatttggaaaataacctcagagagcccaggcatttgcaaacacaaaattatacaatgaagataccactacaacccccaagggtcatgtgaaactgctaaggaacataagcttacaaactaaaattatgattattgtgg

SEQ ID NO: 97148 - DNA, 298 bp, Homo sapiens
ggcccggcggcctgcggaagctcggcggcctggcctggcctgctcgcggggaggtgcgcagactgcgcgggggcgtggcctgcgcccctgactgcgctgtcggtccggcctttgatgaggtggccgccgctggctccctgggccccagcctggttcccgcgcgggccgcggctgccttccagacgcagggcatgcgacctgttggagtgtgaaattctatgggccgggttcctccccagagcggttttatttccgactggactgtgctgcgggtctcagaggccctctggtccgttca

SEQ ID NO: 97149 - DNA, 442 bp, Homo sapiens
tttgttacaccattgaaatattaatatgattatcatttcagcaactttgattaattttataaaaataagggaaatataaagattttaccaaatctttcagaaacagataattgccatgtaatatagctattctgagacttagaactgattcactcttcaactcattctataggatggcaaaatgttgctgttgctttcaaaagaagatagcctgcaaatgataactaaaggcaattttcacttatagacaggtatcaaagtcttaaataaaataatagcaaattgaaatggcagtatataagtcatcatacatcatgaccaagtgagttttcttttaggtttgcaagtgtggttcaatattaagtgataatggtttggctctgtgtccccacccaaatctcatgttgaattatgaacttcagtgttgaaggaggggcctggt

SEQ ID NO: 97150 - DNA, 649 bp, Homo sapiens
ggaagctccatgtgcatggctggggcttatgattggtcaggaggcagctttcttctggagaaccctcaaagtatctgtaggtcatctttctggtaccacttagtttctctagagaaaactctttaaacctccttcaggggttgaaggaaagaggggtggagataggataataggcctgacttttgagagtgcagtagtaaagacaggaaggtttttcgactgtgcagtgtgcagcatgcagattctgactgttttcaggacagaattttacccccaccctctattattcctgaagtccctaacagtctctggttctgtttctccaggcaataagcctcccacctcctgtgatggggagcaggctggggctcaggagtgggaagcagaggtggagggcagctaagccctccttattcagtttttcaaccactcttaagttccagcctttggcctctaaggtacctggggtgcccaattcctgagcttcttttggttctggggtaaggatggtctcagtcttcattgcttcttccttcagcaggcacataggtttcagctttctgtactctaccagtccagccactgttcctccgtgtgctgtctttcccgcagaattttgctaatggctctcttccactcttgagagatt

SEQ ID NO: 97151 - DNA, 1299 bp, Homo sapiens
caagaaaatatttcttaatgttagctgtataaaacaaaaatttgttctgataaaatttttaatatgggcctttatttgccaataaaatcctttgtaaatgtgagctttattaaactgtttaaatagacaaagttaaagcttaggatagggaatatatatgtatgtgtatatgaaatgatgtcttcgagttttaacttccagcctgagatggcctagatttggtgtgttagtttgtttcactgaagtcagtgagataggagtctagctgggtacatgcttaaaaagctggaagtgaagtgggtggcaagtggcagctccctctttcatgtagttttccataatgttcatatagtttccttatggtctaagtgttacaactggttttcaagttgttatattgaatattcctttttggaattcagggttgaatcactttgagggggaagggaagcaagggcaagagactttattttaaccagatgcggtcttatgacctcaaagatgtgctctagaaagaaaataacaaaaagtgtacctgtgaacatattttttgtcttggtgatattatgcaacacagtgttcagaattgcaaaaaaatttaaaaattgatagttttatcaatggaacagagagatgtgtttttggctaaaattattttttgtaagttatttggttatttcattttatattccctttcccatagctttgtacacacctcatacttaaaaccaagtgagaggcctcttttcagatctggtttatttttggaatgcctgagtgtgtttccagattggggggggagaggtggtgttttactttttgacatgctcttagcatgttttgctagtcattctggatcttatgtttgcaaattctgttgaacattcagtgatgtatttgaaatgagaaagtcctttataacatagtgtgaatgtttgtggccaattcaattgtggaatcttatggctttgtttttactttgggtagaagtttaacttccattgttcagattttaggtttatctagtgaaattgtgccaggtagttgtctaaatatggaccaattttgggaaatgaagattaataagtgtatatttgattctagataatcctttactcaaaatcataagttaaagattcacatcattaagagttatctaacttttatgttgtcaaatctttaaatgtggatgatattcagcattctatctatgaatttcctttaggaaaagagaaaaattcagtctccaaaccttttcttggagacaaaatttaccacatatcgaaaatgaaaaaaatt

SEQ ID NO: 97152 - DNA, 1252 bp, Homo sapiens
gggccatccagtgaagccctgggtgagtgacctcagccctgacaaaagactgtgccataagtgggtccagtgcatagagtcagcagcgagcagtgcctcactgagctgtcggggactgtctggaaggttcacagatgaagagaaattttgtgagaatgaactgtaccgtgaagctcacctgcatctgatttagtgcctgctcctgctttgccttctgtcatgagtaaaagctccctgaggcctctccagaagaagatgccactgtgcttcctgtacagcctgcaggactaaaaactcaagctggagacggaaatgaacagatgcacatggctggaaagactcagtgctaatctctacaatgttgttttaatagaatggagacaggaccacatactttcttacaataatgaggatcaataaagacaaaactgacactttgtaatgaataatgatctgaacactcacctgagaaagtatctctttgttgcaggtttttggaaatgggctatattttttgaatcataaccgatatgtactgccataaacaagaggatttcaagccagctccatctggtcgaaaattattttatttattactaagagaaaagtgtaagacaagtcctgtggtaaaaacagatttattgcctctgctattcacctgtgttatttcttcatatattaccattgacatatattatccattcttcacagcaatggctttgccgtggcaaattaaatatctcattgtccttctctgtccattttacattataatgtttctgagcagacttttatagctctctcacagaattatagcaagtctttaaataaaaacaaaattgaaacaaaaattttagactcaacttaaaatccctctttattttataatttggatttttaagtaaaatatgctatatcctatttaacgagaactttcatatgtaatgtatcaatggaattatctaaagctcatttggttttgcataaaaacacaattagagtaaaaacattctaaaatagacactggaataaaaacaatgaaagcaaaactattaattttacatttttcattcaagtattttgatttttactatattatattattatattaggtatcagagtaatcattgatcgctttcaaaaccctgctcctttctaggtgcaatgaagaatttttattttattgaaaagttatcttaagatgtaagacttgtgaatgatagtaaagatttagtagacccaatgtattctc

SEQ ID NO: 97153 - DNA, 324 bp, Homo sapiens
gggccatccagtgaagccctgggtgagtgacctcagccctgacaaaagactgtgccataagtgggtccagtgcatagagtcagcagcgagcagtgcctcactgagctgtcggggactgtctggaaggtgagtcatcaagccaaagaggatgcttcttgaaccttagggtttgatggagtttgccctgttaggttttagatttacttgggatccagcattcatatattttatttttttcgaatagtggttctttttggaatgggaatgtttatcctatgcctgtctcaccattgtattttgagagttcatgttgtttgattccac

SEQ ID NO: 97154 - DNA, 659 bp, Homo sapiens
gtccccatgctgctgtaaatagctgcctgaggctggataatttataaagaaaagacgtttaattgactcacagttccgcatggctggggaaggcctcagcaaactcacaatcatggcagaaggcgtctcctcacagggcgacaggagcgagaatgagcactgaacaaaggggagaaccccttataaaaccatcggatctcgtggaattcactatcacgagaacagcatggaggaagctgcccccaagatttaattatctccacctggtcctgctccagacctgtgggattacaattcaagatgagattttgggtgtggatacagaaccaaaccatgtcagaggccaaggatctcaagacaaggccagggtatggcatgtttatgatttagccttggaattcattccacatcagttctattccatgggttgaggcaggtgcaaaaacccacccaggcctatgggaggagagctaggcccactgctggatggatggactggtgttgccaaattcagtgaggacaaaggcagaacagttacctccaccctcctccgcatcagaagaagaataaagatgagacttacgaagttagctgtcctgaggactggtgtggacccatggtggcactgggcaccaagagtgagttcagtaaacagtaag

SEQ ID NO: 97155 - DNA, 423 bp, Homo sapiens
  misc_feature (423)..(423): n is a, c, g, or t
aatatacaaataaggaaatacgacaagagttgagagtttgaaaactctcttgcctttgtaatactgtttactgttgttttcaaaaactcagccatagcattatttaacatctactttatggtaacaaatgcagaccttgaactttctcccacttccaaatataaaaacttttaagtaaacaaatgtctcaagtaccattattgggatatcaggtattcaggccaggtgcagtggcttatttatttagacttttcactccagaattttaggcaattctaacaaactcaggtgagaagcaacacattagaagcaggtaccctgactgcatgaagatgtgatggagaatataccactattaatagagacaaacacaattaaaagcagacaaaatcttaaagagcacagcggtctattatagcgacn

SEQ ID NO: 97156 - DNA, 931 bp, Homo sapiens
gatgctgtgtctcactcttgtaatcccagctacttgggtggcttgaggagagaggattgcttgagtctaggaatctgacactgtggtgagctatgatcacgccactgcactccagcatgggtgacagagtgagaccctatctctaaggaaaaaaagcaaggaaagtgaaagtctgtgttatttgaaccaagacctgttctccctctcttctcttggctaagtgagatagaactcttctccaaactggtgcagggaagaatatacggttccctttccctctagtcccagttggagtgctgtcttcacaggagtgatggaatgtcagcatttctcatcctgcccccagctacctgttgctgaaactaaattctggataagtgtagctgagaggtgggtcttacctccttccattctgcccttcctcatgggatagcagctgtaccttggatgtgacactgctgagaataccggggccacagtcatcctggtggcggaacatggttccaccccaggaaaagcaaaccaaggagatcaagggttgctgtacctttacttcagttgagctgtcagccctaaagtgagggtgtcacacagaagcataccattgtctctgcccccagcatcagcaccagggctcagaaattttgtccaggggaagaagcaagccttataaaagagagtgctgaatgtctcctcaaaggaactgacttcatttgcacagaatatggagaagttcatgcctaagggtgcaggttgtgatgaaaggcacttggggtgacattaacacagtcattggagatataggttaacccaaaggccagctactttgctaggaggaatgggataactgagctagattgctagagtgaaaggaggaaagtggtagctgggaggaactatcccttcaaaagatggatctgtttgtggagca

SEQ ID NO: 97157 - DNA, 387 bp, Homo sapiens
tctgccctcatgaatggattaatgttctcttgggagtaggctggttttcacagagtgggctcctgataaaaagatgaaattcagtccccattccctctctgtcttgtgtgcttgtttgcctttccaccagatgccagcaccatgctctgtggcttcccaaccactagaacagtgaaccaaataaatttctgttcaccataaattatgaagtctttggtaattctattgtagcagcaggaacaagactataagataaggtaaaggaaggtcacgttttatttttatttttgaaaataaaatcaaactcggctctaagcctcactagctacggttaggggaagaattctaatattcatttttattggggctttttcctctctactgaat

SEQ ID NO: 97158 - DNA, 360 bp, Homo sapiens
attctttgtaaatgaactggtcacttccatccatgcctctgaaccattactcacctttccccacccttctccactctgctctgtgtcttaggtggctgcagggcctgaatatatagtaattgatggatatcattttccttaggctttcattgggtttagctaatgagaggcactgacagatgaaggatgggaagggaataaagccagggtatctggttccctcctgacaggtcatccaggtcacttcatggtggctggttgaggacaccacagttccttgtaggtggccctctcaaaacagctcttttggggttcagaaactgttccccctctttacctcttcaggcctcagggttcaat

SEQ ID NO: 97159 - DNA, 400 bp, Homo sapiens
gtcagttcctccagagcacctccagatccctgcccattctatttagaatcggaggtttaagtctattgccactggctgtcctctggggcccagaaacctatatggggtttgtccagcctctcatcccagcaccatcgtccaaaccccacagtcattaccaatctaacagcttgaaagttgatacaaagatgaggcagaagccagtttggctttctcccagttctctgtgcccctccggagttaatcaacaacgacctatctttgtgtcaataacataagcctctctaactagaacacctggtgaaaagccggaggaaagcttaaaatgaagcaaattttgcagtgattattctgaccctcactgtttaagctggactcaggatctccagacaaaaactgc

SEQ ID NO: 97160 - DNA, 303 bp, Homo sapiens
tagcattgcaacaatagcacatttttattaaaaaagaaaaaaactcattgtgcctacctcattctacactagtatgaaattccaaatatttacctacttgtcttacccaaatatttgaagagttgacatagctagtatcatttacagaaagaagaagttacaaagtatacacgtaattagaattttgactttgaaaatagaacatgtatcgactgcagtattctttcaaagtatctcccataatgaaacattgcaattccaggaaaatttagagatgcttgtctggaaacacacatgcattat

SEQ ID NO: 97161 - DNA, 215 bp, Homo sapiens
gtaggattacctttagccctctaagtgatcagatccgcctcactgtcactcatgggagcccttgatctggacaacgtggaccttgagtagctgagttcaaacaactgaggtggcaagagggatctcccccttggttcttttttttttttttttttttttttttttttttgagacagagtcttgctctgttgcccagtctggggtgcagtggtgcg

SEQ ID NO: 97162 - DNA, 445 bp, Homo sapiens
ggcctctactggtccctggaatggaatcttctccagtgacttgggatctctggccaaggcctggcccacagtgttcaggtatgactttaagtgtttctaaattcctccaggggaaaggttacacctgctcgaggagggaaaaatccccagctgctctacccaggtgacttcaggaagacggctccttttttccctcttctggtggtatcatcccaagaacttgagttagggctttagggagtgttgtgaccaaacactaggaaaggagaaggtcaaggaacagcttggtcgcagtgctttgtacagggtgtgcaatgaacagttattggtagaaattgatcaaagggatggtctgacttggatttggctgtgtcatgccctacagatagtgggatattgaagggactgttctctttccataatggttagactcaaaaacctagaa

SEQ ID NO: 97163 - DNA, 534 bp, Homo sapiens
aattattatatgtcaattaaaaagaaaaaaatttaaatgttgaatgaggtaaagaatgaacaggccaatgaaggaagagcttggaatttaggggaaatcaggaaatggaaaaaatgagagtcttatttaggatagatgatgaaaacatatgtgtgtaatatatgctatctttttttttttttgctattctgtgtgttccagagaggcaattttgatatgatttaacaattccatgatatggagataaatggaaaaaaaatctgaaggaaaataagaagcagattatgctgctgaattctgaatttggggaactgacacatgatggtaatagataattgacgtatagtgaatggaagaatattaaagctgatgttttcaagggtacaaggaaatgggcataaatgaaaagataaatggtgtgatctcatttcatattgtttccttggttttaaattgcaccttaaggtcctttgaatagggctatagtaacaacgggaagcccagagatgcaaatgctgggaagacagagaatgg

SEQ ID NO: 97164 - DNA, 715 bp, Homo sapiens
accatgtgctgccccagctgcatcctcatgaagcacatccgggagcacatggtgggaagggccatgtgagagactttagtatgtgaactgatttatcctctgaacaagcatctttgattatctgttctactccagatacaactcacaagtgaatgaaccagaacacacaaaaagtatgtatggagatcaatagagtgtggtttaagaataaacaagatcagtggaaatgaagagattccaaatgggccaggcgtggtgactcatgcctataatcccaccactttgggaagccaaggcaggcagatcccttgaggtcaggagttcaagaccagcctggccaacatggtgaaaccccgtctctactaaaaatacaaaaattagctgggcatggtggcgtgtgcctgtaattccagctactagggaggctgagccaagagaattgcttgagccccagaggcagaggttgcagtgagctgagatcatgccactgcactccagcctgggcaacagagtgagactccagaggctgaggcatgagaatcgctttaatctgggagccaagatggcaccactgcactccagtctgggtgacagagtgagactccatctcagaaaagagaaatagatccctgcatgtatgaaaatctaacgtacagtagtaactggtattaaaattcagtttatagtcaagatttcgtggggttagaagaaaaag

SEQ ID NO: 97165 - DNA, 388 bp, Homo sapiens
gaaaggaggattttattgtctctgaacagaggctcaggcacaaataaaaaataacaaatccaacattcacattattgtaatctggaaagaagaggacaaagtggtctttgtgggataaaactttgaacaattaatagctgaaaatggttcaaatttgtcaaaagatataaaccagatttttaaagttcagtaaatgtcaatcaggataaacccaaagaaacccatagcaaggcatatcataatcaaactgctgaaaactaagaaaatacaaaacaattttgaaagcagccaaagggaaatgaaagagaaactaccaaatgaatgattgtagatttcgcatcaggaaccataggggccagaaaaaatgtcataacattcggtaagtaac

SEQ ID NO: 97166 - DNA, 249 bp, Homo sapiens
  misc_feature (70)..(70): n is a, c, g, or t
taaacagagacggattttcttatctctagttaattagaggtatgagaaaaacaagacgctcggcacgctncaggctttattcattgatgaaatgtagtcaccacagggagaaatgtagcaacaacttagcatccagaaataatacagaacactgtgctgcattaaatgaaaaatacctgcaagaggaagtgagttaataaaaattcaattactcaaatgggaacttttccaagaccccagggttaacac

SEQ ID NO: 97167 - DNA, 375 bp, Homo sapiens
ctccgtgaccctcctaactggggacgagcgaaccctaaggcctgtcttatataccctctataggagaacgataacattccgcccctcccccagtttcttcagcttcctctcctggagggggaagagcagaagaaagcaaggaaggcacaggttttcttactttctgctccatcgtctcatcctgccccgagagcttcaagtgcacactcactgcacatctttgtgatgccctacaacgtcgtcccccatatcctgatgacacagactgccttttttttttattgccgtttgcagtggaaaccgtggttctgaaataccttccccttccttgataattgcagtctcttccccccccccttttttttttgccagcgg

SEQ ID NO: 97168 - DNA, 950 bp, Homo sapiens
agcggagaaaaagaatcttagtttcccaaagtgggaaaatgaattgatagattcctaaagcgataaagtcaagaacagcagcataatatgttatttagaaataaggaagttggctaggcgcgatggctcatgcctgtattcccagcactttgggaggccaaggtaggcagatcgcttaagctcaggagtttgagaacagcctggccaacatggcaaaaccccatctacaaaaaatacaaaaattagctgggtgtggtggcacacacctatagtctcagctacttgggaggttgaggtgggaggaccacctaagcctccgaggttgaggctgcagtgtgctgtgaattatgccactgtgctccaccctgggagacagaccctgtctcaaaaaaaaaagaaacatcaataaagtaaatagttttaaaaaaaaaaagctgatgagaaagaggaccgaagtaagtcatatgcaacaaaatgttaacagagatagtttgggatggaaagatatgggttagtaataagtttttctctatttttcccactttctacaatcatattattatgatttaggaaactacattttctgtaattagagattactctggattttataaataagaatgtggttcctgtaccagatcttggagaagagtacgcctctggaagtcacgggatatccaaagctgtctgtcagatgtcaggtcagatggagcagagaaccccagagacaagaagggaggggagaatcaggaattggcttttttccctttcctgcttctcaggtcagataaattcagaactcttattcttatacccgcctccgcctcaagctagcctaaaacccacaatccaactcccttgatgaggatgatcattaacaacaatcactaaataagtacttactaagtgccaggcacagtactagataaataaaattgtctttttatcta

SEQ ID NO: 97169 - DNA, 293 bp, Homo sapiens
ggcgcgcgccgcggccggtccgcaccctggactggagcccgggccggggagccccctccccagaaagggccggcagaccccgcgggggcgggcgcgggggtcgccgagcctcagggaccctctttccccgactccgccgtctcccgagttgccttcgcccggggccacccctgcccctgggggagctaacgtggctcccaagccccggaggtggggcaggaggaccccgtcccccgtctcccggcggggagggtttttaaagtcttcgccacgaactcccgtccctgcccggc

SEQ ID NO: 97170 - DNA, 444 bp, Homo sapiens
gtagatacccagtggtggagttgctggacagatagagccaattgatgatcagtaatggtggccaatgatcaactagaaacaaaatacttagcagggcctgaaaacaccaaaactctgagacaactgaccttcaaaaacgtcaaccgccatgagtgaaatatccaaacacatttatccaccattcaaagaccctttattgcctgtcctctgtgcatctcagaattctctttttaccacactgtctatatactgcattagccatttatatgaaactccaaggcatcttatactacatattcaaccatgtatccctagtacctagcacagtcctggcatatagtttgctactaaacatttgcagaattaagtaattatcttgtatccagtttccaagttttaaggtgatttctcactaacaataaagcattggcctcgttggcctca

SEQ ID NO: 97171 - DNA, 542 bp, Homo sapiens
tccccacccccatctctttggagcacccctccaatatctaattgttaacattctgtgtgtgagagatgtattatgtattaactgtttaaataaagtcctgtgaattccttggacagtgtattatgaatttacaagggagttcactatatctttaggtatttgtgttatatgcattatcttacccattaatacattattctgaacttttgtaaggaaatagttttctactattcatctgtggttttggttacagtttttaaaatgcagagacaaatttcagttccatttctggtggcccacttgtgggaccaaatctatctttctaaacgtcagatttttagaagctctaccagcaatcctcgaggcttacagttttcccgggtttctgttggcaagtaacttcagcttttcgtactttgagatcacaagtggcagacgctcttaagtgcgtcacagttaggttgttaagatttgagggggacaatctcctttggtgtcgagttcatcatccacagcagtaggaacaacaaaaactcaagaat

SEQ ID NO: 97172 - DNA, 333 bp, Homo sapiens
tccatggcgcttgggagtttccatggaacttgggggcttctttagaactgtatcctagaataaccccaggcacttaccaagtgcttggtaaatactctttactacatgcagtgaatttttgtgataaagaagcagttagtttgtatcctgtgcattaggctctgtttcattttcaaccttctcctggtgcctctactatccctactgtcttccacatcatccacatcatggggtctcttggctgctcatcttggttcttgccattcaagcccccacctctttcctcgggtccctccctcatccaccctccaaccatttatacccttcttctct

SEQ ID NO: 97173 - DNA, 297 bp, Homo sapiens
cagtgtcccaggcatggctgctgtcagatgagacaacttacttttaaatgtatcttattttgtaaatgtattttttaaaaatagtctcgggctgggcacggtgtatatgtgccatattttctttatccagtctatggttgatgggcatttgtgttggtttcaagtctttgctattgtgaatagtgctgcaatgaacatacatgtgcatgtgtctttatagtagaatatttataatcttttgggtatgtaacccagtaatgggattgttgggtcaaatggtatttccggttctagatc

SEQ ID NO: 97174 - DNA, 277 bp, Homo sapiens
gctatgaaaagaagagctggacctgtatctataaacctgaagagatgtttctgtgacatgaagtgaaaaaaggcaagatactgaggaaagtatttagtatgtgaatagttttacaaggaaaaaaaaaacccccgcataggtgcttatctgtgagcatccttatgtgaccattgatggagggaatgctaaaaggaatcacaccaaatagttgaccttgttgcctccagaagcaggggaggagagggaagaaagcaggagacagattgttgtttatctt

SEQ ID NO: 97175 - DNA, 293 bp, Homo sapiens
gatcgtctctgtcttgttagagtgtgactgagatctctggaaaaaagaaaaagatatccctgatatcttgagtggcctgggatgagcagggaagcctctaggagagcagagagaaaggtgaagaaggcaacttgcttcacgattttacctacacctggagctgcctggaacagtctccttgctcagatgcaattatgccgtgcatctcctgtccggtgccgagtcttccaaactctgctctccaaaatgtctaagtgtgttttgcccacactagcgctgtgcccatgttgcaa

SEQ ID NO: 97176 - DNA, 447 bp, Homo sapiens
atttggagagaaatttttgcctgggaaccttggctcacacctgtaatccagcattttgggaggctgaggcaggaggatcacttgaggccaaaagttttgagaccagcctgggcagcatagcaatgctctgtccatacaacaagtttaaaaattagctgggtatggtggtgtgtgcctgtaggcccagctaatcagaaggctgaggcgggaggatcgcgtgaacccaggaggttgaagctgcaataagccatggttgtgccactgcattccagcctaggcaacagagcaagaccccatctctaaaacaaatgggagtagagttctaatggcatccaaaggtaaaggcccatattccctggtgttccccaaatcattgcaacaaaaaagcaaagccatttaccctctaagtaatgtcagtaaacaatgaaggaaaacctgaagccttcc

SEQ ID NO: 97177 - DNA, 353 bp, Homo sapiens
aatgggattacatcaagctaaaaagcttccgcacaagggaagagtcagtagagtgaagaaaatgaaatgggagaaaatatttgccaactatctttctgacaagggattaataactagaatatgtaaggaattcaactcaaaagcaaaaacaccaaattatccaattaaaatgggctaattatctgaacattttcagaagacatacaggtatgtgaaaatatgttcaacattagtaatcatcaggaaaatgtaaatcgcaaccacgatgagatgttatacaccccagttaaatgaccattatcaaaaagacaagccaggcattggctactctgcctggccctagttttgttctt

SEQ ID NO: 97178 - DNA, 329 bp, Homo sapiens
agagagcaacagatcccataaatagtctgaaagggaagcaggatccatgcgacagcacagatgaatcttccaacattacgctgagagaaagaagtcatacgcaagtacaagtgaagtttaagaacaggcaagaacttatctatggtggcagaaatcagaactcgagttgcttctgggataaagagagaattaactggaaaaaaaagcatgagggaattttctgggataagagaaagattctaccacttaattggaatgttggttacatgggagcataccattgtcacaactctttacacggtaaacttcatatttgtgcttttcttttc

SEQ ID NO: 97179 - DNA, 644 bp, Homo sapiens
tgcataccattttttcactgaacacaatctatcatgaacatctttccataacttaaaagaagctgcatgccagaacagtccatcatgttctgttttctttcagaaatctttagagatggatcattttccttacaagaatagataccaggtaagagaagcagcctttaaagcagcgaatagcagctcatgcatgctaattatttgcttacttatctggctcccctattgatggcatcttgagggccggtatgaacatgtcatgcagtctccaagcaacccacagtaggcccaccataaacagatgttgtggccagcatgggaggtgcaatggtgagttgctctgtttcctccctcccgtccccctccccacccctcccctccccctcccctccccctcccctcccttccccttcccttcccttcctctctcacaaaacagtcacagagagaggacagcagcgtacatggtgaggtgctgacgattctggtccactggatcccaccatccctaggacagtaaataccgtcctagtcactacccagcaagttaccaccgcatcatttcctgcatgttccaaaatgaataaaggtaattaagcataagtgcaaataaaaagtcatttctcatgtttttaatctaaact

SEQ ID NO: 97180 - DNA, 220 bp, Homo sapiens
agacagggtttggctaatgccgcccaggctagtcttgaactcctggatgcaagcaatcctcccacctcggcctcccaaaatgctgggattacaggcatgagccactgcactggaccatgaaagtttgaaagaagtcgtcttatagatggttatgaagagttggaagtttctgaggaaagagagccttgttgctgaaggtaagaggacattgctactggat

SEQ ID NO: 97181 - DNA, 314 bp, Homo sapiens
tttgatgtttgaagtcctgatgcaacattctgagcagggttttcctgacctgctgtgcccaagggactgataaaggaaaaagttctatttattctttgtgatttgacgcacagatgaaaaacttaacacacaataacggaagctggtcgttaataaatcacaccctagtctttcagagcttccgtaaacagacaacatcttcagctttctaactcttgtagttttaacactgcaacatcaatgatgcatatgtccagaatcagctaaaaagagtgtcagattctttttctcttagttcatctatttttcactgt

SEQ ID NO: 97182 - DNA, 371 bp, Homo sapiens
tcacttaagagttgaggaaaataaagctcagagaggttaaataagcagcataaggccatagagcaagttaactttggggctagaatcgatacacctactttggtgtttctctagctgatgccatatcactgcatccccgtctcttctgccttccgaaacagtctggcaatgctgtgccttctgtgaaggacgggaatgttctaaagctgcaccagccaattttaggtactcatcacgtgtggctattgaggacttgaaatgaggctagcgcaactgaagaaacaaagctttacttttatttaattttagttaatttagatgtaaatggacactcacttagctagtcaatactgtattagacagcgtgactc

SEQ ID NO: 97183 - DNA, 285 bp, Homo sapiens
aaatgtattcctcaatgttatcagtttcttctgaatcataatgctgcctcttaagatggcagttgctaagatggcagttgctaagatgcctgcatattataagaggattctttttttttttttttccctgagacggagtcttgctctgtcacccaggctggagtgtagtggctcagatctctcagctcattgcaacctctgcctcctgggttgaagcaattctcctgcctcagcctcccgagtagctgggattacaggcgcccgccaccaagcccagctaatttt

SEQ ID NO: 97184 - DNA, 776 bp, Homo sapiens
agtgacagttctttgttatagtccttcagctagattgaagtttagaaactaggtcattttccttgtatcctatagaaaatgttatggggtagttttacagttactgttgtagaatgaaggacattctttggctagctcattcagtatttgccccctgtacactgaaaagctcacatgatttccttctcttctgttttcccagttggtttcttaagcattgcttcatgtaatttttggactttggagagggaatcagtaatgcaaattaatgtaattggattccagcctgtttggagtaatgctgtcagtggtggcagggtgatttcctgctggtgaaatattcctagtatgtctactgggaacactggtatgtctgaagagttgcttaatcttctgtaaagattaattccttctctcaacccctaaatttggtaatatatgttactactgtaatacatttttatcagttctgctttttatacaaaaagcaccattcttccaagacattgttgttccctgttatatggacacctgcatttttcttaacgctagagatatgcatcactcatttgtattcttctctgttttctgaaaatattgtagtatgttccagagcgtctgcttagtgaggtccttatatcagttagaaccgtctgagaaatgcagatgtgggtagtatgctttatgggaaactggtcataaaatatgtttacgcagttgaaagattcacttatatttactcattttaatttgctcttgtagtggtttagagtata

SEQ ID NO: 97185 - DNA, 290 bp, Homo sapiens
ttctagtgcacgggccaacctaaaatcacttgcaaatttccaactaagaagaaggtactttcatacaaagtcaagattaaataattttagtagagtatgttaatttccaaaaaactcatatgtgtttttgtatgtatcaaaaaatgtacatgcagccaggcactctgactcttgcctgcagtcccagctacccaggaggcagaggcaggaggaagacttgagcacaggagttcgaggctgcaatgaactatgatcatgctaccatgccccagcaccccagtctggatgag

SEQ ID NO: 97186 - DNA, 151 bp, Homo sapiens
tccagggaggggtgtgtcctctgtgcccgagtccttccgctacccagaaaggaggaagtgaaacttgcccttggccaggtcggctccctgaggcaaggttagattttgtggtgataaagtgaaactggttttgcagtgtccccacccgccc

SEQ ID NO: 97187 - DNA, 116 bp, Homo sapiens
ccacctccagagttcaagcgattctcctgtctcagcctcccaagtagcggggattacagtccccctaggtccgtgcaggttacacagtggcaccccaaacagcgacaggatcggaa

SEQ ID NO: 97188 - DNA, 731 bp, Homo sapiens
acatcaaagagggctatttacaaaggattaattacaaaagtgtgtgtgcaatgtcagggaccgacacacagttgtgcagaaacccgtgttagcatcagcagagctatttccacttgtgggcccaaaaggccaggagaagtcactaggacctggaagcagagtcctgtagagcaggtccccaaccccccgggccacagactggataccttagcctgtggggaaccgttaggaaccgggctgcacagcaggaggtgagcagcaggcaagcaagcattactgcctgagctccacctcctgtcagatcagcagtggcgttagattctcataggagcatgaaccctattgtgaactgcatatgtgaaggatctaggttgcgcactccttatgataatctaatgtctgatgatctgagatggaagagtttcatccccaaaccattccctggccccagtccatggaaatattgtcttccacgaaactggttcctggtgccaaaaaggttggagactgctgctgtagagcaggctacctcaagaagagctgtgacttccttcaaagcacacagtgggccttaagccctcccagaaagaagctagggaatgaatgaataccctgatctcatttgcttcactgggctctctgtttgccgactccaagtggaagcctgcaaatatgggagctgttgattataatctatcaatgtaagtcagctttctggctgggagcttggt

SEQ ID NO: 97189 - DNA, 317 bp, Homo sapiens
gcccgggagatactgttgggggagggggtaggtgaacggccgggagtaccagtacccagagatcttcagatacttgggggcgggtggaaggccaggagccccagtacccagggactcttcacttgtctctttctccagtctgagtccatgagaaaaatttggtaagtaaaggtttggaaaggagcctgaacgtcctcctcatgtgtcccaccccttccacaagcccttgccacattcccgcctgcccagcgctcagctctgtctcggctctggtgtccatctggtgtgactgggccgtttcacccgtttcaccccag

SEQ ID NO: 97190 - DNA, 375 bp, Homo sapiens
tttttaatttctctatttggtgaactacagtgcttgatttttaaaatttttattttattgtggtaagaatataacatgagatctactctcttatgagatttttcagtatacaataaaatattgttaactataggcacagtattacacagcagatctctaaagctaattcatcttgcattaatgaaattttatacccattgataagcaactcctcacttccctttcactcccatcctggcaaccaccattccactctttgattctatgaattgtactgttaatattttcactatctaaaataagcaaattatacgggatttgtctttctgtgattggcttatttcacttggaataatatcctcaaggtttattcat

SEQ ID NO: 97191 - DNA, 214 bp, Homo sapiens
agacttacttaaaacatatgtgaaagggctttgaaactattaaaagctaccaaatggaagatatttataggaggcatatactttctatcatcatttaattttatactttattaataaaaattattaaaattcaatttgttatattttcagtaactaatgacaatgaatatattactaatcttttcacttgtcttttcttgctttcctttttcct

SEQ ID NO: 97192 - DNA, 908 bp, Homo sapiens
catagttacaattaatagattagcatatatttggaaattaagatgttttgggagatgtgaatagttagcgttagctactttaagagtatagatcttacaaaggcagcaagtatatcccctttcatgtggtattcttaaagtaaatacatacttggtgtggaaactacagcagcatttcacatgaatgctctgatactttttagaatgactaaagcaaagggataaaaaagtttttataatctggatatctgcttttacttaattcctaatgtttttgaatctaccacttcataaacactgtagctttagagtaccatatctagacatctttgttttttcagcaggtacggggagtatactgtataaaacaaatagaaattggggtagtaggtttaaaaatgctaaatagtaatgcaaaagtgccttgtttccagtagtgttagtagaagaggaggatggatttgtctaatgaggatttaagtgatagtagaattttaatatagctccacataccctgctgaatagacttctatatgattgctatatccaaagtcttaagaaattgttttatttttaagttacacttaagatttggtacagggcagtttataggtttgctttgctgttggttgtttggtttggcttttgtgggggtttgttttctgaatgtctttagagtctgtgcccctgtttacatgatcactatgtttagtcgttttatggatcattctttagtttgacacttaaatgattttaagtttgtttttctacaaaagcatctgtgtaagtttacctgttgatttaaaaatgtactatatagtaacagccatattacacgttacagttccatgactaaaaggaatttttttgtgtgtgacaaggtctcactctgtcacctaggctagagt

SEQ ID NO: 97193 - DNA, 499 bp, Homo sapiens
aattaagctaatcacagttctcatgcaaagttattctttcactgaaataataagctagcattctggcctaaatccagtttcttaatgtcaagctgcctttgagccctcacaaaactcccttccctctaactgcctagtattccttcgaagaacactggtgaatttcagttccaaaatttttttctgccctgtctgttcccctcatatctggttcttacctatctgcacacttggccttgacttgacacttaatactgtgccttgttttctagattgttcttgcctggggtagtgtccatggctccccttttctccctgccctgaagccacagcccacagtaccatccaagtccaggccaggttctgtatttctagtcataacctagacacagactgaggctcccattcctcccaaatctgcatttgctctggaaggaatttagtagcactcgtgagtttcatagcatgaattagtttcctggtatttagtcaccatggg

SEQ ID NO: 97194 - DNA, 323 bp, Homo sapiens
ctttgaacgtcatgctggtgttcaaaaagcatcagattttggattttagatttttggatttgagatactcaacctgtatatattttgagagtaatagtgtgtactctgccaactacatagggttattgcaagggtaaagcaaagataagccatgggacagcactttgcaaactgttaagaattctattatcagggtcaagatggcaatcagggacactatgacatggactacagtcaaaagatccaggaatgcctgccttggacagctagatcttctccccaggaggtgcctgagggagacatacacacaggtgacagtcaca

SEQ ID NO: 97195 - DNA, 525 bp, Homo sapiens
gtgacagctgagaggccagtctgagagtgacatcactaggcgggagtcacgggtgtgtcccagtgggagaggccgtcacagacagcccaacccaaacaccctggttctcaagacttttagtcaagccaggccaaggctcatgcctgtggtctcaactactccagaggctgaggcaagagaatcgcctgaggccaggagttcaagaccagcctggacaacacagtaagatctcacctcttaaggaaaaagaaagacttccagtcaaagggtgtcttaagtcaggtttcttctccaggcaaaggcctctggtgcatggtaacaaacaacgaccaaagccaggcagcccggggccttgggtgacctgtccagcgggcacccaactgtccccatgtcctgtctccacgcctcacacggcaccttactccaccacttcccagagggtcccgccagctgcccccacaatcgcgacactgcaggccccccgtgagcacagagacagcagctttagtaaggtcagacctagcg

SEQ ID NO: 97196 - DNA, 467 bp, Homo sapiens
  misc_feature (461)..(461): n is a, c, g, or t
  misc_feature (466)..(466): n is a, c, g, or t
attcaaagtacgtgaaggaaaaaaaaacaaaaaacctgctaaccaagaatgctttacctggcaaagctgtccttcagaaatgagggagaaatgaaagctttctcagacaaacaaaaacaaaggaaacatgtaaaagtgaaaaaataaatggtataagtaatatatagtcccactcagaattctctaatactgttaaggtggtgtgtgaagcaatcttattactactaggagggttaagagacaaaactattaaaaacaactgcagctacagtatattgttaaaggacacaaattttaagtttacatcaaaatcagaaaacatgggaaggaaggaatgaaagtgcagagtttttgtatgtgattaaaggcaaattgttatcagtttaaagcctgttttaaggataaaatattttatgtaagcctcatggtaaccacaaagcaaaaacctatagaagttaaanaaaana

SEQ ID NO: 97197 - DNA, 146 bp, Homo sapiens
tgctgtgcccactccttccctttgcctgcctgcctatgtcctattccctgtgtcctgcaagaccccctttggtttggttttcttttcttttctttttttcttttttgagactgcgtcttgctctgtctcccaggctcgagtgcagt

SEQ ID NO: 97198 - DNA, 558 bp, Homo sapiens
gtgctgtaagatcactcagagttctatttagttaatgttacagcaatgttcgtgagcaacttggctttctttctgaaagaatcaaggttgtatttgacagggcctctgttaatgcattttaggaaatgtaaagacatattgattatctttcatcatgctaaaagaaaagaagtagtgtcgtaaaggcaatcagaaaaagtcagtatgttccacattaactcatgtaccgatttattcataggctcaggtatttttaaagacagagaagttctaagaaaataataaacattgacaatgatgagaaaacttattgcttaaacagtaatcagtagtgttaatgtgcacaaaaagtgctttgaatagtgaactattctaaaggaggagtaagaggtactatactacagatgacacggttgtggtatggtatgtggtgtcttattatttaacacggccagtataaaattatataacatcattaagataatgttcttcaggatttcaacatacatatgtctccagctttgtaaggtttttaaataagtgtagtgcaaaaaaaaa

SEQ ID NO: 97199 - DNA, 551 bp, Homo sapiens
gtgctgtaagatcactcagagttctatttagttaatgttacagcaatgttcgtgagcaacttggctttctttctgaaagaatcaaggttgtatttgacagggcctctgttaatgcattttaggaaatgtaaagacatattgattatctttcatcatgctaaaagaaaagaagtagtgtcgtaaaggcaatcagaaaaagtcagtatgttccacattaactcatgtaccgatttattcataggctcaggtatttttaaagacagagaagttctaagaaaataataaacattgacaatgatgacacccctcatagctcccccacatcccccatgtgtgtaacgtctcagaaatttcatccagaagtcaaatattattaagaataagtcatagcgaatcaaatacagaatgcccccccccccaaatgttgtcctgtccctgtctgggagctgggtcagttaaagatattctgtatgctgtatcttttgcatgtagcttccttaatggagaaaaagtatcctaattagtttccagtttcattatcctcagaacaa

SEQ ID NO: 97200 - DNA, 617 bp, Homo sapiens
tctatatttctggtatctcagacccactgcctagctggcagctacagaggacaggctcctggccccaagaaacagacttggggaagcgcagttacagctgtgaggtcttaggtaactcctgctctctgcctcttagggttagaagtacaggttgagtattccttatctgaaatgcttgggactagaagtgtttcagatttgggagtttcggcagtaccagctgagcatccctaatccaaaaatccaaaatcccaaatgctccagtgagcatttcctttgaacatcacgtcggcactcagtttcagatttgggggcatttcagatttcagattttcagattagggatatgcaacctgcattaaatgtgataagctaggtaaagtgcttaatccaatgcatgggacagaatgagggctcacataatatattagctactacttttattagactgtgccctgcatataataaattctataaatatttgtttaataaatgaacacaattaaaatgtttagcacaacagaactggagtcatctaagtacatggccttttaaaaacaattctgacaacaagtctctaagaagaaactgagtctctaagaagactctgaagtgag

SEQ ID NO: 97201 - DNA, 727 bp, Homo sapiens
ggctcactttggacaccaccaagcaatgctctcatccaacagacagggccactgtgctgcgctttggggttaattgctgaggccaacctctcttctttctcccccagtctaagagatgcttttcatgcccaacctagggaccaagctcgcagttacaagagcatctccaggtctccgtgctccaattatggcactactgttataatagagccgagaggtaactatggcaacattatttcaaggataaataccacaataccgccttcaactttttccccccatgaagaaagtgaagaatcgagaacatgtaggattaatagcatcatttgttaaaaagccaatggatggcagagttcagaagaaacgctaattagtggagtctttcctggctcaatttaacatttgctctgtgcccccacacatatgggtggtcagcctcagaattctgtatcacccaacttgggtcccgtcaggcttccaaccccaggttgctgcaagttccacagatgtttttctgggaagctcagtgccacaggcagaggtgatggctgaccagtacagaacttcacagtgagtcagggtcagctacagtggtgatgaccagcgagagtagtgaaggggaaagatttattgtcagagcttctcattgcttgagacccaagagaagtagtctagcacagtagtagaagcatgagcccagaaatcagacagatgacaagctgaagaa

SEQ ID NO: 97202 - DNA, 851 bp, Homo sapiens
tagctgcacagtcaatgaacctcccaataagaagacacccctttccacagcccttttttgtcaatgatacacaagacaccatgctttcctgccaggccctacaaacaagtgaaaatgataatacgtgtcatcccgactttagagaatggttttaagaatcaaatatgataatatatgtgaataaatgttctttaaacctgtaagactgtatatagcagtgaaggataggggttaatttacacctacaagatttctgatctatctgctagggtgcttcattagccttttctgataatggattcatgacagttgtacattagaagctatgtggatcactaacccatgacactgacatcttagttataaaagtgagcaattttatagaacacatattagcgagacactgtttctttcaaaaaaaaaaaaaaaaaaaaaaaaaaaaaaaaaaacaaaaacaaaacaaaaaaaaaacaacaaacagcaagcacaaaacaataccaaaaagaacaacaagccaaagagacagaccaacgaagcggggcgcgctcaaaacaacacacgcgagggcgacacgaatacaaaaggaaagcagagaaaaacaacacgagagcaaacaaagaaagaataaagaagaacaacagcaagaaacaaaaacacacaaagaagaaagaacgacgcagagagagagaaagagacgacagcacaacagagagagaaacaacaaaaaagaacaacaaaagaaaagagaaaaatgacggcaccgaagaagaaaaaccacaagaaaagaagaaagagagagaacccgacaaatggcgaggacgagacataagagaaaaaaaagacaaaaaaac

SEQ ID NO: 97203 - DNA, 740 bp, Homo sapiens
tgaaggtggatggctttattcctgggatgcattggtctatgtgtctatttcagtacataactcacagaccctataaaacaacaacacagtagaaaatacaaagtaagcagctaacaacttcatgataggatcaaaactacacatatcaatatcaaccttgaatgtaaatggtctaaacatcccacttaaaatgcacagagttgcaagttggatttaaaaaaaagacccattcatctgctctcttcaagagccccatttcacacataaagacacccatagcttaaagggttgtacagagatctagcatggaaatgaactcttaattttggatggaaagaaacctaggaataaaaatgaaatagaagacaggcccttctggcagggtgtggtgattcatgcctctaatcccagcactttgggaggccgaggcaggtggatcacctgagatcaggagttcgagaccagtctgaccaacatggtgaaaccccgtgtctactaaaaatacaaaattagccaggcgtggtgatgcatgcttgtaatcccagctacttgggaggctgaggcaggagaatcacttgaacccgggaggcggaggttgcagtgagccaagatcgtgccattgcactccagcctgggcaactgagcaagactatgtcacaaaaaaaaaaaaaaaaagaaaagaaaaagaagacaggcccttgtaagagagtatagctcaatgcaaatgggatgaggagatc

SEQ ID NO: 97204 - DNA, 224 bp, Homo sapiens
tatctcacatactcactatcatgagaacaacactgaagggatggtgctaagccattcatgagaacaccaaccacattatccaatcacctcccaccaggccccacctccaacattgaggatcacaactgaacataagacttgggtggggacacagatccaaaccatatccaactctgctttttacctctgagattcacatgttcatagcctcatgtcacagagta

SEQ ID NO: 97205 - DNA, 402 bp, Homo sapiens
cctcagttccctgagtcgcatccttatgaagcccctaagagctcttgcagggtatggcatcctccttttaaggtgacctagagccatacccaaggtcacagggcgcctagcacagtgctcggcacgtggaaagagcttagtaaatttttggtgaatgaacatagtaatttaagaactagagtccaagactcagggctccgaattaccagtcctccattgtatcacccctattacaaccgtcagccaaatcatctactttcttgaatgcaacattagagatggaattttttttcccagaatgattgcagatattaaacttaatgacccaacaatttaacaccaaaatgtacaggacacactcttcctctatttattatctattatttctttaccattaagtac

SEQ ID NO: 97206 - DNA, 2249 bp, Homo sapiens
gatctgtatattatccataataagtggcctcatttagaaataaaggtttttataaggcttctgtaaattttacatcatggaaatttagtacaagtgaaactttttttttttccaaaggctttatactgttggtgtaatcttataaataggtcatagttaagcctttgaaaatgaagtatgtggtgttgacactatcctggtgttatataaactgactttcaagttaaccaattggattgtaatcatcatctatcccctttataaatgaactacactgttgtttttctgacttcgatgtgctttgaagtacagtgtagcatatcattctaccttgaatcctatgataatacagttgacatcttgctgtagtggacttgtgcatatagcacacatgatatagtatattgtattacagtaaactttagacaatgctacttaatcattttacttcatgaagataaactaacattttaaatatgaataatattaatggtctacaaaaaatttgagcacattttaaaatcatatttataaaaaactggccaaattggtcttatttaatgtataattcagaaccactgtgtagtatgtattcttttctctaaatgatgaaatgctaaagaatcatttcacgttgttgaagaaaataccgttgctacaacaacagcagcagctactactgctactactactactactactactactactactactactgacagaaagaattcatgaatgtaaactggaggatatcacagttttctttagtgaatataagtgaactacttgtgcgtgttaggtgtactatttgctatgtattttattttgctttattcagagagaaagttgattactgagtgctgaattatacaatttaggctaggaaactcgtaactttggtatttaataaaagaaactatacatattctgtttgtaatgtaaataatctataccccatgcacaaatatctgtttcctgggtgtgatatattaaagtatgtattcttattttgaggtatcttttggaaataattgaaagagattaaataacaatttatgccacatgaaaaataattacttagaagtagttaggtatcatgtcttatggctttttatgttccattttggctttttttctcatttgctttattactatatgtacttgcatgtaacagtttgtaagcatatattctgacttattttccttctgtcattatctagtgctgttatgccttcctatcagaatcgataagtcaaactcagaggtgtgattttggtgttgaagttttcaggacagagatactatttccatggatgcattttaagtaataaaattaggggaagtgaaatcagaaaatgaaaaatgattacaaaataactttcaggttttctataatcaatggctttaaaaagtagacagtcttaattaattttaaattagcttgctcagaaaggtcatgccatacagtcctatcataaaaggaacactataagaattaagcaatgaacagcatgatttctgatcacccagtgaggactgacagtgtataaaagatacaggtatgctactggatgtacccgataattgtttgagagttttctagtgaaaaactcaaatatgctagcttaaccacagtagtagggggcaaccttattatatgggagagcttcaaaacatactgtcattttgtagaaggagcccaggtaaggatgcctaatcctgtccagtttggctagaactccatagccaaaaatgcagatttggattgaacatttttttgatgggacttctatcaatgcttaactagtaaaaacacatcttttctataagactttagaatactgtggtttctaatgggttcttgaataatgattttgcattgtgtttttctagttaatggtttttggtagtatttaatgatagcacagtttggggttttattgttcttgaagggggaggatattgaatttgtttttcttagagaaaacatcaggtttgctcaaatagactaacaacctgttgtccttaagcacatactaccatgaataaactcaggaaacaattttcaagaaaattcgaatgcagtgctggtgatggggatttttgtgggaaaaaacaatggtttcaagtcctttcacaaagatcaaacttcagcctattttgttagactcagcaatgtctaaaacattgttttttgtaatttattgtcattggtaattcaatataataaaacaattttgatagca

SEQ ID NO: 97207 - DNA, 3615 bp, Homo sapiens
gatctgtatattatccataataagtggcctcatttagaaataaaggtttttataaggcttctgtaaattttacatcatggaaatttagtacaagtgaaactttttttttttccaaaggctttatactgttggtgtaatcttataaataggtcatagttaagcctttgaaaatgaagtatgtggtgttgacactatcctggtgttatataaactgactttcaagttaaccaattggattgtaatcatcatctatcccctttataaatgaactacactgttgtttttctgacttcgatgtgctttgaagtacagtgtagcatatcattctaccttgaatcctatgataatacagttgacatcttgctgtagtggacttgtgcatatagcacacatgatatagtatattgtattacagtaaactttagacaatgctacttaatcattttacttcatgaagataaactaacattttaaatatgaataatattaatggtctacaaaaaatttgagcacattttaaaatcatatttataaaaaactggccaaattggtcttatttaatgtataattcagaaccactgtgtagtatgtattcttttctctaaatgatgaaatgctaaagaatcatttcacgttgttgaagaaaataccgttgctacaacaacagcagcagctactactgctactactactactactactactactactactactactgacagaaagaattcatgaatgtaaactggaggatatcacagttttctttagtgaatataagtgaactacttgtgcgtgttaggtgtactatttgctatgtattttattttgctttattcagagagaaagttgattactgagtgctgaattatacaatttaggctaggaaactcgtaactttggtatttaataaaagaaactatacatattctgtttgtaatgtaaataatctataccccatgcacaaatatctgtttcctgggtgtgatatattaaagtatgtattcttattttgaggtatcttttggaaataattgaaagagattaaataacaatttatgccacatgaaaaataattacttagaagtagttaggtatcatgtcttatggctttttatgttccattttggctttttttctcatttgctttattactatatgtacttgcatgtaacagtttgtaagcatatattctgacttattttccttctgtcattatctagtgctgttatgccttcctatcagaatcgataagtcaaactcagaggtgtgattttggtgttgaagttttcaggacagagatactatttccatggatgcattttaagtaataaaattaggggaagtgaaatcagaaaatgaaaaatgattacaaaataactttcaggttttctataatcaatggctttaaaaagtagacagtcttaattaattttaaattagcttgctcagaaaggtcatgccatacagtcctatcataaaaggaacactataagaattaagcaatgaacagcatgatttctgatcacccagtgaggactgacagtgtataaaagatacaggtatgctactggatgtacccgataattgtttgagagttttctagtgaaaaactcaaatatgctagcttaaccacagtagtagggggcaaccttattatatgggagagcttcaaaacatactgtcattttgtagaaggagcccaggtaaggatgcctaatcctgtccagtttggctagaactccatagccaaaaatgcagatttggattgaacatttttttgatgggacttctatcaatgcttaactagtaaaaacacatcttttctataagactttagaatactgtggtttctaatgggttcttgaataatgattttgcattgtgtttttctagttaatggtttttggtagtatttaatgatagcacagtttggggttttattgttcttgaagggggaggatattgaatttgtttttcttagagaaaacatcaggtttgctcaaatagactaacaacctgttgtccttaagcacatactaccatgaataaactcaggaaacaattttcaagaaaattcgaatgcagtgctggtgatggggatttttgtgggaaaaaacaatggtttcaagtcctttcacaaagatcaaacttcagcctattttgttagactcagcaatgtctaaaacattgttttttgtaatttattgtcattggtaattcaatataataaaacaattttgatagcacctctgtttggctcaaagggattccatatgtttaggcaacccacaaccttaagaacagatgcttggtatttataatgtctgcccattggaacaacatgttaaaatagtactgcccagagaaacttccatacagattgactagtattttctagatagaggtctttcatatatgaagaaggaaaacaaccatttatcttggccctaaggcccacaagaaaacttaggctttaaagtgggcaaagcatatttgtggtattctgtacattctctttctcctggctttccagccccttcatgctatctatcttatttgagcacctcacagcaatactccatcaacgaaatttaccctatccccagaaggattctgtgtgatccttactccttgttccttcctcttcctcttccccaaatcaggatatccattctatcagaacagacatttccagctaaaaaggtgaaaggaaagctatcttattaaattaatttacatttttctgtcagtggctaatagttaattggcattttttaaggaagttgtgcattaatcaagtttttagttgctggatcttcaggcaatctaacaaggtgataattttaaattcagttcctatcacggaaaatattttgggggaaaggaacagtgtgtcccagggtcagagtatctaataaactgtttctttttttgcacaatttccttcctacttcctttctacttctcaatctaccttttctcttaaaaacttttaaactttttaatcacaatgaacttctatgacaaaatgatgtggaggtagacagagattggcgattatttctgtatatgttgtttttaaacccatagttttgtattcttgtttctcacagtacatgacctatatagcataagaagttttattccccccaccccccatcccattcctgttataaagaaaaaaaaaagcacagagagattgaatccaaactactcatggagtccaaatttttccagatcccttttccagattttaggacctagaaatcctttaagtcacaatgttatttcaaaaaaaaaaaaaaaaaaatgcaagccatattaagtatatattggccaactgcaattaaacttctttaaaacatttttgttttacatttcaaagcttattcaggcatttttggcatgtacctcaagatcaatgattgttgaaattagcagaataaatcaatagtgggctatttgcctttttatgtgggaatatagtggcattgatagtgattattcacaacatacattatactcatggatgcactgttcctggttttagtcttacagtgtagtgaattccatcatatactttcaataaaatgttatgcttgatcacctaaa

SEQ ID NO: 97208 - DNA, 737 bp, Homo sapiens
tcaagtctcactgtgtgcacactctcacacatacacacacaattatactaattctagaaaggaaccaaaggtaaataaccagtgtttccattatcactaaatggaaaaattgactggaagttagagttgtgccaattaatcattttgttcatcaactgttctggtaacttatttttttttattggaatcttaaattggaacaactgttacagaatgtatattgctccagttctaaagccagttaaccctgtgccctctaacttatgaaccttcatttcaaaacagtatgtgggaagtcctgtagtttgataagagtaaaattattttaaagaggataatttaccattttactactataaaataagttgatatcagttgaccattttattttttgatggactctttttgttgggagaaagaaatgaatggaagaaaaaaatatgttgcttttatttgaatattgattactaacaacttataaactacattgcaggaaatgaagaaatattttgaaattagcaaaatagcaacagtattcaagtatctgaaattttaatatggtgagtcttagagctttagactttcctataagtgacagtatctaagttattcttaatagtcacacttgataattctgctgaccataagcagctaacctacagttgaagatatttatgtgacatgaatagcctgtgttttaaaaattaaatattttatataaaattgaaactgtgttt

SEQ ID NO: 97209 - DNA, 707 bp, Homo sapiens
ggagggaggatcaacttgagtctgggaactcagccaggaattcaagaccagcctgggcaacacagtgaggccccctacccacatcctctccgtccccgcaatctccttccatcccagggtgttgctgaaaatgtcagatgcaaatttggatagcagcaagaagaatttcttggagggggaagtagatgatgaggaaagtgtgattttgacactggtgccagttaaagatgacgcaaatatggaacaaatggaaccaagcgtttcttcaacttctgatgtcaaactggagaagcctaagaaatacaatccaggtcatctacttcaaacaaatgagcaatttacagctccacaaaaagctagatgcaaaataccagcccttcccttgccgaccattttgcctcccattaataaggtgtgtcgggacactttgcgggactggtgtcaacaactcggtttgagtactaatggcaagaaaatcgaagtttatctgaggcttcataggcatgcttaccctgaacaacggcaagatatgcctgaaatgtcacaagagaccagattacagcgatgttcgaggaaacgcaaggcagtgaccaagagagcaaggcttcagagaagttatgagatgaatgagagagcagaagagaccaatacagttgaagtgataacttcagcaccgggagccatgttggcatcatgggcaagaattg

SEQ ID NO: 97210 - DNA, 1329 bp, Homo sapiens
agatgtggaacaccaagacaagtggctagaaaccttgtacatgaaaacagcggcccacccaaagtttgtcttttcctaggaagttatagagaaatgaggaggtaacagaagagcagtcaataaaagaaaaatttctttaaaagacatatgggtgggatgagaacgaatgattcttactttatctgtagaaattgaattttgctgcaactaagagagacctcgaaaatagtgatttacacaaataaaattttgttccatcaagaaaactgatattcagcagtccaggctgatgcagtggcttcaagagctcttcagcaacccaggcaccttccaggtcttctttcccaattctagtgctagtaactccttcatctcatcacccaacatggctaccagagctccagacatcacgtgtacatctgagttccaggaaaccagacagagggagaaaagaagggcatgcacgctcactttaaagaagacttctaagaagaaccacctaaaattccccaacctagtcccaaagctcacttggctgctttcaagcctggaaaatgcagtctttaagctgaaaaatgctatgacaaaatcagagattgatcatgcctacaatgacaactggaaaacagaaatgaaaccatataagccaagcactcacgcaatctttgtcctcccagttgacttaagaacacttgtgaagaaaatgtggcgtctttagatctcagatcccttgtttccaactggttcaaataaatagacaactcttcattccgatggtacttcttagagataaaccacatgcatgtatcagagaaaacaactctcagcctggtaaatgaacaggaaaaacttgggttagaattctatttctttcaaggtagagagcaaattttcataatctcacatggacatacagaccaagccatgcatggcactatctacataatcaaggcggagaacacaaaaacttggatatgaatgttcacagcagcattattcataatagtcaaaaaatggaaacaaccgaaatgcccaccaactgatgcatgaataaacaaaatgcagtgcatccattcaatggaatattattcagccattaaaaaggataaattactgatacatgctacaacatgtatgaacttcaaaaacatatgctaagtgaaagaagccagccatcaaggaccacaaattgtattattcaatttatatgaaattctaaagtaggcaaatctgcaaagacaaaatagtttagtggttgtatagggctggggtcaggagaggagaataggagtgactgccagtgagcaagaggtttctggtgaaaacatg

SEQ ID NO: 97211 - DNA, 781 bp, Homo sapiens
ccccgacccgggatctctacccaaaaggaggcggttagaacacagagattgatcatgcctacaatgacaactggaaaacagaaatgaaaccatataagccaagcactcacgcaatctttgtcctcccagttgacttaagaacacttgtgaagaaaatgtggcgtctttagatctcagatcccttgtttccaactggttcaaataaatagacaactcttcattccgatggtacttcttagagataaaccacatgcatgtatcagagaaaacaactctcagcctggtaaatgaacaggaaaaacttgggttagaattctatttctttcaaggtagagagcaaattttcataatctcacatggacatacagaccaagccatgcatggcactatctacataatcaaggcggagaacacaaaaacttggatatgaatgttcacagcagcattattcataatagtcaaaaaatggaaacaaccgaaatgcccaccaactgatgcatgaataaacaaaatgcagtgcatccattcaatggaatattattcagccattaaaaaggataaattactgatacatgctacaacatgtatgaacttcaaaaacatatgctaagtgaaagaagccagccatcaaggaccacaaattgtattattcaatttatatgaaattctaaagtaggcaaatctgcaaagacaaaatagtttagtggttgtatagggctggggtcaggagaggagaataggagtgactgccagtgagcaagaggtttctggtgaaaacatg

SEQ ID NO: 97212 - DNA, 521 bp, Homo sapiens
tttgagtgatgtctgatcgtcaaatagcatttggaaagacaagctggtggtagtatgtagaatggattggaggcagaaacagtatttagagttgctggaccattaggcaacagctcagtgctaggccctgtggtaggtgtgggagatacaaaggtgactagggcacagttgctgaactcaagggactcactagttaggagactataggaatatgttaagtgtgaggtgatgaagacctgaaaaacacctttggaaggaaaggaataacaaagtactgctattcttccccactaagtactgctgtgcggaagaacagcagtacttagtaactctctgaattgggggttaagaaaaaaggaggaaccaaagttgactccgtcatgaacagaaatagggtctcaggaggatagctttgatactgagtttgaggaaatggtgggacatccaggagctaggagtacagtttttagtttaaacgtttaattaaaacttaggaaaggtgttcaagctggagaagttga

SEQ ID NO: 97213 - DNA, 580 bp, Homo sapiens
tttgggaggccaggcgggtggatacaaggtcaggagatcgagaccatcctggctaacaaggacattcaaaggatctccttacattttcatgagtacagttttaaaatcattgcatagactacctcttaagactcaaacaacccgcattcacagagcattttgtatagatatatggataagtccacaggagaagctgccttttaaaacctatgcacatcctgactgcttccaggtggccccaatactactgtgtaccttcagcatggacccttcaacatgaagccatctctgccatatgcccaacatgctcaaagtactccccctaaacctgaaatagataaagttgcaaaaggaatatttaaaagtgcagttaatgatgtttctaggtgataagtgcaccaaatgaatgtgtctacttttatatctaaaagagtgttgaaattatcttactgagttatttcatgaaacactgatctagataatctatttaaagccccaattgaatttagtggcttaatcccttgaatgatattgcaatctacccatagcttcatgatttgattgaattaaacttgaataa

SEQ ID NO: 97214 - DNA, 486 bp, Homo sapiens
tagtcactcttcccagtgcagggagcacagtacatgaaattccgtaactgagtaaccctttgcaggcactcactcactcaattctttcctaaaacacaaatgcctctggagggaaaccagaagatgctcttaatgacagaaaagatcaagagggttagtatcaggaaggagagaagcactgagaagacaataagatgaagaaatgaaaagcagtaggacagggatgcttcatctagtcgctgaaggttcaaatcttgttgggataaatgcagccccaaaaaaggacaacagaaagacacattcttgccccacttctgtatcctaaatcacccagggcacaaaaaagtgttatttcctagcatgcaggtccagcctaaaatttgtacaagatgcaatgctttgtcaattcctgtccaaaggaccaccaagacggccaggtgctgtggctcatgcttataatcctagcacattgggaggcccaggtgg

SEQ ID NO: 97215 - DNA, 1471 bp, Homo sapiens
agcggagctcagtgtagggggcaagctctgcaagaccttggccgagtgacttctgctgctttttgctgtggggactctactggatggaccagcacatgagagagatggagtttggaaacaaaacaagtggttcagaaacatgggattgctttcatatctactggcatttagaaggagcttggtaaatttaatcaagaaacaaggaaatgaaaatacccaaggaacaccaggggaagaataatggttggattttcatttaatttgccagacacaatccctgaagtaagaaaataccgtttctcatgaaattccggcacccgaggctcaaacggccaaccctacggttaacagccgaacgcgctaaccaattgtgccacagaaatgaatgtggtggaatatctccattccaacaaggttattttactttttttcagtctaaacaatacattagaaaggaggctacttctccgtgtattggaaaacatgttttccctttttttgactctcattgttgctatgttaatgtgttttaaaaacggaggtttataggcttgccgccgtggctcacactgtaatcccagcactgtgggaggccgaggcgggcggatcacgaagtcaggagttccagatcagcctggccaacatggtgaaacccatctctactaaaaatacaaaaattaaccgggcgtgatggcgggcgcctgtaatcccagctagttgggaggctgaggcaggagaattgcttgaacccaggaagcagaggttgcagtaggccgagatcgcgccactgcactccagcgtgggtggcagagcaagactccgtttcaaacaacaacaacaacaacaacaacaacaaaacacagaggtttgtaataatacagatattattcttaggaacataagagtgttaattgggtggagagcaggacgcgggactggtgcgttttgcaaaataagtatgagtagaatcaaaggaaagaatttattttcggttcaataaggaagttttcactgatagttcagttgagagagaaaccactggaaggctgttgcatagaaggaaatatattaaatgagaaagacaccagcaagagcagaggggaaaaccatttaatggaaaatctgatacaaatattaagggaaagtaaggggccaaacaccaggacatgaaaccagaaactcctatacattagtgcttgtccaccaaactgcgagcctgaaattgcgatcatactttatatttgtgttttaaagagtaagttggtgacagattttatttcttttctgcctgtcttcctgcttcctctttttctttctgccttcctctcattctccagtatgtataccttctaatcattttcttctgggttttattctgaatattaggattttctaaatttgttcctgtttttctcattttcttaagcatatgtgggttgacctttgaagtacgatgatgggtagggggtgg

SEQ ID NO: 97216 - DNA, 160 bp, Homo sapiens
tgttaagctcttacggggtaacttactatttaaagcaaactcatgacaatgtatgaaaggattataatgcaaatagaagtaaaacatgtgacagcataatggacaaggaagtaataaatgtcaggttcttatattttacgtgagatagtataatattaat

SEQ ID NO: 97217 - DNA, 186 bp, Homo sapiens
aggtctccacaggggtctacacatcaggacacccggtgtgaattaagtaggtctccacaggggtctacacgtcagaatacccggtgtgaattaagtaggtctccacaggggtctacatgtcagaatacccggtgtgaattaagtaggtctccacaggggtctacgcgtcaggacaccggtgtgaat

SEQ ID NO: 97218 - DNA, 183 bp, Homo sapiens
aggccgaatcatcagaagccaagccagtgacaataaacacaaaggtcccgccctctcccaaggagacatgtgtctactacatgggaagaattgatcaagccctttgtatttcatagagtgtcacttgttactcagaataacaaaggatgaagcagaattattttatagccctgtttttacttg

SEQ ID NO: 97219 - DNA, 249 bp, Homo sapiens
attttcacatggttatatacttggattcttttagtatagtcactgaagacttttaaaaacagaaatactgggccgggtgcggtggctcatgcctgtaatcccagcactttgggaggccaagatgggtggatcactaggttaggagttcaagaccagcctgggaaacagtgagatcctgtctctacaaaaaatacagaaattagctgggtgtagtggtgcctatacctgtagtcccagctacttaggagg

SEQ ID NO: 97220 - DNA, 708 bp, Homo sapiens
aggcaccaaaggccacacattccagcattccactccaatgacatacagacagatggtaactcagtggctgccaaggcctgaggggaatggggagtggctactcagtggttcagggtcttttgggggtgatgaaaatgttgtggaactggatagaggtggtggtcatacaacactgtgaatgtactgaagaccactaaatcgtacgctttaacgcggcttaaaaattgaggacgaagtatcagtttgggaagatgaacaagttctgcggctggatggtggtgatggctgcacagaaccgtgaatgtgcttatgcccctggaccgcacacttaaaaatggtgaacatgatacaatttaggtgatgtgtattttaccataattttttaattaaaaaaaaaaaaaagcagcagcgagctcccacagggcctgttaggaaattgtttttcatgactgacatggcagattttacgtaaagtgcactttgccacaatgccaatgtggaaatataaagcaagcgcagtgctcccacggctgggcagaatgtatggggcaggtgctcgcaggctctgagaagcgaatgtcagcaggtgggtcagggaggaacaccaggattccgagttctcctgcagactggcagggagctggccgtgccaccaccatcacggaagtgggtggtttatgtctggaggacaggaaaagggagccccag

SEQ ID NO: 97221 - DNA, 237 bp, Homo sapiens
agtgtgttgagttaggacatcgcaccttctcatgagcaacagattttttgcctcaggaaaatggaaaggagaaaaggaaaaatataaaacaattataatgttcacttattaggtaatcatgtcagtctttctattgtgaaacgaatagcatagggtcttagtattatgtaaggaaatttgagttcgtgtaacttgaataataaatatctctaaagaattttcaccacatgtaaagca

SEQ ID NO: 97222 - DNA, 362 bp, Homo sapiens
acattggtcctgcgcgaggcctggccgccggcgacggcgggacgctctgggaggccggcggtgctcgggcgtagagggagacagctgcccgggggcacggacgagcggctctgggggtcccggatccgagccccgctgccccggggtggcggtgacgcctggagccgggcggacgtggctgggccgggctgtcggggcgggcaggcgccgctgccggtgtctaggccacaccaccctgagcgcgccccagctcctctgagctcgtgaagctaagcagggtccggcctggttagtacttggatggattccgcctgggaatagcgggtaccgtaggcttttggcttcccgctccctccctcttt

SEQ ID NO: 97223 - DNA, 303 bp, Homo sapiens
aaatcataatataaagcatgccctgccttcagagaatttataagctagttggaaaagatgtaaggtaatagaaattataattcatggtctggtgcagaactgtaataaatttacatctataatctacctatatgctatcatataagtggcataacttgttgctttatataattattacaacgaacttataaaatacatatgcattttcagataagggaggtgagcctttaagagacgtattagtgcagaataccgggaatctggtctcaaatccatatttgttactctattttatatgttgtt

SEQ ID NO: 97224 - DNA, 220 bp, Homo sapiens
cagccccacacgaggcccatcccgtctcagcataggcttccttctttccactgttcctggagacccagcaggctgtcatgggcctttggtcctacacagtccactccagtgccaccaggcttctgcagccatcatttcccatgtgcacgtgggaaagaactaggccaggcttctaagttatctagaccttcctttttttttttttttttttttttttttg

SEQ ID NO: 97225 - DNA, 583 bp, Homo sapiens
  misc_feature (573)..(573): n is a, c, g, or t
tcaccgcttataccttcaaaactggaggaaagtattatctacattttacacaagcagacataaaaaacagataatataaaggtagaaggaaaatatgctagtacacggtgttttaggaggtcaaaaataactatattaaaaggcaaatataagtcaatgtaagacttaggctacctctaaaattggaaagagattgcttttatttggaaagcaaaggagtttggtcataagtggtggcttttgaagttcagctggatttttcatatgggaattgaaacaggaagcatattatgaagggggaacccctgtgaaaaattaattggtttaggtgttccctacttaagtgtacttgattacaaaatttggttttattattggattagagcagaagttgaaaatatgttgtgatacagtggaaataacagataatataaaggtagaaggaaaatatgctagtacacggggtctcaggaggtcaaacataactccattaaaagcaagggcccttggtacagaattttggtctgcaaattccacaaaagcaaacggagttggctgagtctcatcacctgncatccgcaca

SEQ ID NO: 97226 - DNA, 675 bp, Homo sapiens
  misc_feature (665)..(665): n is a, c, g, or t
tcattgctatcaaatatcactcaataattgcatgaggagctgtgggaaatgttgtagattcctggcatctttggagaaaacaatttttttctatgtgtttgcaagattagactgatatagcttaattacttgtggcatccacactccttagataaaaaacagataatataaaggtagaaggaaaatatgctagtacacggtgttttaggaggtcaaaaataactatattaaaaggcaaatataagtcaatgtaagacttaggctacctctaaaattggaaagagattgcttttatttggaaagcaaaggagtttggtcataagtggtggcttttgaagttcagctggatttttcatatgggaattgaaacaggaagcatattatgaagggggaacccctgtgaaaaattaattggtttaggtgttccctacttaagtgtacttgattacaaaatttggttttattattggattagagcagaagttgaaaatatgttgtgatacagtggaaataacagataatataaaggtagaaggaaaatatgctagtacacggggtctcaggaggtcaaacataactccattaaaagcaagggcccttggtacagaattttggtctgcaaattccacaaaagcaaacggagttggctgagtctcatcacctgncatccgcaca

SEQ ID NO: 97227 - DNA, 385 bp, Homo sapiens
acaagtacatgccctaatgtgaaagccaggatacgggttacttttgggaaaacagaagcgaccgtgattgggagaggcataggagggactcgggaagctggcagcgttctatttcctcatggccagtggtcatgtaagtgtttcattggcaataaatcagtgaactgttcattttcatcttatgtattttctgtatgtttattagattttacaattaaaactgttaaagctaatctaaagctaatttgcattttaaacaagactgatagaaatttaccacagaataagttagtcatttctcttaaatgtttcctcacccactaaattctagatgggtcttgctagaggaacagtattgtaactagtcctaaaacaatgaatgaaa

SEQ ID NO: 97228 - DNA, 411 bp, Homo sapiens
aaggcaggagcgtgggcgtcactgaaggaaggcagcaccgcagggtgcacggagccaacatccggcctgagatcaggtgctatcaaggctttgcttttacatggggatgtctcttgcacagctgggccactcagaaggaccgcagaaagatgtggttcttagaatcactgattggaatgattcagaaattcctttatgaggatcctgcttatgatgagctccatgaagacttagaggaaaattgaaagagttttgttcatgactcaaggttcagcctgacttcgaaattagtgcagaagcttctggactttggtttggaggacgaccgatggatgaacaaagatgaaacatcaaggaacacaggtccctctgtccctctgttcagtgtttaaaatgtgactgaaggtcaga

SEQ ID NO: 97229 - DNA, 650 bp, Homo sapiens
tttagtacgggtaaaagactcagtgaaggtgaagccagtaggcatacaacttttgggttatgggaagaagaggtgccaactccaagaccaaagtttcaggctcaggcagaatctgttctagacctttcttccctacttactctccctggacaatttcatggcttccatttatatattgatgactcccaaagctaaacatccacctcacccctctctcctgagatccagtcctagcctatgtagcaaacctgctggatatctcatgggcctctcaaactgttcttttagctatcctcaagctttccacagcaaaaggagctatattctctcataatagttgttcaaaggctctcacatataaaactctggtcccagaccttcatggctttgccttcctttaactacattgtatcctgaggcctagaataggactatgagctgggactgtgtgattttttttccatggcactgatgttggtaattatgggcttagacacttatttaagtagatgcttataaatgtctaagcccgtaattaccaacatgagtgccatgaaattgaatctaagacacttaagttcaattcaagaaacctttcctaggcaccctttctgtgcaagacctatgcatgatgctgggcagacagaaga

SEQ ID NO: 97230 - DNA, 509 bp, Homo sapiens
cagcgttcagggtaatagatggcccccaaaaatctaagtctgctcatgccacaagttcaacgtagctgtcagccaagctgctaaagtacccaccatctctaccaattacatgcaatgtagcagaaaaaaggaggggaatggtgccctggaaaatgaagagtagaggttctgaagaatcacattagattaggttgggggaggatggcaaaagaaaagggagtgaaaatgttattagaaagaggagaaagaaaagtgaaatgttagatagggaggaatccactacatgcccctgtgctccaggagtaataatgtgttcctttgagctcaagattgaaaaaaaaaaaaaaattgacctctgctatagcttaatgcctaaaacaatgcctggcacatggtaagcattcagtaaaatgttgaatgaaacgtaatggatggatgggagggttgaatctgtttagtctgtttaaaagatgttttaaaaacatcttggttcattctgcttctgggcc

SEQ ID NO: 97231 - DNA, 111 bp, Homo sapiens
agaattgatgagaacacaaagtccaaggacatgatgatatttaccaaggaaagagcagcttctgctgggtgtagtagctcacgctggtaatctcacaactttgaaaggctg

SEQ ID NO: 97232 - DNA, 199 bp, Homo sapiens
gcacttatctttaatccactgatgaaaacaaattttagaacaccaaatgttatggaaaacttgttggtcatgagtgttactatgggtatgctatgttccagcttttcagttttaggaagcttgggtaaatgtctgctattcccttgtgctgcagccctcccttctcccatttcctttttgggtactatggatagtttgc

SEQ ID NO: 97233 - DNA, 226 bp, Homo sapiens
aaagttggctggaagtaccagacagtgacagccaccctggaggagaagaggaaggagaaggccaagatccactaccagaataagaaacagctcatgggatggccgggcgcggtggctcacgcctgtaatcctagcactttgggaggcggaggcgggcagatcaggaggtcaggagattgagaccatcctggctaacatggtgaaacccagtctctactaaaaaaat

SEQ ID NO: 97234 - DNA, 454 bp, Homo sapiens
ggacactggagattacattttccacggaaaatgtcagccactgccgaaaataggactttggagaaaatgctagaaagtgtatttttaggctatatatttccctcctggattcctacagtccagtgggctgcttgatactccccagggttcagctgccaggtgcagaccccaaagcttccaaacaggtggtccggggagagggctcccgtaggaaaaaaaaatgcctgtaggccaaaaacaggtggaccaatgcaaggacctgtttccagtgtcaggaagaaggaggtggaagagagccagccatggccggggcctcagattccgcatggctaacgagcttcggggagatgccacagatgtccggagactgtcctttgagtggcaagagacaagaggaggcagggctcagttagactgcggcctgggaagggggagcttctccaagcccaccctg

SEQ ID NO: 97235 - DNA, 861 bp, Homo sapiens
  misc_feature (861)..(861): n is a, c, g, or t
tcagtcaatggctcgctgcccatcaattacactttctttgaaaaccatgttgccatatcaccagctatttccaagtatgacagggagcctgctgaatttaacttaaccaagaagaatcctggagaagaggaagagtataggtgtgaagctaaaaacagattgcctaactatgcaacatacagtcaccctgtcaccatgccctcaacaggcggagacagctgtcctttctgtctgaagctactacttccagggttattactgttgctggtggtgataatcctaattctggctttttgggtactgcccaaatacaaaacaagaaaagctatgagaaataatgtgcccagggaccgtggagacacagccatggaagttggaatctatgcaaatatccttgaaaaacaagcaaaggaggaatctgtgccagaagtgggatccaggccgtgtgtttccacagcccaagatgaggccaaacactcccaggagctacagtatgccacccccgtgttccaggaggtggcaccaagagagcaagaagcctgtgattcttataaatctggatatgtctattctgaactcaacttctgaaatttacagaaacaaactacatctcaggatggagtctcactctgttgcccaggctggggttcagtggcgcgatcttggctcacttcaatctccatcttcccagttcaggcgattctcatgcctcgacctgtaatcccagctacttgggaggctgaggcaggagaatggcgtgaacccaggaggcggagcttgcagtgagcagagatcgcaccactgcactccagcctgggcaaaagagcgagatctgtctcgagaagaagaagaaaaaattcn

SEQ ID NO: 97236 - DNA, 708 bp, Homo sapiens
tcagtcaatggctcgctgcccatcaattacactttctttgaaaaccatgttgccatatcaccagctatttccaagtatgacagggagcctgctgaatttaacttaaccaagaagaatcctggagaagaggaagagtataggtgtgaagctaaaaacagattgcctaactatgcaacatacagtcaccctgtcaccatgccctcaacaggcggagacagctgtcctttctgtctgaagctactacttccagggttattactgttgctggtggtgataatcctaattctggctttttgggtactgcccaaatacaaaacaagaaaagctatgagaaataatgtgcccagggaccgtggagacacagccatggaagttggaatctatgcaaatatccttgaaaaacaagcaaaggaggaatctgtgccagaagtgggatccaggccgtgtgtttccacagcccaagatgaggccaaacactcccaggagctacagtatgccacccccgtgttccaggaggtggcaccaagagagcaagaagcctgtgattcttataaatctggatatgtctattctgaactcctgacctcagatgatctgcctgcctcggcctcccaaagtgctggaactacaagcctgagccaacgtgcccggccctgaatcgctttagtaaataaagggtctccaagaataaattcatccgaacatgca

SEQ ID NO: 97237 - DNA, 805 bp, Homo sapiens
  misc_feature (738)..(738): n is a, c, g, or t
  misc_feature (755)..(755): n is a, c, g, or t
tcagtcaatggctcgctgcccatcaattacactttctttgaaaaccatgttgccatatcaccagctatttccaagtatgacagggagcctgctgaatttaacttaaccaagaagaatcctggagaagaggaagagtataggtgtgaagctaaaaacagattgcctaactatgcaacatacagtcaccctgtcaccatgccctcaacaggcggagacagctgtcctttctgtctgaagctactacttccagggttattactgttgctggtggtgataatcctaattctggctttttgggtactgcccaaatacaaaacaagaaaagctatgagaaataatgtgcccagggaccgtggagacacagccatggaagttggaatctatgcaaatatccttgaaaaacaagcaaaggaggaatctgtgccagaagtgggatccaggccgtgtgtttccacagcccaagatgaggccaaacactcccaggagctacagtatgccacccccgtgttccaggaggtggcaccaagagagcaagaagcctgtgattcttataaatctggatatgtctattctgaactcaacttctgaaatttacagaaacaaactacatctcagggtaagatgctttttatgaagctgatttccatgaacaaaaagcaaacttgaggctgaggcaggtggattacttgaggtcaggagttcgagaccagcctggccagcatggaaaaaccccatctntactgaaagtacaaggnttagccgggtgtggtggtgtgtgtgtgtggtcccagctactcgggaggct

SEQ ID NO: 97238 - DNA, 252 bp, Homo sapiens
atccatttacttcctgcataccaccccaccatccacctagtaagccattctagaactattaggaatcaacatcaatgtccccttctccagtctgactcttccataccagctaaccctgtcctatcatccctcagctggattagtacagtagcttgataattcatcttcatgctgcagtcctgatctcctaaaattcattctccattccagggtattctagaaggacttggaggaaaaaatcccctaagtaga

SEQ ID NO: 97239 - DNA, 877 bp, Homo sapiens
ggctccggacctggcgacgcacgaccgagctggtcacttgctgccacctcgcaaaggcgcatctctagtccagtggtgagctgcggccgggtcgctgcaactcgctccaggccttcggactcgtggcctcggtgtccctcgcggagccctcggtgtgtcgcttgcaggctctttttttgaagaaagcagggagggaatggccttgtgagagactccaggagcaaagagcgaccctcacaaggcccaagtcctcccagagctcagggaagctgtcgcttctgacagaagaagggagagaaagctccctcctgtgtgtccctggtggtctagtggctaggattcggcgctttcaccgccgcggcccgggttcgattcccggtcagggaattgttttacactggccgccctcccgcaggaatcttccttcactacgctgtcagccggcctgctccaagggccagaagcagaacagtctccgcagcggggttaaagccgggcgaaggagggcaagtgcttgtggaccacctctcacgacacaccgttcctatttgtctccgtgtccgtcatccgcgggagcagctttagagagcgactgagcttctcgctcaggtgtacacagcccggcagagatgccagcccccgtggagctgcacccaataagcccaccttctttcccgtcgccaccccggagacgcccatcgggctgagctgcgaataactaagagagaggccaagccaagtcgtggcgtttgtggcagccccggacacgggcaccagccagtcagcggagcctcctcacctccgttgccagcgaaggcgctcgttaggccttgggaagaggcgaccggaggcgatgcccgcgaatttgttagggggg

SEQ ID NO: 97240 - DNA, 251 bp, Homo sapiens
ggtttcagtcctaaccagctcagcaccctaatggcttccctgagactggtgataggggctctgtaaaggacctcttgtcctgtatgtactcctttacaggactaatgacaggctccacaccttaaacataatagcttggcctggtctgttccttctggctgatgcttaagaccatcttcgctccacctgcaccttggagtgcatttttgggattttccctttcatccataccccttacttgagaatgctgt

SEQ ID NO: 97241 - DNA, 403 bp, Homo sapiens
ttcatttctttcaagtctggtggtttgtcactgcatgtacacttcattacacagacagcaaagcatgtagttgtgttgtagtgctaaacccaccatgacattttacaagaatacataatcaaaagagggaattgaccaacagagaagaaagtacacaaagaaacaaaagtatatggagttatagaagcagcagctacctctgggaatgttgaccctgcagtcactcaagagactctagatattggaagctgatccaaacttagaaaggagtatgacagtttgccacaggacaggaaaaatgtcactctatattataagctatgcaatgagaagaaaccaagccctgcttaaacgactctttatatgtaatttacaaagacagaaaacattttaattctcaaag

SEQ ID NO: 97242 - DNA, 371 bp, Homo sapiens
agatcatcaggaattagattctcataaggaacacacaacctagacccctcagaggtgcagttcacagtagggttcatgctcctatgagaacctaatgttgcagctgatctgacaggaggcagagctcagctggtaatgctcactcacctgctgctcacctctttctgtgtagctcggctcctaatagacctgtatgtgtccatggtctgcgagttggggacccctgcaggaagtcttgtaaatgcatgtcaggaaacttactgtttacagccacatagtttgtagtagtaagaaactagaacaattcaaatattcatcaagagaaaactggataaattgtggtcaattcatatgttcatacagaaaaaaag

SEQ ID NO: 97243 - DNA, 355 bp, Homo sapiens
cgtccctggccttcagtcagggttctgtctgttgactctccaacctcgaaagcagcagcggtattgtttctgagaaagtttgtttgcattgcttaggaaccgtaacaagcctctcttcataaggataggaagaagcccaagggcattagtgggaggcggataagggagcctaacttcccagtttggctatcattctttgcaaaatcacttctaatctccaaagaggagggggtttctcctctttcaagttgcttagaagggcacccacagatctgcttatttctcacagcatctctctgcccttgcaatctttcctctccacctcaccatccacttttagtgcaattagtgaatt

SEQ ID NO: 97244 - DNA, 744 bp, Homo sapiens
atgcctggctaatttaaaaaaatttttttgtagagacagggtctcactatgttgcccaggctggggtctgaaattcctggcctcaagtgatcctcctgcctcagcctctcaaagtgcatttggatattcttatactaatatgattattcttaccccctccttcatctacacctatttttgccttataataaggttttatagatttatttagcacaagaatgagctgatggttaactagataaagttattcaacaaaccattttccctaggtatttcatcctgaggaggctttaactccatcttccagtacgctttaactccatcttccaatatgctttaactccatcttccaatacacttgatcgtcaatatcagatcatgaaacttatttacatgaggtagtttagtcttaccaacaatgccagtattacatctttttgtgttgtgaccatggtataattcaatttcataaaaaagcaagaatttcaaaggtatttgctcttcctttcccacagaatctactcttgctcacacaagggcaaatgtcagtacaattagacaggacagttatttctgtaaattaattgggaacaaagccagtcagcccatcttatctctcaggtttgtactgaggctgagttccattgtgtgttattacacagcagggcccacctcacacctatggggaggacacagtaatatttacaagacctcctatccttattaactgtctcgtgggatata

SEQ ID NO: 97245 - DNA, 295 bp, Homo sapiens
cttttaagtccttgaatgcagaagggctcctttggaagattttatgcaagagaatgccatggaaagattatattatagtggatcactctggaagtgtcatgcggaatgaatggagaggtaggaagcggggttgggagagcaaacgtaaatctaaggtccaattgggaggctctgttggaatgagctggcgagagatgatgagggcctgatttaaggaacgattgtattgaaggcactaaggtattggcattcagcgaatgtacatgagtctcaactttctggtttacatctgaat

SEQ ID NO: 97246 - DNA, 645 bp, Homo sapiens
  misc_feature (604)..(605): n is a, c, g, or t
  misc_feature (638)..(638): n is a, c, g, or t
aagtagtattcctccatatgtctacatgttccaaatctatacaggtttttcaacacggttctcttcctctgctgctgctggctgtcttgaccattacacatcttttcttaatccttttctttgccaataacttttttcaataactcagttaaaatttatgactttttagcctaaatgcaaaatacttaatctttgatgacaaatttaaaagagcataagtcatctcatgactcatgagagtactatagtacttacagatatattaatgccggcagttccaagagctacggatcttcaacagctgtcagaggattgtgattgagaattctgataaaaatgcaatgaaattaaaattacctgcattttcaatgtgtgaaactgcatcaaaagcttatattcattttttgttatggaacttttaggttaaaaaaatcattttctgtttttacctaataaatcaccattagaatctgtaaagcactattcctttgggaactacctaggtctctagaagatagaggagagaaagaggggaagaaatagaaaaaaaaaaaacaagcggatagcaaagaaaaaatatgctgcagtgagctgaggtcacgcnnctgcactgcagcctgggtgacagtgagactccntcttata

SEQ ID NO: 97247 - DNA, 848 bp, Homo sapiens
aagtagtattcctccatatgtctacatgttccaaatctatacaggtttttcaacacggttctcttcctctgctgctgctggctgtcttgaccattacacatcttttcttaatccttttctttgccaataacttttttcaataactcagttaaaatttatgactttttagcctaaatgcaaaatacttaatctttgatgacaaatttaaaagagcataagtcatctcatgactcatgagagtactatagtacttacagatatattaatgccggcagttccaagagctacggatcttcaacagctgtcagaggattgtgattgagaattctgataaaaatgcaatgaaattaaaattacctgcattttcaatgtgtgaaactgcatcaaaagcttatattcattttttgttatggaacttttaggttaaaaaaatcattttctgtttttacctaataaatcaccattagaatctgtaaagcactattcctttgggaactacctaggtctctagaagatagaggagagaaagaggggaagaaatagaaaaaaaaaaaacaagcggatagcaaagaaaaaatatgctgcagaacttttcaggtcaaaaaccctagaagtgactatgttggtaggaagccctgactctgcaggaaacactatatctagtgtcctccataattcaagttgctcgggttttttttgtttttgttttttgagatggagtcttgctctgtcgcccaggctggagagcaatggctctatctcggctcactgcaacctccacctcctgggttcaagcgattctcctgcctcagcctcctgagtagctgggattacaggtgcctgccacc

SEQ ID NO: 97248 - DNA, 413 bp, Homo sapiens
aattataaacttttttctactctaagtgtaatgcacttatataaggctaagaaaagcatattttggcataaaaacaaaatccaagaagaaatttacttttgtaattccactatctccaatattaaaaatagaaaatgagttggaattctgttgtttttccctgaaaatttatagcttgttttctgatgttgttatgagaaggcattgtctgaaatttgaggatttagttcttatttttgaaatgtagtaaactaaaaccaattactttgcaactaattttcatgaccactttatggttattgttcatgaatctgagtctaaaagcagttgtttctacttaggaatagggcatagtagggtatggggcttggatactaataaaggacatgtgctgtgtgcacctaccgtcccat

SEQ ID NO: 97249 - DNA, 351 bp, Homo sapiens
agttgtctaggaagaaatatattgcttggagcctgaaactaaataattttgcacatgaaacaattgattctatgagtgtaggaaggtttgatttagtttgcatgtttaaattgtctatggtaataagttgttctttaagctttccttaaagaaatcaatttccctggattgtatcatgatgtgtaagagtgagtgtggcattttttagtaagcttattatgaaataatgaccaacacctccaggagatattcatagaggatttttttttttaattacaaagattatgtaacctctcctttcttacttgaaatcttaatctagtaaatcatagaggccatggtgttataaaa

SEQ ID NO: 97250 - DNA, 496 bp, Homo sapiens
aggtaggtaattagacatgtacaactaatactatacccaaactggttttacaatgctgaaatgcaaatttacatcctgagaatatgaagagagggtttacacacctcaaaaatcaaatgctgtttatacctgagctatatgacagctataggactcaagttataagcaataagagccaataaattaatactggtgaaaagggacttttctgaaaatactttgaatactagactatgcaagaaacccagcaggaatgtaggaaaaaaaaaacaggaaatctaagtccattatttgttttccttattatctaaacaacaatattaaaaagaaacaaataatggtttctaaataccattctccactaaaaggaactagagctctttggacaagtggatgattctaggacctaggcagaaaaatataaagatgagtttggaacatcttgttgcatcagaaagcaagaaatgatcacagaatgatgcagatacgtcaaaag

SEQ ID NO: 97251 - DNA, 199 bp, Homo sapiens
tgcccaggctggggtgcagtggtgcaatcatagttcaaggtaactttgaactcctaagctcaagccatactcctgccttggcctcccaaagtgctgagattcaggtgttagccaccatgtgctgcctctactttctttttaaagggggcaaagagtgaaggaaatactgtgattagggaagtggcaacgaggtgggagg

SEQ ID NO: 97252 - DNA, 119 bp, Homo sapiens
acgagaaagagatagaaaagtgaaaggtgtatgtgagattcccactcttgattcacctctttggctgaaatgcaatgtttgagtgagttttgttccacttgtttgttaggtattttctt

SEQ ID NO: 97253 - DNA, 284 bp, Homo sapiens
tatgatttgtatgacgttccataaaaggcaaatctatctatagtaacagaacagatcagtggttgcctcgggttgtgatagtagtgagatgagtcagcaacaaaagagaaaataaactgaagtaaccaaaaattataagtgttatgaaggaaacaaagcaggtggcagtatgtataaaggccctaagttggaaaagaagactgttgatggagtatagtgaacaaaggagtgagtggtgggagagctaaataagctaccaggtcatgcggaaagagtccttaaaa

SEQ ID NO: 97254 - DNA, 358 bp, Homo sapiens
cccttttattgacccagcacagtacacagtaaaatgtcatgccatttgcatgtaagtatgtttgataaacactataatgatgtaaatagccccagaattctgaatgccttattttatgatatatttataaacagccttattgaggttatgattgatatataataaactacacatcttgaaatatgtgatgttttgacatatgtataacctaagaaacatcacaaccaagacaatctatcaccaccatcacaaccaagacaatctatcaccaccaaaagtttattcatgcccctttaatccttcctcccactctgtcccaccattctccatccccaggcaatcactgctctgatctctt

SEQ ID NO: 97255 - DNA, 596 bp, Homo sapiens
tcttacaggaaatgcagggaagaaacataccctgggcctgctgcctacggacataaggcacagatctgaatttgtatacacaaacatcttcatcctctgaagaggacaaaaataccaacattcttgtattttccaacatttttcaaaataaggtaccaaaggcttaagaaactgaagaaagctgaaagaatccatgtcagaactcaatgatcgctattatttcaaggacccagagtggaaagaagagccaatgcatgaagaaccagacgccagacaggctagtggtcctacccaaagacacagctctctactggcaagggaagaacaagtgtcttttaatttctgggcctctgaagtgccattatcaatagtgcactaatcttttataggtagtagtaatgaatactttaaagggattaggccattcacaaaagaatcaaacaactgtaattattttttaaaatcctcactcatttatcgtcctctaaactcccaaatacaatactttaaatccactggggcttcacatgtacctagttgatacaaagttcccaatctaagcttgcaacctcatcaaaatacattattatagtacc

SEQ ID NO: 97256 - DNA, 401 bp, Homo sapiens
aattgaagggttattctctttggtgaaaaaattaggagtgggttgttacgacatgaaatacagagggcccttcccttttttgttttgaaacttagccattattattgtgtgacttacaatatgtattttaaaatttatattattttacagatctcacaaatctatgaggttgagagggcagatatactctatggatgagaaaacttaggctctactcgttcagggtcacactggtgacagctaagtcttttcagttacagcctgtgccctttgacatgttgcttttttcctctccccttattgtacatgccctagttccaggcctttgccattctggtgtttgaccatggctcacaaatctcttgctaatatctatccactccaggtaaaaagtctgcctg

SEQ ID NO: 97257 - DNA, 715 bp, Homo sapiens
aagggggtcaaagaaatattaaaaactttgtagtaatcatagctaacacttttattcagtacacttaaagcttttaacatttctgtgaggcaagttatgttatatataaaaaaaattgagtcttggatgtatgacattgaaggagttttagttttggttttggtttagtttttgctaactagcagtctaggtttcaaccaggcagccgggctctaaagttcttagaacatgtttgcatgctgtactatgcttctcccacaggatactaacttaaactgtggtggagcatgtcattatttaatgttttgaaatctgtaaatttatttctaaaatctggattgtgggaacactgaaagaatatcctcgctaaagaatgaaaatgggccaggcatattggctcacgcttgtaatcccgactacttgggaggctgagatgggaggattccctgagcccaaggaggccaaggctgcagtgagccatgatcaggccagtaaactccagcttgggcaagagagtgaggccctgtctcagaaaaaaaaaagaaagaaaatggaggagaggaggtctaaatcaacaattacagatgaagtcagattaagtacaaatctgtaagggatgtaaagcatgtgaattaactagaaagatggtattaaactgaggatacttttttttataagtgagacggagtttcactcttataaaaagtaaaggttg

SEQ ID NO: 97258 - DNA, 328 bp, Homo sapiens
tggttccagtgaccatggacctggggttcagggccagggttggggatgggcattccagggccagggttctgaggattcggaaatcagggctggggctgggtttggtgcgcacagacccggtttctggggtttgggttccaggaactgttaacaggggttctgacagggttttaatattggagtttcgaggtcaggatttgcagacaggagttcagaggcagggtcccagggtcaacggtcagctgctggagtctggaggatggggttcggggattcagggcccaggtcttcaggtctcgggcttggggatcaagacaggggtctgggc

SEQ ID NO: 97259 - DNA, 523 bp, Homo sapiens
gctccctctggttgctggtggagatgagactacggagggggggcagtgaagatcccagagaggaggctgctgtaatggtccaagcagaaggtgatagtgatttggatcagggtaacagagccgaggtggtgagaggttgacaggtcatgcatctatttcgaaggaaaggccatgtccaggctccttagctcggcattcaaggcttctctccaccactggacacacttactctctagcttctcagaccctgttgcagatagaatcatgatccccaatgatgtccacatcttaatcccctgaacctgtgaacaggtgaccttccatggcaaaagggactttgcagataggatgaagttaaagatctttagatgggggagcgattatcctggattgggtctgggtgggctcagtggaatcacaagagtccttatatgaggaagatagaaatttgagacatacggtagaggaggaggtgatgagaccacagaggcagggacgggcgtggtgcaaccacaagccaagg

SEQ ID NO: 97260 - DNA, 569 bp, Homo sapiens
ttattaactgtagtcctcatactgtacatcgtatctccaggcttagttatcttacataatggaaacttctgactctttgacctccatcttctcatcccctctccttccagtaaccaccttcctactttctgtttctatgtatgatgcatcttttccttgaaaattgttttaaagtttgcaactacaagaacagttatttagacttgaccattgcatttgacatttggtttttagcatctgttctttttttcagagatctttgcccgaattcattgatggtgtgtcttaatcatcttgagtaatttttttccctcagaattgctagtgatatgccctctgattccctgcatttttgaaaatgattttctttggcccataccaaggaaggataatttgactgtgaattgaattctctatatagaattatagcttaattttgttttcaaaatttaatcttcattctattatttacttattattatggatgaacagctgtaagtctgtctttcctttgtggataatttgttatttatctacccctatccatatacaggctcacacttattcac

SEQ ID NO: 97261 - DNA, 162 bp, Homo sapiens
cgttgctgtaggtaggggatgggcacatatgatttcatgatcttatatgcttctacctttctataagtttgaaaattcccatactaaaaagttaaagacaaaagaaaaaaaaattatatccactcattactcagggtctggtaaaacaaatgatcagaaact

SEQ ID NO: 97262 - DNA, 777 bp, Homo sapiens
actctcagagcatgtcagcctcaagtcagctagctcagcctccctcctcagccactctgcaggagttcagggagcaggaactctggtatcagagagactcaggccaagactctgccactcacccaggcatgtcacctctcagagacttcatttcctcccttctaataggggaagaatggtgcctactcatagggctactgtgaggatacatcaggcagcgtaagtaaagtactcccttctctacaatggtagcacaaccagctgactaaaaatcagttcgttcattcattcaactggaatgtgagtaaacaacaaagaccttgggaaatgtcgactgtcacggtccttgattttcctcactctctatggtgctacagtggcaaaacagtgggtacccccactgcccatcatcctggagcagaaatgagggggcccttggaaacggaccacacagaggcttcctctggggacctggctggtgcagtgtggcgagaccaggaggtcagttctcatggtggaggttgtcaagcactgatgatgagtggtacgggggggttttggctaatcaatcacatggttttgctccctgagatctgagccacttgacaaatagacacaaggtcaaaaaacaccaggttttcaaggtgagctggactgaagaatgcaatgtggacctgcctgtttccccccacccaacaaagtacaccctaaccctgatcatgacactaattgcaaccctaaccctaatcctagcccaccctggcaccccatgcaggg

SEQ ID NO: 97263 - DNA, 200 bp, Homo sapiens
gctgaggcaggaagatcgcttgagcccaggagatggaggctgcagtgagccatgtttgcgccactgcactccagcctgggcgacagagatgacatgtggatagacaaagcagggattgagacctcaagaaggtcagtgtcctgacaggcagacaggtgccctgggcttctgggggacctggtcctggggaaggcagcact

SEQ ID NO: 97264 - DNA, 4985 bp, Homo sapiens
agcggggcagcgaccgtgcccgccgctgggcggggccgcccttctccgagagcgtcagcccgctaggtccttgtccgcgcgggcggcacctcctctgcaggtaaatggaagagctggagaccagtttattccagacacggaaagcacatagaatagaacaaatggtggcaagatggcttcggcgctcccgggacagctcggcccgggctaaagttgctgcagctgatgggcccgccaggaacccaactcagaccctcatccctgtgcgacacacagtaaagatagacaaagacaccctcctccaggactatggatttcacatttctgagagccttccccttacagtggtggctgtcacagcaggaggctctgctcacggcaagcttttccctggtgatcagatcctccaaatgaacaatgagcctgctgaagacctttcctgggaacgagcagtcgatattctcagggaagcagaagattctctttcaatcacagttgttcgctgcacgtcgggagtccctaaatcgtccttcctgaccgaggagaagagagccagactgaagaccaaccccgtgaaggtgcactttgctgaagaagtgctcatcagtggacacagccagggtaattctctgctgtgtatgcccaacgtgctcaagctatacttggagaatggacagaccaaagctttcaagtttgaggcaaacacaaccgtgaaggacatcatcctcaccgtgaaggagaagctgtccatccgaagtatcgagtactttgcactggccctggaagagcagtacagcatctcccggctgcacctgctgcacgaagaggaactcatccagcaggtggtagaaagggaggagtcacatgactaccgctgcctcttcagggtctgttttgttcccaaggaccccctggacctcctgaaagaagaccccgtggcctttgaatacctctatctgcagagctgcagcgatgtgctccaggagcgctttgctgtagaaatgaaatgtagctctgcactccgactcgcggctctgcacatccaggaacggatctacgcctgtgcccagccacagaagatctctttaaagtatatagagaaagactggggaatagagaactttatatctccaactttactccgaaacatgaaaggcaaagacatcaagaaagccattagcttccacatgaagaggaaccagaatttgctggaaccccgacagaagcaacttatttctgctgcccagctacgtttaaattatctacagatcctcggagaactcaagacatatggtggaagaatctttaatgctactttaatgttacaggatagagaatcctacattgcccttctagttggagccaagtatgggattagccaggttatcaatagcaaactcaacatcatgtccacattggcagagtttgcaaacatcagccgtgtagagctaacggaagagtctgagaaagtgagcgtcgtcaaagtgtatcttcaggacgtcaaggttctgactttgctgctggaatccaacagtgcaaaagacctagcctgcctgattgctgggtactacaggctgttggttgacccagttacctccattttcctctggcctggaaacaaacaacaagcgcaccgggtatctgcagaagaaggctatgaatccagggcctgcagtgactcagaggagtcctctgaggtggactgcgtactcgaacctctctctgacaggcgcctggtgaaactggcaccctgcagatcactcataaaggaggagcagcctcctgggaacagccccacacctgaggtggctaggaggggccccagcacctgcggggccagcagcacgacagacagtgccgagtccgaggcgtccgactcagccaacactgagagccgcggctacaggaccagtggctcgagtgagtccatggacgctctggaagaggatgacttagacacctgctcctccagcaggtccaccttcttccactttggctcgccaggcctcgcagagagcattgactctgacagccaggaggagagaagcgggattgaaaccagtggcttcctctgtctcctggacctggcccagagagccaacccccagtgccagaagacagagttttccgagagtgctgctttggagacatttggctgggcaccagaactgagcacagtcaggctggaccccaggctgtatgaaggcagccacgccgactactacagcctgtgttccagtgtctccccggccagctacctgagtgacagttccgagagtacagcttcccggcaagggggagccccgccagcctggggtcagcagggctggactgaggcccagcccagttccatgctggaacccctggccctgcacccaccactggcctttgaggatggcagctcagatgaggaatactatgacgcggctgataagctcactcccccaggccccccgtcagggcccagagatgtttctactgcagaacccagtgccacaagcttgcagaataaggccagcacttctagccctgagaacagcctgccttgtgggccagatggaagacagccaagcaggaggggaggggtgaagaaatatgccaagaccctgaggaaaagaaggtctttcctacagaccgactacacctctcaggtctcatttcccctggtgccatcagcctccctggagagtgtagacgacgtgtgctactatgacagggagccctacctggcccttggtgcaccctccccaactgtgtcctctctgcaggacatgcagggtgagcctggccttctggagaccaaggccttggggctgctggctcctctgagggagaccaagagcacaaacccagcctccagggtcatggagatggagcccgagaccatggaaaccaaatcagtcatcgactctcgagtgtcttctatttctgccattcgcttccggattgaccccaacaataaagagaattctggtgttgtccctgctgccagctcctcagcaagcactcctcactgttctaacccaggttcatctggcccagatactgctcaggcaaggccttcccaaatcttacctctatctcaagacctggatgggattgcccccaaagaaccaaccatagagcatggagacagctccttctccctctccagtggtgaccctaacccagacagagcctgcctggccagcaacccaggactaaataatgtctctcaaggagacacactagagctccagttggagccccatgtccagttggaaatgggattggaatctttttgtacaaatcatatacaagaaactgcccccaaatacacagagcctttgttgtctcctagagatgagcctagaagtgatgaatgtggaataaatccaggagagaagatagcttctatccctacaaaggaagagccacaaggacaactatctctggaaagagacagagaagttacaaacaaaaatggcaccaacgtatttcaggaggagtctaggaaggattcaggtgactccccgggtgatgtgtcaaataatgtttcacagactcttgatattagctctccagctggtaaaatagtaacctccctttctttagatgctcctgtaacagggaccgagcagatcccaccacatccccctagagaccctcaaggacagagcagagaacccccagggcaaggctgccaggctcaagaacaaaaactattcgtagagttggatttagaccctgatttctttcttgggaagcagacagtttcaccagccgtccctccagaggggatcaaggcagaggcacctaaccatgtgacagggcaagatatagcccctagggacagccctgagtgggtctgttttaatcctgagccttccctgccagaaccactaccatgtccacaagaggatcctcacttagaaacttcaaaccattgcttactctcagaaggcaaaagtgacagctctagcatctgcctttctgctgagaagtcttttctgtgctttgccccagaaagccatcctgaagtctctgccagtctcagggtggccacatctttgggttttgcaggcatgaatgagatggtggctcccaggatagggatggaccagtgcagctgtcagttctcctatgccacatgcttccgtggcccgcagcctgagacagaggaagaagacagggacttggaagcacaccccatggcccccctcacctcaccgccctctgcgggaagcccggtggttctgccctggaggcctgcccgagcccacagctgcaccaccgcacccctgtcgaggaaaagccacatctggccagagtactgctccagggcactgagacagctgaaagccacccctgccagcacccctgagggcttcatccaactcatggagagcttgctggagctacaagacattttagaaacttcctggggggttggaaacaaacatcccccagagaagtgcacctggcactttaccgaaagccggagccgcctctgcatgggctcccagaagctcctgtcgagctgtcggcatgtgatcagaatggaccagtcccccgaagagatgcagggggccgtgcgtgacaccttccagcacctggtccagctggccggcctgtgctttcagttcacagactgtagccgctgctccgcccggcacagggaggcagcggggaacctgagggatgtggtgtacacctaccatcagtttatagaggctgctaaatcgacctgcgagagaggctaccacgacctgagtgtgaaactcctggcccgtcagtgcacggccctcacggccgccgtgttctgtttgacccagaagttccgggcatccacggccctgtaaacaggtcaacggcccaagggcctcctgccctgtcctgccttggacacttccctgagaagccccttccactctcccacccaccctcttcaaatgtttactatatagagtattcaaataaactgctgcttaatcttgaaagagtca

SEQ ID NO: 97265 - DNA, 468 bp, Homo sapiens
gtgctttttaatgtattttttctttcctgactcccagggcccagagatgtttctactgcagaacccagtgccacaagcttgcagaataaggccagcacttctagccctgagaacagcctgccttgtgggccagatggaagacagccaagcaggaggggaggggtgaagaaatatgccaagaccctgaggaaaagaaggtctttcctacagaccgactacacctctcaggtctcatttcccctggtgccatcagcctccctggagagtgtagacgacgtgtgctactatgacagggagccctacctggcccttggtgcaccctccccaactgtgtcctctctgcaggacatgcagggtgagcctggccttctggagaccaaggccttggggctgctggctcctctgagggagaccaagagcacaaacccagcctccagggtcatggagatggagcccgagaccatggaa

SEQ ID NO: 97266 - DNA, 169 bp, Homo sapiens
tataaaaagaatgtgtttaacactgcaacctagtaaacactgtatcctacaaaacacagattttatgaagtaatatttatcttcattacctgtgagatcctctaatagttttcctcttttctcttcacatttttctcctctatgccattcccttgtattctttctacta

SEQ ID NO: 97267 - DNA, 939 bp, Homo sapiens
gcacgaggaaggaacggttggatcgcacactgtctgcatccattattgccctcagatcttcaggcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaagtatctcccaaaattgtagagatttcttcagatatctccattaatgaagggaacaatattagcctcacctgcatagcaactggtagaccagagcctacggttacttggagacacatctctcccaaagcggttggctttgtgagtgaagacgaatacttggaaattcagggcatcacccgggagcagtcaggggactacgagtgcagtgcctccaatgacgtggccgcgcccgtggtacggagagtaaaggtcaccgtgaactatccaccatacatttcagaagccaagggtacaggtgtccccgtgggacaaaaggggacactgcagtgtgaagcctcagcagtcccctcagcagaattccagtggtacaaggatgacaaaagactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttgacgtaaaatagagagcagtagaaaagtggctaacagctgaggagccaagatggccgaataggaacagctccagtctacagctcccagtgtgagtgacgcaaaaga

SEQ ID NO: 97268 - DNA, 601 bp, Homo sapiens
ggctgctcccgggaggaaggcggcgcggaggccgggggcggccgctgagcttggcgtccgcgcggctccggtgcgggctgcgccgcgccttccccagcgagctaccgagcttggggccgccgcggtccgctcccgccgcccggcctctccctcctcggccaccgccgcagcccctgccccgccgagccccgccggacagcggcggccgcagcgcgcatttgggctccgaggaagttgaccgaggcggctgccgcaggataggatcccgggcccggatcgcacgaagcccgcgcggccgtctcctccgcgcgccacccctgcgcctcccgcgagctccacttcccatctgctattgtttccgattgttttccggtggcgagcccggctccgaaacttacaaagtgttggatgtcccccgttcgaactgagggactgcagaccgcctctgggtagctggatgaagcccaccccgtccccttctggagtgcccgtgcgcagcggagatgccaccttccccaaagctatggacaacgtgacggtccggcagggggagagcgccaccctcaggtggagaaactttcaagagaggtctgagggtgca

SEQ ID NO: 97269 - DNA, 385 bp, Homo sapiens
ttacgactagttctagcccacgcgtacgacacaaaagaactctgaggggcgtagcaaggagaccaaacacaggcacccagggagagcgcctggcatagccacagggccattgagatctgccacagggggtgtttgcccgctctcagtcgtctcccgagctgcagagtccccagcctggaaacaaggtttcagcattcccttacatggtaactacgccaggcccctgctgggctgaacacctggctgtggcattctcctccctggaggcttccactggcaggtcaggctgcaaggagggagttcagaagagaggagagaacacctcagtgcagggaagcggcacttgttttccatctcttacccagggcatcttcttagtcacagg

SEQ ID NO: 97270 - DNA, 3602 bp, Homo sapiens
ggctgctcccgggaggaaggcggcgcggaggccgggggcggccgctgagcttggcgtccgcgcggctccggtgcgggctgcgccgcgccttccccagcgagctaccgagcttggggccgccgcggtccgctcccgccgcccggcctctccctcctcggccaccgccgcagcccctgccccgccgagccccgccggacagcggcggccgcagcgcgcatttgggctccgaggaagttgaccgaggcggctgccgcaggataggatcccgggcccggatcgcacgaagcccgcgcggccgtctcctccgcgcgccacccctgcgcctcccgcgagctccacttcccatctgctattgtttccgattgttttccggtggcgagcccggctccgaaacttacaaagtgttggatgtcccccgttcgaactgagggactgcagaccgcctctgggtagctggatgaagcccaccccgtccccttctggtaccaaagtgcttactcctctccaaagtgccgtgtctgaactgccgctgggaagaagcggctcctgagacgcgcccacacctttcacctgccgcgcgcttccccctcctcggccaccttcccggcggaagcagcgaggagggagccccctttggccgtcctccgtggaaccggttttccgaggctggcaaaagccgaggctggatttgggggaggaatattagactcggaggagtctgcgcgcttttctcctccccgcgcctcccggtcgccgcgggttcaccgctcagtccccgcgctcgctccgcaccccacccacttcctgtgctcgcccggggggcgtgtgccgtgcggctgccggagttcggggaagttgtggctgtcgagaatgggggtctgtgggtacctgttcctgccctggaagtgcctcgtggtcgtgtctctcaggctgctgttccttgtacccacaggagtgcccgtgcgcagcggagatgccaccttccccaaagctatggacaacgtgacggtccggcagggggagagcgccaccctcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaagtatctcccaaaattgtagagatttcttcagatatctccattaatgaagggaacaatattagcctcacctgcatagcaactggtagaccagagcctacggttacttggagacacatctctcccaaagcggttggctttgtgagtgaagacgaatacttggaaattcagggcatcacccgggagcagtcaggggactacgagtgcagtgcctccaatgacgtggccgcgcccgtggtacggagagtaaaggtcaccgtgaactatccaccatacatttcagaagccaagggtacaggtgtccccgtgggacaaaaggggacactgcagtgtgaagcctcagcagtcccctcagcagaattccagtggtacaaggatgacaaaagactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttggtccaggcgccgtcagcgaggtgagcaacggcacgtcgaggagggcaggctgcgtctggctgctgcctcttctggtcttgcacctgcttctcaaattttgatgtgagtgccacttccccacccgggaaaggctgccgccaccaccaccaccaacacaacagcaatggcaacaccgacagcaaccaatcagatatatacaaatgaaattagaagaaacacagcctcatgggacagaaatttgagggaggggaacaaagaatactttggggggaaaagagttttaaaaaagaaattgaaaattgccttgcagatatttaggtacaatggagttttcttttcccaaacgggaagaacacagcacacccggcttggacccactgcaagctgcatcgtgcaacctctttggtgccagtgtgggcaagggctcagcctctctgcccacagagtgcccccacgtggaacattctggagctggccatcccaaattcaatcagtccatagagacgaacagaatgagaccttccggcccaagcgtggcgcttccggcccaagcgtggcgctgcgggcactttggtagactgtgccaccacggcgtgtgttgtgaaacgtgaaataaaaagagcaagaaagaaaaaggaaacaaaataagaccgtctgacagcaacaacggtcccacaaacaagtcacaaaagataccgttaaactttttttttttttttatcattttactacatgaacatcatggataacaagggattctgattcattattaatttcattaattatattttctgatatgagtctagaacttactgcaaaaacaagacaaaactaaaaaaatacaactgagaagggtgaagagaagtatgtttgttaaacagtaaaaatgaatagtatacttcttaactaggtttacaactggtggaccacacaccaggcactaatcacctggtgaggatttggcatatccaccaaaaaatgcatccgatttaaccaacatctccaccagcgctacggactcctcccaattctgacatctcttgcagacaatactatgctctctacacactgtttagaaatggaaaggtgatctgcactgtatcttgggtttgttggctatgcttcctttgatgacatatattatacagtatatatatacatatattttttttgttagagttctagccattttatttctccgcagggtcctttctcagacattactgcatgctgtatatggcgttagctgtgtgttgatcttctaaaagatgatagagtttactggtaattgtgtaatcagctcctgcctttttattttcttgggttatttacatgtcagagacatttataaaaagtgaaaggataaaaaaaaaaaaaaacaactaataccgggcgcagcatctttccaggtgtggctctgcgctaggccaccccaggtggccccgctttctccattctgccctgtggcgttaacagacagcaagcagctgaacaagcagtaccgtcagtacccacttgctttagcccattatgggaatctctgatgcctttgtgaccactggagagtttaatcctcttggtttattttatttcccacctttgtgtgagtgtgtatgaaagagaagaaaatgcaatttttaggtaatcttttttttttttcccctcccctgaaagtctgggaacctgagagtcctcggggaggggtcctggatgtgatgagggaaagggggattgggggatccgggagggtggggttgtctctgacttgacattaaaaagtgttccatgtccctcttca

SEQ ID NO: 97271 - DNA, 3185 bp, Homo sapiens
tttctgatactcagaagactcagagactgtcagtttaaaaaatgaaagtaatatagaaggggcaaagtggcatttatcattctatctctccaggctcctgtctctttaatcagctagcctgatttgcccagtaaatgattcctgagagtgtgtgtgcgtgtgtgtgtgtgtgtgtgcccgcgcgcgtgtgttgtagctctgtcaatccttggattagaaccaatgattgcagcttgtaggagggctgtccagggccagattgtacaatgtgtctcagtgccagagtatgagtggagataattacggagaagtcatactctctcacaccctcggctttcttgttgtgtccttcagcaaaacagtggatttaaatctccttgcacaagcttgagagcaacacaatctatcaggaaagaaagaaagaaaaaaaccgaacctgacaaaaaagaagaaaaagaagaagaaaaaaaatcatgaaaaccatccagccaaaaatgcacaattctatctcttgggcaatcttcacggggctggctgctctgtgtctcttccaaggagtgcccgtgcgcagcggagatgccaccttccccaaagctatggacaacgtgacggtccggcagggggagagcgccaccctcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaagtatctcccaaaattgtagagatttcttcagatatctccattaatgaagggaacaatattagcctcacctgcatagcaactggtagaccagagcctacggttacttggagacacatctctcccaaagcggttggctttgtgagtgaagacgaatacttggaaattcagggcatcacccgggagcagtcaggggactacgagtgcagtgcctccaatgacgtggccgcgcccgtggtacggagagtaaaggtcaccgtgaactatccaccatacatttcagaagccaagggtacaggtgtccccgtgggacaaaaggggacactgcagtgtgaagcctcagcagtcccctcagcagaattccagtggtacaaggatgacaaaagactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttggtccaggcgccgtcagcgaggtgagcaacggcacgtcgaggagggcaggctgcgtctggctgctgcctcttctggtcttgcacctgcttctcaaattttgatgtgagtgccacttccccacccgggaaaggctgccgccaccaccaccaccaacacaacagcaatggcaacaccgacagcaaccaatcagatatatacaaatgaaattagaagaaacacagcctcatgggacagaaatttgagggaggggaacaaagaatactttggggggaaaagagttttaaaaaagaaattgaaaattgccttgcagatatttaggtacaatggagttttcttttcccaaacgggaagaacacagcacacccggcttggacccactgcaagctgcatcgtgcaacctctttggtgccagtgtgggcaagggctcagcctctctgcccacagagtgcccccacgtggaacattctggagctggccatcccaaattcaatcagtccatagagacgaacagaatgagaccttccggcccaagcgtggcgctgcgggcactttggtagactgtgccaccacggcgtgtgttgtgaaacgtgaaataaaaagagcaagaaagaaaaaggaaacaaaataagaccgtctgacagcaacaacggtcccacaaacaagtcacaaaagataccgttaaactttttttttttttttatcattttactacatgaacatcatggataacaagggattctgattcattattaatttcattaattatattttctgatatgagtctagaacttactgcaaaaacaagacaaaactaaaaaaatacaactgagaagggtgaagagaagtatgtttgttaaacagtaaaaatgaatagtatacttcttaactaggtttacaactggtggaccacacaccaggcactaatcacctggtgaggatttggcatatccaccaaaaaatgcatccgatttaaccaacatctccaccagcgctacggactcctcccaattctgacatctcttgcagacaatactatgctctctacacactgtttagaaatggaaaggtgatctgcactgtatcttgggtttgttggctatgcttcctttgatgacatatattatacagtatatatatacatatattttttttgttagagttctagccattttatttctccgcagggtcctttctcagacattactgcatgctgtatatggcgttagctgtgtgttgatcttctaaaagatgatagagtttactggtaattgtgtaatcagctcctgcctttttattttcttgggttatttacatgtcagagacatttataaaaagtgaaaggataaaaaaaaaaaaaaacaactaataccgggcgcagcatctttccaggtgtggctctgcgctaggccaccccaggtggccccgctttctccattctgccctgtggcgttaacagacagcaagcagctgaacaagcagtaccgtcagtacccacttgctttagcccattatgggaatctctgatgcctttgtgaccactggagagtttaatcctcttggtttattttatttcccacctttgtgtgagtgtgtatgaaagagaagaaaatgcaatttttaggtaatcttttttttttttcccctcccctgaaagtctgggaacctgagagtcctcggggaggggtcctggatgtgatgagggaaagggggattgggggatccgggagggtggggttgtctctgacttgacattaaaaagtgttccatgtccctcttca

SEQ ID NO: 97272 - DNA, 3102 bp, Homo sapiens
ggctgctcccgggaggaaggcggcgcggaggccgggggcggccgctgagcttggcgtccgcgcggctccggtgcgggctgcgccgcgccttccccagcgagctaccgagcttggggccgccgcggtccgctcccgccgcccggcctctccctcctcggccaccgccgcagcccctgccccgccgagccccgccggacagcggcggccgcagcgcgcatttgggctccgaggaagttgaccgaggcggctgccgcaggataggatcccgggcccggatcgcacgaagcccgcgcggccgtctcctccgcgcgccacccctgcgcctcccgcgagctccacttcccatctgctattggctgccggagttcggggaagttgtggctgtcgagaatgggggtctgtgggtacctgttcctgccctggaagtgcctcgtggtcgtgtctctcaggctgctgttccttgtacccacaggagtgcccgtgcgcagcggagatgccaccttccccaaagctatggacaacgtgacggtccggcagggggagagcgccaccctcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaagtatctcccaaaattgtagagatttcttcagatatctccattaatgaagggaacaatattagcctcacctgcatagcaactggtagaccagagcctacggttacttggagacacatctctcccaaagcggttggctttgtgagtgaagacgaatacttggaaattcagggcatcacccgggagcagtcaggggactacgagtgcagtgcctccaatgacgtggccgcgcccgtggtacggagagtaaaggtcaccgtgaactatccaccatacatttcagaagccaagggtacaggtgtccccgtgggacaaaaggggacactgcagtgtgaagcctcagcagtcccctcagcagaattccagtggtacaaggatgacaaaagactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttggtccaggcgccgtcagcgaggtgagcaacggcacgtcgaggagggcaggctgcgtctggctgctgcctcttctggtcttgcacctgcttctcaaattttgatgtgagtgccacttccccacccgggaaaggctgccgccaccaccaccaccaacacaacagcaatggcaacaccgacagcaaccaatcagatatatacaaatgaaattagaagaaacacagcctcatgggacagaaatttgagggaggggaacaaagaatactttggggggaaaagagttttaaaaaagaaattgaaaattgccttgcagatatttaggtacaatggagttttcttttcccaaacgggaagaacacagcacacccggcttggacccactgcaagctgcatcgtgcaacctctttggtgccagtgtgggcaagggctcagcctctctgcccacagagtgcccccacgtggaacattctggagctggccatcccaaattcaatcagtccatagagacgaacagaatgagaccttccggcccaagcgtggcgctgcgggcactttggtagactgtgccaccacggcgtgtgttgtgaaacgtgaaataaaaagagcaagaaagaaaaaggaaacaaaataagaccgtctgacagcaacaacggtcccacaaacaagtcacaaaagataccgttaaactttttttttttttttatcattttactacatgaacatcatggataacaagggattctgattcattattaatttcattaattatattttctgatatgagtctagaacttactgcaaaaacaagacaaaactaaaaaaatacaactgagaagggtgaagagaagtatgtttgttaaacagtaaaaatgaatagtatacttcttaactaggtttacaactggtggaccacacaccaggcactaatcacctggtgaggatttggcatatccaccaaaaaatgcatccgatttaaccaacatctccaccagcgctacggactcctcccaattctgacatctcttgcagacaatactatgctctctacacactgtttagaaatggaaaggtgatctgcactgtatcttgggtttgttggctatgcttcctttgatgacatatattatacagtatatatatacatatattttttttgttagagttctagccattttatttctccgcagggtcctttctcagacattactgcatgctgtatatggcgttagctgtgtgttgatcttctaaaagatgatagagtttactggtaattgtgtaatcagctcctgcctttttattttcttgggttatttacatgtcagagacatttataaaaagtgaaaggataaaaaaaaaaaaaaacaactaataccgggcgcagcatctttccaggtgtggctctgcgctaggccaccccaggtggccccgctttctccattctgccctgtggcgttaacagacagcaagcagctgaacaagcagtaccgtcagtacccacttgctttagcccattatgggaatctctgatgcctttgtgaccactggagagtttaatcctcttggtttattttatttcccacctttgtgtgagtgtgtatgaaagagaagaaaatgcaatttttaggtaatcttttttttttttcccctcccctgaaagtctgggaacctgagagtcctcggggaggggtcctggatgtgatgagggaaagggggattgggggatccgggagggtggggttgtctctgacttgacattaaaaagtgttccatgtccctcttca

SEQ ID NO: 97273 - DNA, 2395 bp, Homo sapiens
tgggaattgaaagatgagatggtgcagagtgtctcctttgggaggatgtctcatttgagagaatgcccctgcctcggggctacccctgtttccttctccttctgtccaacttggtccaggtctggtgtcctggatgtgctgctgaagagacaggttccgggggtggtgagcgcatgtacctgtggggtgggctgcgcagactggatatggtcacatagtgccagccactcaccagcctgagatggagatgatgatgatggagagcttcagaggggctgctcaggcttttcccagatatactacaagcaagagaatggctggcaggcacttggtggcctttttctgtcttccataggaagaattttctaacacaacaaacaggtgaggacacgactcgtctttacaagctctctgtggtgcttcccagcatggagcagatccacaaaagaactctgaggggcgtagcaaggagaccaaacacaggcacccagggagagcgcctggcatagccacagggccattgagatctgccacagggggtgtttgcccgctctcagtcgtctcccgagctgcagagtccccagcctggaaacaaggtttcagcattcccttacatggtccaggcgccgtcagcgaggtgagcaacggcacgtcgaggagggcaggctgcgtctggctgctgcctcttctggtcttgcacctgcttctcaaattttgatgtgagtgccacttccccacccgggaaaggctgccgccaccaccaccaccaacacaacagcaatggcaacaccgacagcaaccaatcagatatatacaaatgaaattagaagaaacacagcctcatgggacagaaatttgagggaggggaacaaagaatactttggggggaaaagagttttaaaaaagaaattgaaaattgccttgcagatatttaggtacaatggagttttcttttcccaaacgggaagaacacagcacacccggcttggacccactgcaagctgcatcgtgcaacctctttggtgccagtgtgggcaagggctcagcctctctgcccacagagtgcccccacgtggaacattctggagctggccatcccaaattcaatcagtccatagagacgaacagaatgagaccttccggcccaagcgtggcgctgcgggcactttggtagactgtgccaccacggcgtgtgttgtgaaacgtgaaataaaaagagcaagaaagaaaaaggaaacaaaataagaccgtctgacagcaacaacggtcccacaaacaagtcacaaaagataccgttaaactttttttttttttttatcattttactacatgaacatcatggataacaagggattctgattcattattaatttcattaattatattttctgatatgagtctagaacttactgcaaaaacaagacaaaactaaaaaaatacaactgagaagggtgaagagaagtatgtttgttaaacagtaaaaatgaatagtatacttcttaactaggtttacaactggtggaccacacaccaggcactaatcacctggtgaggatttggcatatccaccaaaaaatgcatccgatttaaccaacatctccaccagcgctacggactcctcccaattctgacatctcttgcagacaatactatgctctctacacactgtttagaaatggaaaggtgatctgcactgtatcttgggtttgttggctatgcttcctttgatgacatatattatacagtatatatatacatatattttttttgttagagttctagccattttatttctccgcagggtcctttctcagacattactgcatgctgtatatggcgttagctgtgtgttgatcttctaaaagatgatagagtttactggtaattgtgtaatcagctcctgcctttttattttcttgggttatttacatgtcagagacatttataaaaagtgaaaggataaaaaaaaaaaaaaacaactaataccgggcgcagcatctttccaggtgtggctctgcgctaggccaccccaggtggccccgctttctccattctgccctgtggcgttaacagacagcaagcagctgaacaagcagtaccgtcagtacccacttgctttagcccattatgggaatctctgatgcctttgtgaccactggagagtttaatcctcttggtttattttatttcccacctttgtgtgagtgtgtatgaaagagaagaaaatgcaatttttaggtaatcttttttttttttcccctcccctgaaagtctgggaacctgagagtcctcggggaggggtcctggatgtgatgagggaaagggggattgggggatccgggagggtggggttgtctctgacttgacattaaaaagtgttccatgtccctcttca

SEQ ID NO: 97274 - DNA, 1443 bp, Homo sapiens
tttctgatactcagaagactcagagactgtcagtttaaaaaatgaaagtaatatagaaggggcaaagtggcatttatcattctatctctccaggctcctgtctctttaatcagctagcctgatttgcccagtaaatgattcctgagagtgtgtgtgcgtgtgtgtgtgtgtgtgtgcccgcgcgcgtgtgttgtagctctgtcaatccttggattagaaccaatgattgcagcttgtaggagggctgtccagggccagattgtacaatgtgtctcagtgccagagtatgagtggagataattacggagaagtcatactctctcacaccctcggctttcttgttgtgtccttcagcaaaacagtggatttaaatctccttgcacaagcttgagagcaacacaatctatcaggaaagaaagaaagaaaaaaaccgaacctgacaaaaaagaagaaaaagaagaagaaaaaaaatcatgaaaaccatccagccaaaaatgcacaattctatctcttgggcaatcttcacggggctggctgctctgtgtctcttccaaggagtgcccgtgcgcagcggagatgccaccttccccaaagctatggacaacgtgacggtccggcagggggagagcgccaccctcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaagtatctcccaaaattgtagagatttcttcagatatctccattaatgaagggaacaatattagcctcacctgcatagcaactggtagaccagagcctacggttacttggagacacatctctcccaaagcggttggctttgtgagtgaagacgaatacttggaaattcagggcatcacccgggagcagtcaggggactacgagtgcagtgcctccaatgacgtggccgcgcccgtggtacggagagtaaaggtcaccgtgaactatccaccatacatttcagaagccaagggtacaggtgtccccgtgggacaaaaggggacactgcagtgtgaagcctcagcagtcccctcagcagaattccagtggtacaaggatgacaaaagactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttgaagtgaaaactacagccctgaccccttggaaaggtt

SEQ ID NO: 97275 - DNA, 3535 bp, Homo sapiens
ggctgctcccgggaggaaggcggcgcggaggccgggggcggccgctgagcttggcgtccgcgcggctccggtgcgggctgcgccgcgccttccccagcgagctaccgagcttggggccgccgcggtccgctcccgccgcccggcctctccctcctcggccaccgccgcagcccctgccccgccgagccccgccggacagcggcggccgcagcgcgcatttgggctccgaggaagttgaccgaggcggctgccgcaggatccgcgagctccacttcccatctgctattgtttccgattgttttccggtggcgagcccggctccgaaacttacaaagtgttggatgtcccccgttcgaactgagggactgcagaccgcctctgggtagctggatgaagcccaccccgtccccttctggtaccaaagtgcttactcctctccaaagtgccgtgtctgaactgccgctgggaagaagcggctcctgagacgcgcccacacctttcacctgccgcgcgcttccccctcctcggccaccttcccggcggaagcagcgaggagggagccccctttggccgtcctccgtggaaccggttttccgaggctggcaaaagccgaggctggatttgggggaggaatattagactcggaggagtctgcgcgcttttctcctccccgcgcctcccggtcgccgcgggttcaccgctcagtccccgcgctcgctccgcaccccacccacttcctgtgctcgcccggggggcgtgtgccgtgcggctgccggagttcggggaagttgtggctgtcgagaatgggggtctgtgggtacctgttcctgccctggaagtgcctcgtggtcgtgtctctcaggctgctgttccttgtacccacaggagtgcccgtgcgcagcggagatgccaccttccccaaagctatggacaacgtgacggtccggcagggggagagcgccaccctcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaagtatctcccaaaattgtagagatttcttcagatatctccattaatgaagggaacaatattagcctcacctgcatagcaactggtagaccagagcctacggttacttggagacacatctctcccaaagcggttggctttgtgagtgaagacgaatacttggaaattcagggcatcacccgggagcagtcaggggactacgagtgcagtgcctccaatgacgtggccgcgcccgtggtacggagagtaaaggtcaccgtgaactatccaccatacatttcagaagccaagggtacaggtgtccccgtgggacaaaaggggacactgcagtgtgaagcctcagcagtcccctcagcagaattccagtggtacaaggatgacaaaagactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttggtccaggcgccgtcagcgaggtgagcaacggcacgtcgaggagggcaggctgcgtctggctgctgcctcttctggtcttgcacctgcttctcaaattttgatgtgagtgccacttccccacccgggaaaggctgccgccaccaccaccaccaacacaacagcaatggcaacaccgacagcaaccaatcagatatatacaaatgaaattagaagaaacacagcctcatgggacagaaatttgagggaggggaacaaagaatactttggggggaaaagagttttaaaaaagaaattgaaaattgccttgcagatatttaggtacaatggagttttcttttcccaaacgggaagaacacagcacacccggcttggacccactgcaagctgcatcgtgcaacctctttggtgccagtgtgggcaagggctcagcctctctgcccacagagtgcccccacgtggaacattctggagctggccatcccaaattcaatcagtccatagagacgaacagaatgagaccttccggcccaagcgtggcgcttccggcccaagcgtggcgctgcgggcactttggtagactgtgccaccacggcgtgtgttgtgaaacgtgaaataaaaagagcaagaaagaaaaaggaaacaaaataagaccgtctgacagcaacaacggtcccacaaacaagtcacaaaagataccgttaaactttttttttttttttatcattttactacatgaacatcatggataacaagggattctgattcattattaatttcattaattatattttctgatatgagtctagaacttactgcaaaaacaagacaaaactaaaaaaatacaactgagaagggtgaagagaagtatgtttgttaaacagtaaaaatgaatagtatacttcttaactaggtttacaactggtggaccacacaccaggcactaatcacctggtgaggatttggcatatccaccaaaaaatgcatccgatttaaccaacatctccaccagcgctacggactcctcccaattctgacatctcttgcagacaatactatgctctctacacactgtttagaaatggaaaggtgatctgcactgtatcttgggtttgttggctatgcttcctttgatgacatatattatacagtatatatatacatatattttttttgttagagttctagccattttatttctccgcagggtcctttctcagacattactgcatgctgtatatggcgttagctgtgtgttgatcttctaaaagatgatagagtttactggtaattgtgtaatcagctcctgcctttttattttcttgggttatttacatgtcagagacatttataaaaagtgaaaggataaaaaaaaaaaaaaacaactaataccgggcgcagcatctttccaggtgtggctctgcgctaggccaccccaggtggccccgctttctccattctgccctgtggcgttaacagacagcaagcagctgaacaagcagtaccgtcagtacccacttgctttagcccattatgggaatctctgatgcctttgtgaccactggagagtttaatcctcttggtttattttatttcccacctttgtgtgagtgtgtatgaaagagaagaaaatgcaatttttaggtaatcttttttttttttcccctcccctgaaagtctgggaacctgagagtcctcggggaggggtcctggatgtgatgagggaaagggggattgggggatccgggagggtggggttgtctctgacttgacattaaaaagtgttccatgtccctcttca

SEQ ID NO: 97276 - DNA, 3303 bp, Homo sapiens
tttctgatactcagaagactcagagactgtcagtttaaaaaatgaaagtaatatagaaggggcaaagtggcatttatcattctatctctccaggctcctgtctctttaatcagctagcctgatttgcccagtaaatgattcctgagagtgtgtgtgcgtgtgtgtgtgtgtgtgtgcccgcgcgcgtgtgttgtagctctgtcaatccttggattagaaccaatgattgcagcttgtaggagggctgtccagggccagattgtacaatgtgtctcagtgccagagtatgagtggagataattacggagaagtcatactctctcacaccctcggctttcttgttgtgtccttcagcaaaacagtggatttaaatctccttgcacaagcttgagagcaacacaatctatcaggaaagaaagaaagaaaaaaaccgaacctgacaaaaaagaagaaaaagaagaagaaaaaaaatcatgaaaaccatccagccaaaaatgcacaattctatctcttgggcaatcttcacggggctggctgctctgtgtctcttccaaggagtgcccgtgcgcagcggagatgccaccttccccaaagctatggacaacgtgacggtccggcagggggagagcgccaccctcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaagtatctcccaaaattgtagagatttcttcagatatctccattaatgaagggaacaatattagcctcacctgcatagcaactggtagaccagagcctacggttacttggagacacatctctcccaaagcggttggctttgtgagtgaagacgaatacttggaaattcagggcatcacccgggagcagtcaggggactacgagtgcagtgcctccaatgacgtggccgcgcccgtggtacggagagtaaaggtcaccgtgaactatccaccatacatttcagaagccaagggtacaggtgtccccgtgggacaaaaggggacactgcagtgtgaagcctcagcagtcccctcagcagaattccagtggtacaaggatgacaaaagagctgaaatctcattcacagtttggttatgatgggaaagcttcctccccatggtggacgaatggtgtcaaaacggccagtgggatcaatcagcctgacttgctcgcagaatcctcccgactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttggtccaggcgccgtcagcgaggtgagcaacggcacgtcgaggagggcaggctgcgtctggctgctgcctcttctggtcttgcacctgcttctcaaattttgatgtgagtgccacttccccacccgggaaaggctgccgccaccaccaccaccaacacaacagcaatggcaacaccgacagcaaccaatcagatatatacaaatgaaattagaagaaacacagcctcatgggacagaaatttgagggaggggaacaaagaatactttggggggaaaagagttttaaaaaagaaattgaaaattgccttgcagatatttaggtacaatggagttttcttttcccaaacgggaagaacacagcacacccggcttggacccactgcaagctgcatcgtgcaacctctttggtgccagtgtgggcaagggctcagcctctctgcccacagagtgcccccacgtggaacattctggagctggccatcccaaattcaatcagtccatagagacgaacagaatgagaccttccggcccaagcgtggcgctgcgggcactttggtagactgtgccaccacggcgtgtgttgtgaaacgtgaaataaaaagagcaagaaagaaaaaggaaacaaaataagaccgtctgacagcaacaacggtcccacaaacaagtcacaaaagataccgttaaactttttttttttttttatcattttactacatgaacatcatggataacaagggattctgattcattattaatttcattaattatattttctgatatgagtctagaacttactgcaaaaacaagacaaaactaaaaaaatacaactgagaagggtgaagagaagtatgtttgttaaacagtaaaaatgaatagtatacttcttaactaggtttacaactggtggaccacacaccaggcactaatcacctggtgaggatttggcatatccaccaaaaaatgcatccgatttaaccaacatctccaccagcgctacggactcctcccaattctgacatctcttgcagacaatactatgctctctacacactgtttagaaatggaaaggtgatctgcactgtatcttgggtttgttggctatgcttcctttgatgacatatattatacagtatatatatacatatattttttttgttagagttctagccattttatttctccgcagggtcctttctcagacattactgcatgctgtatatggcgttagctgtgtgttgatcttctaaaagatgatagagtttactggtaattgtgtaatcagctcctgcctttttattttcttgggttatttacatgtcagagacatttataaaaagtgaaaggataaaaaaaaaaaaaaacaactaataccgggcgcagcatctttccaggtgtggctctgcgctaggccaccccaggtggccccgctttctccattctgccctgtggcgttaacagacagcaagcagctgaacaagcagtaccgtcagtacccacttgctttagcccattatgggaatctctgatgcctttgtgaccactggagagtttaatcctcttggtttattttatttcccacctttgtgtgagtgtgtatgaaagagaagaaaatgcaatttttaggtaatcttttttttttttcccctcccctgaaagtctgggaacctgagagtcctcggggaggggtcctggatgtgatgagggaaagggggattgggggatccgggagggtggggttgtctctgacttgacattaaaaagtgttccatgtccctcttca

SEQ ID NO: 97277 - DNA, 2524 bp, Homo sapiens
gaacagctattccagtgttgcagtagaatttattcccattcggactccctgactttgtgtttaaataggaggaaatcaaagctaaattaaagagtatctcccaaaattgtagagatttcttcagatatctccattaatgaagggaacaatattagcctcacctgcatagcaactggtagaccagagcctacggttacttggagacacatctctcccaaagcggttggctttgtgagtgaagacgaatacttggaaattcagggcatcacccgggagcagtcaggggactacgagtgcagtgcctccaatgacgtggccgcgcccgtggtacggagagtaaaggtcaccgtgaactatccaccatacatttcagaagccaagggtacaggtgtccccgtgggacaaaaggggacactgcagtgtgaagcctcagcagtcccctcagcagaattccagtggtacaaggatgacaaaagagctgaaatctcattcacagtttggttatgatgggaaagcttcctccccatggtggacgaatggtgtcaaaacggccagtgggatcaatcagcctgacttgctcgcagaatcctcccgactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttggtccaggcgccgtcagcgaggtgagcaacggcacgtcgaggagggcaggctgcgtctggctgctgcctcttctggtcttgcacctgcttctcaaattttgatgtgagtgccacttccccacccgggaaaggctgccgccaccaccaccaccaacacaacagcaatggcaacaccgacagcaaccaatcagatatatacaaatgaaattagaagaaacacagcctcatgggacagaaatttgagggaggggaacaaagaatactttggggggaaaagagttttaaaaaagaaattgaaaattgccttgcagatatttaggtacaatggagttttcttttcccaaacgggaagaacacagcacacccggcttggacccactgcaagctgcatcgtgcaacctctttggtgccagtgtgggcaagggctcagcctctctgcccacagagtgcccccacgtggaacattctggagctggccatcccaaattcaatcagtccatagagacgaacagaatgagaccttccggcccaagcgtggcgctgcgggcactttggtagactgtgccaccacggcgtgtgttgtgaaacgtgaaataaaaagagcaagaaagaaaaaggaaacaaaataagaccgtctgacagcaacaacggtcccacaaacaagtcacaaaagataccgttaaactttttttttttttttatcattttactacatgaacatcatggataacaagggattctgattcattattaatttcattaattatattttctgatatgagtctagaacttactgcaaaaacaagacaaaactaaaaaaatacaactgagaagggtgaagagaagtatgtttgttaaacagtaaaaatgaatagtatacttcttaactaggtttacaactggtggaccacacaccaggcactaatcacctggtgaggatttggcatatccaccaaaaaatgcatccgatttaaccaacatctccaccagcgctacggactcctcccaattctgacatctcttgcagacaatactatgctctctacacactgtttagaaatggaaaggtgatctgcactgtatcttgggtttgttggctatgcttcctttgatgacatatattatacagtatatatatacatatattttttttgttagagttctagccattttatttctccgcagggtcctttctcagacattactgcatgctgtatatggcgttagctgtgtgttgatcttctaaaagatgatagagtttactggtaattgtgtaatcagctcctgcctttttattttcttgggttatttacatgtcagagacatttataaaaagtgaaaggataaaaaaaaaaaaaaacaactaataccgggcgcagcatctttccaggtgtggctctgcgctaggccaccccaggtggccccgctttctccattctgccctgtggcgttaacagacagcaagcagctgaacaagcagtaccgtcagtacccacttgctttagcccattatgggaatctctgatgcctttgtgaccactggagagtttaatcctcttggtttattttatttcccacctttgtgtgagtgtgtatgaaagagaagaaaatgcaatttttaggtaatcttttttttttttcccctcccctgaaagtctgggaacctgagagtcctcggggaggggtcctggatgtgatgagggaaagggggattgggggatccgggagggtggggttgtctctgacttgacattaaaaagtgttccatgtccctcttca

SEQ ID NO: 97278 - DNA, 371 bp, Homo sapiens
aaaatacgagcaaaccaaatctagcagcacatcaaaaaattaattcaccatgatcaagcaggctttctgcctgagatgcaaggctgattcaagatacgcaaataaataaatgtgatacatcatataaacagaattaaaaacaaaaaacatatgatcatttcagtaaacacagaaaaaaactttcaataaaatccaacatcctttcatgatgaaaatcctcaacaaactaggcattgagggaacatactccaaaataataagagccatttatgacaaacccacagccaacatactgaacaagcaaaagctgagatcatttcctttaagaacagaaacaagacaaggatgcccactcacactactcctattca

SEQ ID NO: 97279 - DNA, 757 bp, Homo sapiens
aagtgcctgtcgcttggagacggagtgactccaaacgggctcacacggttttctgagaaacataaagggaaaccgaatccaccaatatatatatatattttcttgagacggcgtctcgctctgtcacccaggctggagtgcagtggcgtgatctcggctcactgcaaactccgcctcccgggttgacgccattcttctgcctcagcctcccgagtagctgggactacaggcgcccgccgccacgcccggctaatttttttgtattttagtagagacggggagtcaccgtgttgcccaggctggtcgcgaactcctgagctcaggcaatccgcccgccttggcctcccaaagtgctaggattacaggcgtgagccaccgcgcccggcccaccaatactcaattggtttgacttcagttgaggaaaccagaaaaaatttaaatatatttatggaaagaagctattgggagagtggctgagtactgagtctatcactacttggatgatacagcttctgtcttcaagataagcagaattgttcagaatccactggaatccaaattcaacttgggcctcaatttctgcagatggacacctctggactccaaaaaatccaaggacataaaaaacttaagcagcctttattacatttagttcaacaagtttaaagtgtaggtcactttccacttttgtttacttgatgcttaattttactggaatcgttaaaagaaatatacttgcaatttttttaaaaaggta

SEQ ID NO: 97280 - DNA, 341 bp, Homo sapiens
taggttgtggcatagaatctggagaagggctaatatatgcacatatacctattctaacagcaatagagttataattttaaatcattttgtatcacatttgtcagagttgcaaatgacattaatattgaatgagtaatttttagtgaagtttatgtggaacataaaataacttttccagagagataacttaatccttgagttatacatgttttaaatagattttcatactatattaacaaaactggaatgtgacactgggggtttcctgctgcattttttatgtgggctcataaagctgtgggtttctacagaggttctcctagagcttcctaacagtgagg

SEQ ID NO: 97281 - DNA, 317 bp, Homo sapiens
  misc_feature (55)..(55): n is a, c, g, or t
tccattccctacggctcctgggtcgttctggagcttggcttttttaggatggggnttttcgttctgtgggtggcagggaaggtggcaagtgggctagcccctcagtgtagggctgcagggagaggagtggggaggcagggaggaagggaggctcccatgtttacctgcctggggaagaaactccttgttggaggattgcactgtgggctcggcagctggggtcctttgccaggccagtggggccagctcagcagagtaccaaaggctctggagtggcctagattcctacctgctcaggccttttccccaaaatactg

SEQ ID NO: 97282 - DNA, 283 bp, Homo sapiens
tcacactgagcctggccaaagctggactacttgtaagcttttgtctggaacctgatttgggagccagtggcccgaggacgatgaaaactatcagaggtggctgggcacagtggttcatgcctataatcccagcactttgggaggcggaggtggatggatcacttgaggtcaggagtttgagaccaacctggccaacatggcaaaaccagtctttactaaatatacaaaaactggccaggcatggtggctcacgcctctaatcccagcactttgggaggccgag

SEQ ID NO: 97283 - DNA, 182 bp, Homo sapiens
tgggtacagccacgtgatttgataagattgctgggaggcctaagtgaattatgtacataggagcatttaatgcagtgcctggcacatagtaggtattcagtaactattgtctattattattattatttttgagacagagtctcgctcttttgcctaggctggagtgcagtggcacgatcttg

SEQ ID NO: 97284 - DNA, 397 bp, Homo sapiens
ccttctctaacttaggtgtcagcacttcaatctctaaagcctcatcaagatgcttccatctgccttacttcacatcaaataaggcaccaagcctatcaattttatctgtatttcttaaatctattctcttttatcctactatactgcctctgctctaagattttaggatttattctttcctagattcttgcaataacctaattgggttcccatcttctggtgttactatctgtacagttagcttcctcattgtatcacactaatttatttaaaacacgaatttgatcaaatgactcccctcttaaaagtcttcaaatggctctcttcaagtacggaaaaaggtcaaactctttgcattacccacaaggttttataaaattcactgcttatctacatc

SEQ ID NO: 97285 - DNA, 448 bp, Homo sapiens
gtgatttatacgggagtatgtattcaatgggtgtacattattatcacgtgtatactagcatatgctcgggcacagggaggaactagatagagacccaaactatgaacacttatttagtatcctttgggttgaagtttgggcagaaaaagggtgaaaggagatactgtcttttgatacaaatgcttctgtttgcttgaatctcttgcgtgcaaatgtagccatgtatcatttcagtaattaaacatagaaaaagcaaaacaagccgaactggtgctttgttttttgaacctggagttaagaaggtaagaaagaagcattgtcagtatctgcattccaagctgttaccaaagaatggagctgttaattgtctcctgctgtctcaataacaaaaatctggatgagagaattcttcttcagggaggatcattcaaaggtcaagcagcccatt

SEQ ID NO: 97286 - DNA, 221 bp, Homo sapiens
caatcctgtggtccagacactgctgagtgtctcctgggtggcaacgtcacccccgtttcagaaccactagcataactgaagtcactgtctcaggctcatctccctggtctctccattttccttattcctcacacccagcgcataagcagttcctttagaactgctgcacggctctcatctccatgagcaccgccaggtcccctgcgctggctggtcgggcc

SEQ ID NO: 97287 - DNA, 329 bp, Homo sapiens
ctatttaataatctagcactaaaacttatgaattatttatatgttcattttaagaatgaaactgaatactactcatattcctttaaatatattttaccaatattataaaacttgattctacctttttttcatatttctgaagaaaactaaccttctgactctgcttaagactatttcttgttgttttcttattgttcacaatcttctgcttatggtccagaaagagactccagccctggatacccaacagctgttcctggtttaaggcctaacatcttaatggaccttgggttggacatgtattttgttgcctaccaatcgtcagagaa

SEQ ID NO: 97288 - DNA, 627 bp, Homo sapiens
attgcagcactggggctcacccaaagaccatggtcactacagaattgctgccactgaaatttatttgaggcccaagaccatttcagtcagctagggcttaagcccttctgccgtggctgtggctacagatttctatcttgcctggtgttctgttgccactgcgtgtcgtgacccaggggtccccatgaatgggactcgaaatggggatggaagagaacctggggacactgttgtttttcaatgtgacccaggatatgaacttcaaggagaggaaagaataacctgcattcaggtagaaaatcggtacttctggcagcccagcccaccagtctgtatagcaccctgtggaggcaatttaacaggatcttcaggctttattctttcaccaaacttccctcatccatatccgcatagcagagactgtgactggactatcaccgtcaatgcagactatgttatctccttggcgttcatcagttttagcatagaaccaaactatgacttcctctatatctatgatggaccagacagtaatagcccactgattggaagttttcaagacagcaagttaccagagagaatagaaagcagctcaaatacaatgcatttggcttttcggagtgatgg

SEQ ID NO: 97289 - DNA, 693 bp, Homo sapiens
tcttaggggcttctcccacacttcttgctgccaccaggtgaagaaggatgtgtttgcttccccttccaccatgattgtaagtttcctgaggcctccacagccatgaggaactgtggccaggaggagggatgttagccacaaaggtttgtttttctgagacccttcaatcagttaccctcatgcttaattttcctacatggagctttaggggaagccatgaggaacatggtgtctgacgcatagtaagtgttcaataaatatttgctgaccagatgtagtggaagtgccttatcttccagtctgtttggtctcagctgcagaagtgagatgatgaagggaatctcatcgtttggaaagcatcacagtaagacacacacattgtgccaccactgtggctctaaggcccaccacctccagaagacgacctgtggcaaatgtggctaccctgccaaacacaagaggaaatataactgggtgccaaggctaaatggcgaaataccaccagaacttgttgaatgagacacctaaaaattgtttgccacagactgaggcacagattccgaaaaggaacacacctaaacccaagagggtagccgttgcagcatccagttcatcttaagaatttcagtgactagtcatgtgacaaatgttctagttttaaaaaataaataaataaatatttgctgaccgaaa

SEQ ID NO: 97290 - DNA, 713 bp, Homo sapiens
tgggtgcattcagtttttatttcaaaggatggcatcaggcagcaaaatttaagtaatgggaaatttctgtgtttcaattgcctattggctacaaaatgtactgcctgctactcggtagtgtaaaacagcaacaaacattttgttgttgttattattattttgagacagggtcttgctctgtcactcaggctggagtgcagtgacccgatcatggctcactacagcctcaacctccctgggctcaggcaatcctcctgcctcagcccccacaagtagctgaaattacaggtgtgtgccaccatgcctggctaaattttttgggaatagtttttaaagatggagttttgcagtgttgcctgggctggtcttgaactcctgagctcaggcaatctgcccacttcagcctcccaaagtgctgggattacaggcctgagtcactggacctggttgttgttgttattatcgctcatggttttggaggttcactgggctcaggtatgtagttctcagtcaggagtctctatgcagttgtggtcagctggcagctggagcctcctgatgtcttcttcgctcacatgtctaatgaccgatgctgatgttgctgtcctctgtgacctcagtgaaacctgtcagccaaaacacctacatatggcttctccacctggcctgggtttcatcagggcatggtgtctggatttcaagagcaagtgtcc

SEQ ID NO: 97291 - DNA, 487 bp, Homo sapiens
cgggatcccaggggtcccccagtccggcgccgtctcccctagctcggcgcactgggtccgaggtggccggtgtgaggtctcaagctggccgcacctcgtccaagaagggaaaagaccagaggccgcagacgtctcctcccagtctggagttgggacgcactagggtgtagaaaggtcaggatgtccccccaccccaaacccacacgcgcttgcgagcacacacgcagacacagagaccacggcgcgcgcacacgcacacgcacacacctacgctttgctcccctggcctgagagctggagagggggcgctttggaaaacttggctgattcgccggatgaccatgtgcgctcaagactgtacccgccaaacataaccttaattttacaagatgtttttccccataacttttctgcaaatgagtcagaacagaacccagtttccgaggcagcccagtctggtttgctaaatttctcaaaatgtaccagc

SEQ ID NO: 97292 - DNA, 660 bp, Homo sapiens
cccataatattttgtgaatatgtctatgatagtatttaatacattgcattatgacttgttgtttgtgtcattctccacttattaattagacttctttgaggatagagattgagtttttaaatttgtttcttcatttgttcttttacttagctcaatgcctggcaaaaaaacaaatcattgttaaatcagtttttaggtgaaatagggataagtgggaggctaacttatccagtctttgaaaatgcctagcgatccccttcagaatcctcacacatcatcatcaatcttcttaccctgtaaataaatatacttttctcacacattaaagatatttgtaaaataaatttattcagtttttttttctattgcagtgatatgtgtgtgtatatatgtatatagttgtatttaaactaaacaggagaaaaggagcaagcctgtgaagtattatttccgcatttaccagcaagacaattatctcagaagattaaaatgtgagagatacaactagtgttcaaaccctgctctttctgatgccacagtcaatgttctttctttggtagaaaccaaactgtatttttcttattgttcaagtaatgtaattaactatggaaaaataagaaattacagattaacaaaataaagcaaaagtaagtaaaattc

SEQ ID NO: 97293 - DNA, 541 bp, Homo sapiens
actcttggaggatatttcatcccctccaagccttgccccatggaaagggctacacctcctgcaggaaggggtgccttttgttaacaggtattaatgggtacagaggcaccatgcagcctaccagcacccttgctagcctagtcctcttcctgtgcttctttttgaaagatcaagaatgaagaggaagagatgaggagtgggggtcctttacctaaaggaccctcgtggttcattgcttctctttaactgactttttaaaaaaactccctcttccacactccttgctgtgattctgtcctaatcatttttcttgagaatgtcatgtagagataaatgtgtgtcacagtgaagccagaaggtgaattaacaactaagacaaatccagcatgctcttgcctgccctgcatatgtgctcatttggggaaggacggaggacacagagcatcgacacaaattctacagctcctcagagaacacagcagagactcagatgagctgtaaaatccattaaggaaaaataaatggcatgatttggaagtta

SEQ ID NO: 97294 - DNA, 718 bp, Homo sapiens
tggcttttcttttcactataatattaaagttttgtttgttttcaatgaacaagacttgttaattttactacagtacaatacaccaacatttttggttggtgctgtctatgccctattttaaaatgtttcgccacagtcagccatggggaattcaattgcagctcactgactcttagtcatttcaatttaatcagtatatgctaagaccaagaaaatgcagctggttggtggacccgagccctaatcatatggctgacaccaaagtcatgaaggtaggggaatgattgttgagtaggaaattagtaatgtctgctaaaagctgcatctcttgagttttgatatataatactaccattaccacttaagtttaaaaactcataaatttccattatacattattttattcatgaattacttagatgttttttggagggtagttttttgttattgatttctaatgttatagcactttggttagaatttgtgttaaacatggtatcagttcattagtatttgttgaaaattgctttgtggtctagttcacacttaatttttctaatattgcatgtgtgtttgaaaagcatatgaattttctttctaaagtagagcatccacaaaatcaagcctattaattgtgtcattcagatattttctaccattactagtgtttgacagtttctgatggagatgtgacagcatttcccactcttttggatat

SEQ ID NO: 97295 - DNA, 785 bp, Homo sapiens
caggtggctacctctcatctcctgaggatctgttccttctctcttctcttaccagagattggcatcacctcctggtgttagtcagcatgtttatctgaaacagtggaaggctgttgtaggagctagggaatgatgctaattcatatgctaaaggatgaagttgccttataaagctgctgatttctgaaggatgaaaaaccttcccagaggcctgagtgcgctgtgtgccggagcttgtggcatcaatgggcctgctgtgtccaaagaaagaggctgaggcagccgagctccggcctgaagcacctggaccagacgacaaagaggtcggcttccttagtccggaggactgtccggactgtgagcaagaggaagctacagcccacgagggccacccgcagcctgacaccttcagcagtaaacaagataaaataacttcttcaagataagcctgagtattaggtgtaaaagttggtgtccgaaccagggcctgtaatgacctttcttatagtctagaataaacgaagacaagggagatttcgatgaagaagtcattcaagatggagtcagagtgttcatcgaaaagaaagcacaactaacacttttaggaacagaaagaccatgctgaagacaaactatccagtgagtttgtgttcaataacccaaacatcaaaggaacatgtggccgtggagaaagctttactatttgacatctcaggacgcctctgaccataagctctgggaaagctcctggaagccctggggctcacaaataaatcatatgattg

SEQ ID NO: 97296 - DNA, 234 bp, Homo sapiens
gacctactggtatcccaccccaaacagcaactctttctgatatgcttgcatttaaaatcaggctttttctcccttttggaaaaacacagtccttgtttgctttagggaagaataaaggtcagtgcgctgcattgcattaatttcgaagggaaagatgagaagacatcttgaaaggaatggctggctttctagagaatagtagaggcttaataggtgtcatagaaaaaccagggg

SEQ ID NO: 97297 - DNA, 525 bp, Homo sapiens
  misc_feature (14)..(14): n is a, c, g, or t
tgatctagaggatncgtttctctgatcgctcaaggaataagatcagatgagatccccagtgaaagaagagaggagttgtaaggactgggccctggggcattctagcttcatgaggagcagaagagaagaatgcaggggaggaagtggagacagggattgtggacaactcagttgagctttgcggcaaaagggagcagagtttgaggtggtatctggtggggtaaataagcttaggagaattatttttcagttggaagcattatcagcatgtttagatgctgatgggagtgattctgtagagagtgaaatattgattgtgtgggatggagggctgctgaaaacacttcttgagtaggagagagagatgggtttgtggaaaagtggagttactggctttaggaggaacacggatagttaccagtggggatggaccaaatgacagatacatgcgtgggtggtgctcggaggaggaggctctgcagttctcttctgattaccgacctttctttgtgaaatgggagtcaa

SEQ ID NO: 97298 - DNA, 438 bp, Homo sapiens
gatagccttaccaagtgataaggacagaaataaaagcagaagacaccttccacctgcccacacacacggaagaaccaaaggaccatggcaagcaatgtgaagatgtgcttgcttccccttcaccttccaccatgactgtaagtttcctgaggcctccccagccatgcttcctgtacagcccatgtaactatgaagaacagttcagccatggactgcagctgctgcgtggctaatggaaaaggagcccaggaatgcacactctccgtatctactcaatgccaacaggcttgcctgatgtgaacaaaaattcagtcaagctgcctgcttggcactgtacaagcaatagatccaggtgcctcacaagatttccaactgaaataaggggctgtttttgaatggtgccggtccaatattaaatgctttcttcctcattggctg

SEQ ID NO: 97299 - DNA, 1160 bp, Homo sapiens
aatctgagaatggcaggtatgagcagccacaacccctacgtctgagatcaattacccaggaagaagccctctcagagctcagatctagatgttggagatggtacagctgtggtttagtagctggcagggaagttaccatgctactgtgctgctgtgctgctgtgatgttaaaacttgcttaaaatctgttctctaggatgctagggaacactgttcactggcaggtgactcaccagagacatcctgctacaaaaccaactgacaggtcagggtgtttgagaaatgtctggccataggagccttgccaagatggcacactggaaccagggaggaaaacccagtccttctgcaaggtaactctggctcccaactccagctccccgtactgacaaatcttaacatatgtgccagctggcaaagggaaaatgtagaaagagatcagctccatttttggagagcaagtaatgaaggatgaattgggagctgagaggaaatacattgataactggcacacgctccaaatcttaccacctagagatactacttatgaacacacacagttatcaatatggtttttaacctgttattttcctgcaatagcgtggtgtggacagctttatatgccaataaatatgatccgcttcaacatttttctttgtcgagtagtatatattcactttgttttatatagctgattccctactggttaatatttaaattgactcctgtttttactattataaataatgctgtactcaacatctttaaatgcttattttatcatactaaattattagaagttgaattgttggaacaactgttctatgttaagttgataagagtaaatgctgggtgcattatttatttgttttagcaagaaagatattttttcattttctgcattcctcaataaagcatgaagatgctaccttagacatctgatatggtatccaagtcaaataaggtcaggtaccagtgtggttccaagaatttctctgagagccatgtagcctggccagggaaactaactggcaaagatggcatgtatctaccctggcttttcactaaaataaagtataggattaaaaaaaaaaacttcatttttcagaggagttttaggatcacagcaaaactgagtgaaagtgcagaagaattcccat

SEQ ID NO: 97300 - DNA, 672 bp, Homo sapiens
cgaattcctttgatacgtggcccccctttccatttcttcccccctagagttcctttttttggacccccccggttatcaatatggtttttaacctgttattttcctgcaatagcgtggtgtggacagctttatatgccaataaatatgatccgcttcaacatttttctttgtcgagtagtatatattcactttgttttatatagctgattccctactggttaatatttaaattgactcctgtttttactattataaataatgctgtactcaacatctttaaatgcttattttatcatactaaattattagaagttgaattgttggaacaactgttctatgttaagttgataagagtaaatgctgggtgcattatttatttgttttagcaagaaagatattttttcattttctgcattcctcaataaagcatgaagatgctaccttagacatctgatatggtatccaagtcaaataaggtcaggtaccagtgtggttccaagaatttctctgagagccatgtagcctggccagggaaactaactggcaaagatggcatgtatctaccctggcttttcactaaaataaagtataggattaaaaaaaaaaacttcatttttcagaggagttttaggatcacagcaaaactgagtgaaagtgcagaagaattcccat

SEQ ID NO: 97301 - DNA, 461 bp, Homo sapiens
cacaccacacatcacgcatacatacaccacacccctcacaaccccacacaacacataaatacgtcacacacacacacaccacacactacacacaccacacgccacatacacaccatacacacaccacacagatacatcacacacacaccacacacagatacaccaaaagcacacagataccacacacacccccacagaaagcacacagataccacacacacccccacagaaagcacacagataccacacacacccccacagaaagcacgcagataccccccccacacacacagaaagtgcacggataccacacacacacacacacagaaagcgcacacagcattcacaccccacatatacttctttgcacttaaaagcaggagcatgtcaaaggctgcctgcgaagctggccagtgctccagggagggccggatcatctctcacacaaagtgatcaggacc

SEQ ID NO: 97302 - DNA, 714 bp, Homo sapiens
tgttcatgtcttgctcattgccgcatctccagtacctggcacagtgcttggcaccaagtatctgctgctacttgtcaattgcatgaatgaattattatatacatttctcacaagctatttgggggcttggtgctggacatcaagcggaaggccccctggtactggagcgactaccgagatgcactcagcttacagtgtttggcttcctttctgttcctgtactgtgcctgcatgtcacctgtcatcacctttgggggactgcttggagaagccactgagggacgcataagtgcaattgaatccttgtttggagcttccatgactgggattgcttattccttgtttgcgggacaggctctcaccatcctgggaagtactggaccagtgcttgtgtttgaacaagattctgttcaaattctgcaaagactatgctctttcatacctctccctgcgagcttgtattggactgtggaccgctttcctgtgtattgtccttgtggcaactgatgccagttcccttgtctgctacattacccgtttcactgaagaagcatttgcctccctaatttgcattattttcatctatgaagcaatagaaaaactgattcacctggcagagacctacccaatccacatgcacagccagctggaccaccttagcctctattagtacgtgtgctttctgcttatctaaaaattgagcaagggcctgag

SEQ ID NO: 97303 - DNA, 334 bp, Homo sapiens
gattcaggcatcccttcttgatctttctaggagctgtgaagttgcagaattttggtttattgggatgcatcctggtgcttgcctacagatcttgttttgcaagtaagaacagaagactctggccgggcgtggtagattatgtctgtaatcccagcactttgggaggccaagggggggcggatcacctgaggtcaggaattcaagacaagcctggccaacatggcgaaaccccatctctactaaaaatacaaaaatcagccaggtgtggtagcacgcacctgtaatcccagctagtctggaggctgagacaggagaatcacttgaacccgggagg

SEQ ID NO: 97304 - DNA, 213 bp, Homo sapiens
gttagaacatgatggagagctacagaaggagctctaatcacagaaatacatgtggagagtttcaaatgtgctgatggggcttggtaagcatgtagatgatcttcttggccagatgcagtggctcatgcctataataccagcactatgggaagccgaggtgggaggagcacttgagcccaagagtttgagactagcctgagcaacatatggaaa

SEQ ID NO: 97305 - DNA, 805 bp, Homo sapiens
gcccttggatgcagtaggcatttatctatgtgacttgatgtaaggggctccaaaaatgccccccgcccaaccagcctaaatatctccctgccagactgtcatactgtctgtgcatgaaacccctggcttcagcattgccctctcccatttcctcgtattgaaataggtggcaagctgcagtcaggactggcaaagagccctgtgcaaaatgaaaatggagggctcctcgtccaaaagttaggaagaatttcaaggcaacaacagaagagaattcaactaagcacggggccctgcactgctgcacaggctgtgcactcttgaagccagctctgcctgcagcctgagctcttagcgagacaggatcacctcctttccttgcaccagtgaggagccctggagctgcccagatcaaggacacaaagacaaaacgagcctctttactcagctcaggacaattgttgttttcggagatgggtgaagctcagggccctctgtccagctggcctaacttcagggcctcctgaaattcctctgggttctccaggcccctggagtcctggcagttgatggggcattttctgcctatggcctggctggccctgagcttgtccttactctattgcagtgtttgccttgcctgctgagggactcgctctggcatgtgggcctgatcctgaggggtccttttcctgtttcctgaacaaccaccagatctttggatttagctcctagcagccccaggagcacccccagacagacttcccgtgcttggggctgttctaggctctccagatccactgtcttc

SEQ ID NO: 97306 - DNA, 592 bp, Homo sapiens
ggcaaggacaggcccaggctgcctggccccttacaccacccatgggctccatcccacacaggaggcagctgggtgggtccagaggctgaaatgagagccacgcagcccagtcaagtgggacagacccagaggtatctggacatcacccgagggaggagaaggtgctgataactggaacctgggatgggcagctcccaggcacactggccaagatccagaagacaaagtcttcctgccctgcaagtgcagatgcttctgcctcaaactgacagggagcagagggtgaagaacattctccacactcagcaggagatgggcaatcccacacaggcaaggaagtcagctcagcctgaggcggggacacacccaggtcacccacgatgggctgtggcatcaacttcaaggaatccacaaccaccaacaagctccaaggagcccccgaggttgaattcagggtgccaggtgttatgcccggctctgccctcccatactgagagctgagcctcagtctgccatccatgagacagaaataagggttggtgtggaaccaggcttggtaaactgcagcctggagaccaaatccagcccctgg

SEQ ID NO: 97307 - DNA, 370 bp, Homo sapiens
cagaaaaagagactgagagagagagagagagacaaatgaacaggagaactacactgtgtatttgggtgatgctccagggaggtttgaacagactgtcaatgtcatgttttgaagagagcaaggaattttggggatactgctgtgccagagaaaacaggttcgagagaaagaaaacagaggcgggatcccttacagagcaagaggtaaccaggagttgtttaggtaggcatccagccaggggaattgctcagggttctgcagagggcagcctctggggctccggctggggtggggagatggcttggccctgggctgttggcctgggaactggggttcagccacagttgagttccaagcctcctagtgtttc

SEQ ID NO: 97308 - DNA, 336 bp, Homo sapiens
  misc_feature (37)..(37): n is a, c, g, or t
cgaatgcgaaagtgggcaggcggccttaaactccggngctcaattaatccctcagcctcggcctcggaaagtgtgggatgacaggcatgaaccagggggctcatcactctcgttggagctcctatatcagagctagtcctggatcaagtttttctccttcagtctatcctcacccctgtgtgatctcatccactgccacagcttcagataccacccatgtgccaatgactcccatagccataactcagccctgacctcttttctggactcattttgtaagtgcattcaagatttttctttccttgactattttgcaggcatctcaaatttaccata

SEQ ID NO: 97309 - DNA, 378 bp, Homo sapiens
ttctgccctagccctggcatcagccgtttcttcagagagttctaatttcttttactggagaatgatatttagaaactaacatgggcattaggtataccccttttgtggacagagctaagaaatacacctgctacattaatgtgtagacttaaaaaaaataaatcacgagttaaagctagtacttctaattccaatctaatgtagtaagtcttttctgtcattctgtatttgtatttgcaaatattctggtttccagagtatcagcatatttaatcttttggataattatataatacccagaaaatagttgcagaattatgcaaatgtcactaaaagcaataaagttattaagttcaagatttcttcacagttcttttg

SEQ ID NO: 97310 - DNA, 424 bp, Homo sapiens
agagggcagggctggaaggatggtgagtggggctctgggcatcttgtcccagccaatgggtaagagggtcaaggagctggtgtgccaggctgggctgggctcaggaggagggttcagaccctcctaggcccctggggttcatagagacatgctttgtctgatagtagagggtcctgaagtattggaggagatgggggaatcttgttagggtcctggtgttgggccaggagccaggacatggttcaggctggagctcccagccccaaagaggaacagcctgtccctttgcaagggcggagttgccttgggcctccccaggccagcctagctctcagtgctgggggtgaaggagccagaagggaactggtactcctggcccagtgcgagagtcacatcagggcactgaatagtagaaatcagagga

SEQ ID NO: 97311 - DNA, 383 bp, Homo sapiens
atctcttgcctgagggcgttctttgaaattatgtgaggactttgtctgcccaccctgcaggctggaagtgtcagaagattaatgtcacccttcctctggaatagctctcaaccaaagattgatgggatttgatggctcctctagtgggagaatgctaaggcttgtattctccacttttcccagagtgtcttcctagcattaagctacagtagcccatgatggttgctggtttacgaatacacccttgattgaagatgcgccttccctgtttcactttcccctgctcctctgcactgatttccttgagcaggctcacatttcaagcaaggaacatcaatgttattaattgactgtgaaaaagaaaaagccctcacaaccccaag

SEQ ID NO: 97312 - DNA, 500 bp, Homo sapiens
taatttctaaaagaaactgttatttctaacacttgttatttattctttaacaaaaagggaaactttgaagaggaactttttacttttcacatgcggatccattagtcctcgagaatttaacagtgaacctatatagatgtattttgctgtccttacagaacatgcagtgtaagaagtacctttaatgccaacctacacacttctttcccgaagtacccaattaagtgcaaatgcttaatgtctttagtgttttatagtaaagcaaaaaatccttatttagaattagaagtacaggcctgtgcaacatggcggaaccccatctttaccaaaaaatacaaaaattagctggacatggtggcatgcttatgtagtctcagctacttgggggctgaggtgggaggatcgcttgagtccgggaggccaaggttgcagtgagccattttcgcaccattgcactccagcctgggtgacaaagtgaaacttcaccttaaaaaaaaaaa

SEQ ID NO: 97313 - DNA, 2309 bp, Homo sapiens
tgctagctgcttccgggcggaggtcctcggcctcccctaggcgaggcactaggtctgggggcggcgggtcttagcgtgcccgccacgctcgccgcctcccacctgccctggctggctggggcccgacccttgcgtcgctccggggcccaagttacggactcgggaatccagttgtccgcaccgaacaagccccgccgcagcgcccgcccctcctcttgctgctttggagtctcccggcttccgccttccgcagcagtcacgtgcctccgatcacgtgaccggcgcctctgtcattctactgcggccgccctggcttccttctacctgtgcggccctcaacgtctccttggtgcgggacccgcttcactttcggctcccggagtctccctccactgctcagacctctggacctgacaggagacgcctacttggctctgacgcggcgccccagcccggctgtgtccccggcgccccggaccaccctccctgccggctttgggtgcgttgtggggtcccgaggattcgcgagatttgttgaaagacattcaagattacgaagtttagatgaccaaaatggatatccgaggtgctgtggatgctgctgtccccaccaatattattgctgccaaggctgcagaagttcgtgcaaacaaagtcaactggcaatcctatcttcagggacagatgatttctgctgaagattgtgagtttattcagaggtttgaaatgaaacgaagccctgaagagaagcaagagatgcttcaaactgaaggcagccagtgtgctaaaacatttataaatctgatgactcatatctgcaaagaacagaccgttcagtatatactaactatggtggatgatatgctgcaggaaaatcatcagcgtgttagcattttctttgactatgcaagatgtagcaagaacactgcgtggccctactttctgccaatgttgaatcgccaggatcccttcactgttcatatggcagcaagaattattgccaagttagcagcttggggaaaagaactgatggaaggcagtgacttaaattactatttcaattggataaaaactcagctgagttcacagaaactgcgtggtagcggtgttgctgttgaaacaggaacagtctcttcaagtgatagttcgcagtatgtgcagtgcgtggccgggtgtttgcagctgatgctccgggtcaatgagtaccgctttgcttgggtggaagcagatggggtaaattgcataatgggagtgttgagtaacaagtgtggctttcagctccagtatcaaatgattttttcaatatggctcctggcattcagtcctcaaatgtgtgaacacctgcggcgctataatatcattccagttctgtctgatatccttcaggagtctgtcaaagagaaagtaacaagaatcattcttgcagcatttcgtaactttttagaaaaatcaactgaaagagaaactcgccaagaatatgccctggctatgattcagtgcaaagttctgaaacagttggagaacttggaacagcagaagtacgatgatgaagatatcagcgaagatatcaaatttcttttggaaaaacttggagagagtgtccaggaccttagttcatttgatgaatacagttcagaacttaaatctggaaggttggaatggagtcctgtgcacaaatctgagaaattttggagagagaatgctgtgaggttaaatgagaagaattatgaactcttgaaaatcttgacaaaacttttggaagtgtcagatgatccccaagtcttagctgttgctgctcacgatgttggagaatatgtgcggcattatccacgaggcaaacgggtcatcgagcagctcggtgggaagcagctggtcatgaaccacatgcatcatgaagaccagcaggtccgctataatgctctgctggccgtgcagaagctcatggtgcacaactgggaataccttggcaagcagctccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtataaaagtaggtgattctgtatttaaagaaaatattactgttacatatactgcttgcaatttctgtatttattgttctctggaaataaatatagttattaaaggattctcactccaa

SEQ ID NO: 97314 - DNA, 2255 bp, Homo sapiens
tgctagctgcttccgggcggaggtcctcggcctcccctaggcgaggcactaggtctgggggcggcgggtcttagcgtgcccgccacgctcgccgcctcccacctgccctggctggctggggcccgacccttgcgtcgctccggggcccaagttacggactcgggaatccagttgtccgcaccgaacaagccccgccgcagcgcccgcccctcctcttgctgctttggagtctcccggcttccgccttccgcagcagtcacgtgcctccgatcacgtgaccggcgcctctgtcattctactgcggccgccctggcttccttctacctgtgcggccctcaacgtctccttggtgcgggacccgcttcactttcggctcccggagtctccctccactgctcagacctctggacctgacaggagacgcctacttggctctgacgcggcgccccagcccggctgtgtccccggcgccccggaccaccctccctgccggctttgggtgcgttgtggggtcccgaggattcgcgagatttgttgaaagacattcaagattacgaagtttagatgaccaaaatggatatccgaggtgctgtggatgctgctgtccccaccaatattattgctgccaaggctgcagaagttcgtgcaaacaaagtcaactggcaatcctatcttcagggacagatgatttctgctgaagattgtgagtttattcagaggtttgaaatgaaacgaagccctgaagagaagcaagagatgcttcaaactgaaggcagccagtgtgctaaaacatttataaatctgatgactcatatctgcaaagaacagaccgttcagtatatactaactatggtggatgatatgctgcaggaaaatcatcagcgtgttagcattttctttgactatgcaagatgtagcaagaacactgcgtggccctactttctgccaatgttgaatcgccaggatcccttcactgttcatatggcagcaagaattattgccaagttagcagcttggggaaaagaactgatggaaggcagtgacttaaattactatttcaattggataaaaactcagctgagttcacagagttcgcagtatgtgcagtgcgtggccgggtgtttgcagctgatgctccgggtcaatgagtaccgctttgcttgggtggaagcagatggggtaaattgcataatgggagtgttgagtaacaagtgtggctttcagctccagtatcaaatgattttttcaatatggctcctggcattcagtcctcaaatgtgtgaacacctgcggcgctataatatcattccagttctgtctgatatccttcaggagtctgtcaaagagaaagtaacaagaatcattcttgcagcatttcgtaactttttagaaaaatcaactgaaagagaaactcgccaagaatatgccctggctatgattcagtgcaaagttctgaaacagttggagaacttggaacagcagaagtacgatgatgaagatatcagcgaagatatcaaatttcttttggaaaaacttggagagagtgtccaggaccttagttcatttgatgaatacagttcagaacttaaatctggaaggttggaatggagtcctgtgcacaaatctgagaaattttggagagagaatgctgtgaggttaaatgagaagaattatgaactcttgaaaatcttgacaaaacttttggaagtgtcagatgatccccaagtcttagctgttgctgctcacgatgttggagaatatgtgcggcattatccacgaggcaaacgggtcatcgagcagctcggtgggaagcagctggtcatgaaccacatgcatcatgaagaccagcaggtccgctataatgctctgctggccgtgcagaagctcatggtgcacaactgggaataccttggcaagcagctccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtataaaagtaggtgattctgtatttaaagaaaatattactgttacatatactgcttgcaatttctgtatttattgttctctggaaataaatatagttattaaaggattctcactccaa

SEQ ID NO: 97315 - DNA, 542 bp, Homo sapiens
  misc_feature (42)..(42): n is a, c, g, or t
  misc_feature (70)..(71): n is a, c, g, or t
gggagagccagccctggcccgacggttccgtttttcaccganactgggtgtcaaaacacatttggggggnnaagggtcatcgagcagctcggtgggaagcagctggtcatgaaccacatgcatcatgaagaccagcaggtccgctataatgctctgctggccgtgcagaagctcatggtgcacaactgggaataccttggcaagcagctccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtataaaagtaggtgattctgtatttaaagaaaatattactgttacatatactgcttgcaatttctgtatttattgttctctggaaataaatatagttattaaaggattctcactccaa

SEQ ID NO: 97316 - DNA, 516 bp, Homo sapiens
  misc_feature (1)..(1): n is a, c, g, or t
  misc_feature (7)..(7): n is a, c, g, or t
  misc_feature (13)..(15): n is a, c, g, or t
  misc_feature (28)..(28): n is a, c, g, or t
nacttgncggggnnncataaagccgcanttttgggtggcgtagacagcggtcatcgagcagctcggtgggaagcagctggtcatgaaccacatgcatcatgaagaccagcaggtccgctataatgctctgctggccgtgcagaagctcatggtgcacaactgggaataccttggcaagcagctccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtataaaagtaggtgattctgtatttaaagaaaatattactgttacatatactgcttgcaatttctgtatttattgttctctggaaataaatatagttattaaaggattctcactccaa

SEQ ID NO: 97317 - DNA, 395 bp, Homo sapiens
  misc_feature (33)..(33): n is a, c, g, or t
agggcgcgacaagataatgtcttaggaaaaagncttgggtgggaataccttggcaagcagctccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtataaaagtaggtgattctgtatttaaagaaaatattactgttacatatactgcttgcaatttctgtatttattgttctctggaaataaatatagttattaaaggattctcactccaa

SEQ ID NO: 97318 - DNA, 400 bp, Homo sapiens
  misc_feature (37)..(37): n is a, c, g, or t
gggggccgtccggccgccggcttcgtcttcccccggngcttcggttggaataccttggcaagcagctccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtataaaagtaggtgattctgtatttaaagaaaatattactgttacatatactgcttgcaatttctgtatttattgttctctggaaataaatatagttattaaaggattctcactccaa

SEQ ID NO: 97319 - DNA, 401 bp, Homo sapiens
tttgctattgaaattctcattctccttacttcattcttttttttcagggaataccttggcaagcagctccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtataaaagtaggtgattctgtatttaaagaaaatattactgttacatatactgcttgcaatttctgtatttattgttctctggaaataaatatagttattaaaggattctcactccaa

SEQ ID NO: 97320 - DNA, 2519 bp, Homo sapiens
  misc_feature (2455)..(2455): n is a, c, g, or t
  misc_feature (2496)..(2496): n is a, c, g, or t
tgctagctgcttccgggcggaggtcctcggcctcccctaggcgaggcactaggtctgggggcggcgggtcttagcgtgcccgccacgctcgccgcctcccacctgccctggctggctggggcccgacccttgcgtcgctccggggcccaagttacggactcgggaatccagttgtccgcaccgaacaagccccgccgcagcgcccgcccctcctcttgctgctttggagtctcccggcttccgccttccgcagcagtcacgtgcctccgatcacgtgaccggcgcctctgtcattctactgcggccgccctggcttccttctacctgtgcggccctcaacgtctccttggtgcgggacccgcttcactttcggctcccggagtctccctccactgctcagacctctggacctgacaggagacgcctacttggctctgacgcggcgccccagcccggctgtgtccccggcgccccggaccaccctccctgccggctttgggtgcgttgtggggtcccgaggattcgcgagatttgttgaaagacattcaagattacgaagtttagatgaccaaaatggatatccgaggtgctgtggatgctgctgtccccaccaatattattgctgccaaggctgcagaagttcgtgcaaacaaagtcaactggcaatcctatcttcagggacagatgatttctgctgaagattgtgagtttattcagaggtttgaaatgaaacgaagccctgaagagaagcaagagatgcttcaaactgaaggcagccagtgtgctaaaacatttataaatctgatgactcatatctgcaaagaacagaccgttcagtatatactaactatggtggatgatatgctgcaggaaaatcatcagcgtgttagcattttctttgactatgcaagatgtagcaagaacactgcgtggccctactttctgccaatgttgaatcgccaggatcccttcactgttcatatggcagcaagaattattgccaagttagcagcttggggaaaagaactgatggaaggcagtgacttaaattactatttcaattggataaaaactcagctgagttcacagaaactgcgtggtagcggtgttgctgttgaaacaggaacagtctcttcaagtgatagttcgcagtatgtgcagtgcgtggccgggtgtttgcagctgatgctccgggtcaatgagtaccgctttgcttgggtggaagcagatggggtaaattgcataatgggagtgttgagtaacaagtgtggctttcagctccagtatcaaatgattttttcaatatggctcctggcattcagtcctcaaatgtgtgaacacctgcggcgctataatatcattccagttctgtctgatatccttcaggagtctgtcaaagagaaagtaacaagaatcattcttgcagcatttcgtaactttttagaaaaatcaactgaaagagaaactcgccaagaatatgccctggctatgattcagtgcaaagttctgaaacagttggagaacttggaacagcagaagtacgatgatgaagatatcagcgaagatatcaaatttcttttggaaaaacttggagagagtgtccaggaccttagttcatttgatgaatacagttcagaacttaaatctggaaggttggaatggagtcctgtgcacaaatctgagaaattttggagagagaatgctgtgaggttaaatgagaagaattatgaactcttgaaaatcttgacaaaacttttggaagtgtcagatgatccccaagtcttagctgttgctgctcacgatgttggagaatatgtgcggcattatccacgaggcaaacgggtcatcgagcagctcggtgggaagcagctggtcatgaaccacatgcatcatgaagaccagcaggtccgctataatgctctgctggccgtgcagaagctcatggtgcacaactgggaataccttggcaagcagctccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtataaaagtaggtgattctgtatttaaagaaaatattactgttacatatactgcttgcaatttctgtatttattgttctctggaaataaatatagttattaaaggattctcactccaaacatggcctctctctttacttggactttgaacaaaagtcaactgttgtctcttttcaaaccaaattgggagaattgttgcaaagtagtgaatggcaaataaatgttttaaaatctaattacaatcactgcccgtcgttacacgtcngactgggaaccctgcgttaccacttatcgcctggagacatnccctttggcagcttgcgtatacg

SEQ ID NO: 97321 - DNA, 2472 bp, Homo sapiens
tgctagctgcttccgggcggaggtcctcggcctcccctaggcgaggcactaggtctgggggcggcgggtcttagcgtgcccgccacgctcgccgcctcccacctgccctggctggctggggcccgacccttgcgtcgctccggggcccaagttacggactcgggaatccagttgtccgcaccgaacaagccccgccgcagcgcccgcccctcctcttgctgctttggagtctcccggcttccgccttccgcagcagtcacgtgcctccgatcacgtgaccggcgcctctgtcattctactgcggccgccctggcttccttctacctgtgcggccctcaacgtctccttggtgcgggacccgcttcactttcggctcccggagtctccctccactgctcagacctctggacctgacaggagacgcctacttggctctgacgcggcgccccagcccggctgtgtccccggcgccccggaccaccctccctgccggctttgggtgcgttgtggggtcccgaggattcgcgaggtaaggccgccctcgcgttgtttggtctcaggctgcagaccaggtcaggcgactcttgcagtttctccagcttgcctggtgcgtgctggtgtctcgccgcttggtcctctcctgttcttcggcccccggttgccagattgcttttcttccaggcctcaaccagatttgttgaaagacattcaagattacgaagtttagatgaccaaaatggatatccgaggtgctgtggatgctgctgtccccaccaatattattgctgccaaggctgcagaagttcgtgcaaacaaagtcaactggcaatcctatcttcagggacagatgatttctgctgaagattgtgagtttattcagaggtttgaaatgaaacgaagccctgaagagaagcaagagatgcttcaaactgaaggcagccagtgtgctaaaacatttataaatctgatgactcatatctgcaaagaacagaccgttcagtatatactaactatggtggatgatatgctgcaggaaaatcatcagcgtgttagcattttctttgactatgcaagatgtagcaagaacactgcgtggccctactttctgccaatgttgaatcgccaggatcccttcactgttcatatggcagcaagaattattgccaagttagcagcttggggaaaagaactgatggaaggcagtgacttaaattactatttcaattggataaaaactcagctgagttcacagaaactgcgtggtagcggtgttgctgttgaaacaggaacagtctcttcaagtgatagttcgcagtatgtgcagtgcgtggccgggtgtttgcagctgatgctccgggtcaatgagtaccgctttgcttgggtggaagcagatggggtaaattgcataatgggagtgttgagtaacaagtgtggctttcagctccagtatcaaatgattttttcaatatggctcctggcattcagtcctcaaatgtgtgaacacctgcggcgctataatatcattccagttctgtctgatatccttcaggagtctgtcaaagagaaagtaacaagaatcattcttgcagcatttcgtaactttttagaaaaatcaactgaaagagaaactcgccaagaatatgccctggctatgattcagtgcaaagttctgaaacagttggagaacttggaacagcagaagtacgatgatgaagatatcagcgaagatatcaaatttcttttggaaaaacttggagagagtgtccaggaccttagttcatttgatgaatacagttcagaacttaaatctggaaggttggaatggagtcctgtgcacaaatctgagaaattttggagagagaatgctgtgaggttaaatgagaagaattatgaactcttgaaaatcttgacaaaacttttggaagtgtcagatgatccccaagtcttagctgttgctgctcacgatgttggagaatatgtgcggcattatccacgaggcaaacgggtcatcgagcagctcggtgggaagcagctggtcatgaaccacatgcatcatgaagaccagcaggtccgctataatgctctgctggccgtgcagaagctcatggtgcacaactgggaataccttggcaagcagctccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtataaaagtaggtgattctgtatttaaagaaaatattactgttacatatactgcttgcaatttctgtatttattgttctctggaaataaatatagttattaaaggattctcactccaa

SEQ ID NO: 97322 - DNA, 2004 bp, Homo sapiens
tgctagctgcttccgggcggaggtcctcggcctcccctaggcgaggcactaggtctgggggcggcgggtcttagcgtgcccgccacgctcgccgcctcccacctgccctggctggctggggcccgacccttgcgtcgctccggggcccaagttacggactcgggaatccagttgtccgcaccgaacaagccccgccgcagcgcccgcccctcctcttgctgctttggagtctcccggcttccgccttccgcagcagtcacgtgcctccgatcacgtgaccggcgcctctgtcattctactgcggccgccctggcttccttctacctgtgcggccctcaacgtctccttggtgcgggacccgcttcactttcggctcccggagtctccctccactgctcagacctctggacctgacaggagacgcctacttggctctgacgcggcgccccagcccggctgtgtccccggcgccccggaccaccctccctgccggctttgggtgcgttgtggggtcccgaggattcgcgagatttgttgaaagacattcaagattacgaagtttagatgaccaaaatggatatccgaggtgctgtggatgctgctgtccccaccaatattattgctgccaaggctgcagaagttcgtgcaaacaaagtcaactggcaatcctatcttcagggacagatgatttctgctgaagattgtgagtttattcagaggtttgaaatgaaacgaagccctgaagagaagcaagagatgcttcaaactgaaggcagccagtgtgctaaaacatttataaatctgatgactcatatctgcaaagaacagaccgttcagtatatactaactatggtggatgatatgctgcaggaaaatcatcagcgtgttagcattttctttgactatgcaagatgtagcaagaacactgcgtggccctactttctgccaatgttgaatcgccaggatcccttcactgttcatatggcagcaagaattattgccaagttagcagcttggggaaaagaactgatggaaggcagtgacttaaattactatttcaattggataaaaactcagctgagttcacagaaactgcgtggtagcggtgttgctgttgaaacaggaacagtctcttcaagtgatagttcgcagtatgtgcagtgcgtggccgggtgtttgcagctgatgctccgggtcaatgagtaccgctttgcttgggtggaagcagatggggtaaattgcataatgggagtgttgagtaacaagtgtggctttcagctccagtatcaaatgattttttcaatatggctcctggcattcagtcctcaaatgtgtgaacacctgcggcgctataatatcattccagttctgtctgatatccttcaggagtctgtcaaagagaaagtaacaagaatcattcttgcagcatttcgtaatcttgacaaaacttttggaagtgtcagatgatccccaagtcttagctgttgctgctcacgatgttggagaatatgtgcggcattatccacgaggcaaacgggtcatcgagcagctcggtgggaagcagctggtcatgaaccacatgcatcatgaagaccagcaggtccgctataatgctctgctggccgtgcagaagctcatggtgcacaactgggaataccttggcaagcagctccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtataaaagtaggtgattctgtatttaaagaaaatattactgttacatatactgcttgcaatttctgtatttattgttctctggaaataaatatagttattaaaggattctcactccaa

SEQ ID NO: 97323 - DNA, 1526 bp, Homo sapiens
  misc_feature (6)..(6): n is a, c, g, or t
  misc_feature (16)..(16): n is a, c, g, or t
  misc_feature (19)..(19): n is a, c, g, or t
  misc_feature (25)..(25): n is a, c, g, or t
  misc_feature (34)..(34): n is a, c, g, or t
ttgatngttctccccncancaagangtgggccgnatatggatggcagtcagtgtgctaaaacatttataaatctgatgactcatatctgcaaagaacagaccgttcagtatatactaactatggtggatgatatgctgcaggaaaatcatcagcgtgttagcattttctttgactatgcaagatgtagcaagaacactgcgtggccctactttctgccaatgttgaatcgccaggatcccttcactgttcatatggcagcaagaattattgccaagttagcagcttggggaaaagaactgatggaaggcagtgacttaaattactatttcaattggataaaaactcagctgagttcacagagttcgcagtatgtgcagtgcgtggccgggtgtttgcagctgatgctccgggtcaatgagtaccgctttgcttgggtggaagcagatggggtaaattgcataatgggagtgttgagtaacaagtgtggctttcagctccagtatcaaatgattttttcaatatggctcctggcattcagtcctcaaatgtgtgaacacctgcggcgctataatatcattccagttctgtctgatatccttcaggagtctgtcaaagagaaagtaacaagaatcattcttgcagcatttcgtaactttttagaaaaatcaactgaaagagaaactcgccaagaatatgccctggctatgattcagtgcaaagttctgaaacagttggagaacttggaacagcagaagtacgatgatgaagatatcagcgaagatatcaaatttcttttggaaaaacttggagagagtgtccaggaccttagttcatttgatgaatacagttcagaacttaaatctggaaggttggaatggagtcctgtgcacaaatctgagaaattttggagagagaatgctgtgaggttaaatgagaagaattatgaactcttgaaaatcttgacaaaacttttggaagtgtcagatgatccccaagtcttagctgttgctgctcacgatgttggagaatatgtgcggcattatccacgaggcaaacgggtcatcgagcagctcggtgggaagcagctggtcatgaaccacatgcatcatgaagaccagcaggtccgctataatgctctgctggccgtgcagaagctcatggtgcacaactgggaataccttggcaagcagctccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtataaaagtaggtgattctgtatttaaagaaaatattactgttacatatactgcttgcaatttctgtatttattgttctctggaaataaatatagttattaaaggattctcactccaa

SEQ ID NO: 97324 - DNA, 2905 bp, Homo sapiens
  misc_feature (2904)..(2904): n is a, c, g, or t
tgctagctgcttccgggcggaggtcctcggcctcccctaggcgaggcactaggtctgggggcggcgggtcttagcgtgcccgccacgctcgccgcctcccacctgccctggctggctggggcccgacccttgcgtcgctccggggcccaagttacggactcgggaatccagttgtccgcaccgaacaagccccgccgcagcgcccgcccctcctcttgctgctttggagtctcccggcttccgccttccgcagcagtcacgtgcctccgatcacgtgaccggcgcctctgtcattctactgcggccgccctggcttccttctacctgtgcggccctcaacgtctccttggtgcgggacccgcttcactttcggctcccggagtctccctccactgctcagacctctggacctgacaggagacgcctacttggctctgacgcggcgccccagcccggctgtgtccccggcgccccggaccaccctccctgccggctttgggtgcgttgtggggtcccgaggattcgcgagatttgttgaaagacattcaagattacgaagtttagatgaccaaaatggatatccgaggtgctgtggatgctgctgtccccaccaatattattgctgccaaggctgcagaagttcgtgcaaacaaagtcaactggcaatcctatcttcagggacagatgatttctgctgaagattgtgagtttattcagaggtttgaaatgaaacgaagccctgaagagaagcaagagatgcttcaaactgaaggcagccagtgtgctaaaacatttataaatctgatgactcatatctgcaaagaacagaccgttcagtatatactaactatggtggatgatatgctgcaggaaaatcatcagcgtgttagcattttctttgactatgcaagatgtagcaagaacactgcgtggccctactttctgccaatgttgaatcgccaggatcccttcactgttcatatggcagcaagaattattgccaagttagcagcttggggaaaagaactgatggaaggcagtgacttaaattactatttcaattggataaaaactcagctgagttcacagaaactgcgtggtagcggtgttgctgttgaaacaggaacagtctcttcaagtgatagttcgcagtatgtgcagtgcgtggccgggtgtttgcagctgatgctccgggtcaatgagtaccgctttgcttgggtggaagcagatggggtaaattgcataatgggagtgttgagtaacaagtgtggctttcagctccagtatcaaatgattttttcaatatggctcctggcattcagtcctcaaatgtgtgaacacctgcggcgctataatatcattccagttctgtctgatatccttcaggagtctgtcaaagagaaagtaacaagaatcattcttgcagcatttcgtaactttttagaaaaatcaactgaaagagaaactcgccaagaatatgccctggctatgattcagtgcaaagttctgaaacagttggagaacttggaacagcagaagtacgatgatgaagatatcagcgaagatatcaaatttcttttggaaaaacttggagagagtgtccaggaccttagttcatttgatgaatacagttcagaacttaaatctggaaggttggaatggagtcctgtgcacaaatctgagaaattttggagagagaatgctgtgaggttaaatgagaagaattatgaactcttgaaaatcttgacaaaacttttggaagtgtcagatgatccccaagtcttagctgttgctgctcacgatgttggagaatatgtgcggcattatccacgaggcaaacgggtcatcgagcagctcggtgggaagcagctggtcatgaaccacatgcatcatgaagaccagcaggtccgctataatgctctgctggccgtgcagaagctcatggtgcacaactgggaataccttggcaagcagctccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtataaaagtaggtgattctgtatttaaagaaaatattactgttacatatactgcttgcaatttctgtatttattgttctctggaaataaatatagttattaaaggattctcactccaaaaacacaacaccaacaaactctccgcaccaacacgaacctaaacacaaaccataacccgcacaccacacaccacacacacacacaccaacaacagcaccgacaacaaacacaacaccaaacactccccaacagacccgcgcgccaccgagccaaagcaccaccagccgggagccccccaactcccccaaccacccccacctctcacgcacccccccaactcccacaccaccctctcaaaccacacgccgcacggagcaggaacccaacggccgagcgacgacaaaccacccgggggacacgcccacgcaacaccacaccgcacgcgggtgggaccgtcaactgcccaagcaccgcacccgacaggacagcagggcggagcacacaacacggcggcgaccgcacgcgccggccgcggagcggacaacagaccgcggatcagcaaactcacgcaacaaatgagaaccgcgcccagcagaggcagcgcgcgcagccagacgggcgcgtcgagccacaaggcgcgaccgcgcaaccagcgcgcgaagcgcacacgcccgacaccacgcgaccccacgcgaccgctcgacaacgcacccnc

SEQ ID NO: 97325 - DNA, 2337 bp, Homo sapiens
  misc_feature (2317)..(2317): n is a, c, g, or t
  misc_feature (2323)..(2323): n is a, c, g, or t
  misc_feature (2327)..(2327): n is a, c, g, or t
  misc_feature (2332)..(2332): n is a, c, g, or t
tgctagctgcttccgggcggaggtcctcggcctcccctaggcgaggcactaggtctgggggcggcgggtcttagcgtgcccgccacgctcgccgcctcccacctgccctggctggctggggcccgacccttgcgtcgctccggggcccaagttacggactcgggaatccagttgtccgcaccgaacaagccccgccgcagcgcccgcccctcctcttgctgctttggagtctcccggcttccgccttccgcagcagtcacgtgcctccgatcacgtgaccggcgcctctgtcattctactgcggccgccctggcttccttctacctgtgcggccctcaacgtctccttggtgcgggacccgcttcactttcggctcccggagtctccctccactgctcagacctctggacctgacaggagacgcctacttggctctgacgcggcgccccagcccggctgtgtccccggcgccccggaccaccctccctgccggctttgggtgcgttgtggggtcccgaggattcgcgagatttgttgaaagacattcaagattacgaagtttagatgaccaaaatggatatccgaggtgctgtggatgctgctgtccccaccaatattattgctgccaaggctgcagaagttcgtgcaaacaaagtcaactggcaatcctatcttcagggacagatgatttctgctgaagattgtgagtttattcagaggtttgaaatgaaacgaagccctgaagagaagcaagagatgcttcaaactgaaggcagccagtgtgctaaaacatttataaatctgatgactcatatctgcaaagaacagaccgttcagtatatactaactatggtggatgatatgctgcaggaaaatcatcagcgtgttagcattttctttgactatgcaagatgtagcaagaacactgcgtggccctactttctgccaatgttgaatcgccaggatcccttcactgttcatatggcagcaagaattattgccaagttagcagcttggggaaaagaactgatggaaggcagtgacttaaattactatttcaattggataaaaactcagctgagttcacagaaactgcgtggtagcggtgttgctgttgaaacaggaacagtctcttcaagtgatagttcgcagtatgtgcagtgcgtggccgggtgtttgcagctgatgctccgggtcaatgagtaccgctttgcttgggtggaagcagatggggtaaattgcataatgggagtgttgagtaacaagtgtggctttcagctccagtatcaaatgattttttcaatatggctcctggcattcagtcctcaaatgtgtgaacacctgcggcgctataatatcattccagttctgtctgatatccttcaggagtctgtcaaagagaaagtaacaagaatcattcttgcagcatttcgtaactttttagaaaaatcaactgaaagagaaactcgccaagaatatgccctggctatgattcagtgcaaagttctgaaacagttggagaacttggaacagcagaagtacgatgatgaagatatcagcgaagatatcaaatttcttttggaaaaacttggagagagtgtccaggaccttagttcatttgatgaatacagttcagaacttaaatctggaaggttggaatggagtcctgtgcacaaatctgagaaattttggagagagaatgctgtgaggttaaatgagaagaattatgaactcttgaaaatcttgacaaaacttttggaagtgtcagatgatccccaagtcttagctgttgctgctcacgatgttggagaatatgtgcggcattatccacgaggcaaacgggtcatcgagcagctcggtgggaagcagctggtcatgaaccacatgcatcatgaagaccagcaggtccgctataatgctctgctggccgtgcagaagctcatggtgcacaactgggaataccttggcaagcagctccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtataaaagtaggtgattctgtatttaaagaaaatattactgttacatatactgcttgcaatttctgtatttattgttctctggaaataaatatagttattaaaggattctcactccaaaaaaaaanatcggnctcnttggnctcac

SEQ ID NO: 97326 - DNA, 2331 bp, Homo sapiens
tgctagctgcttccgggcggaggtcctcggcctcccctaggcgaggcactaggtctgggggcggcgggtcttagcgtgcccgccacgctcgccgcctcccacctgccctggctggctggggcccgacccttgcgtcgctccggggcccaagttacggactcgggaatccagttgtccgcaccgaacaagccccgccgcagcgcccgcccctcctcttgctgctttggagtctcccggcttccgccttccgcagcagtcacgtgcctccgatcacgtgaccggcgcctctgtcattctactgcggccgccctggcttccttctacctgtgcggccctcaacgtctccttggtgcgggacccgcttcactttcggctcccggagtctccctccactgctcagacctctggacctgacaggagacgcctacttggctctgacgcggcgccccagcccggctgtgtccccggcgccccggaccaccctccctgccggctttgggtgcgttgtggggtcccgaggattcgcgagatttgttgaaagacattcaagattacgaagtttagatgaccaaaatggatatccgaggtgctgtggatgctgctgtccccaccaatattattgctgccaaggctgcagaagttcgtgcaaacaaagtcaactggcaatcctatcttcagggacagatgatttctgctgaagattgtgagtttattcagaggtttgaaatgaaacgaagccctgaagagaagcaagagatgcttcaaactgaaggcagccagtgtgctaaaacatttataaatctgatgactcatatctgcaaagaacagaccgttcagtatatactaactatggtggatgatatgctgcaggaaaatcatcagcgtgttagcattttctttgactatgcaagatgtagcaagaacactgcgtggccctactttctgccaatgttgaatcgccaggatcccttcactgttcatatggcagcaagaattattgccaagttagcagcttggggaaaagaactgatggaaggcagtgacttaaattactatttcaattggataaaaactcagctgagttcacagaaactgcgtggtagcggtgttgctgttgaaacaggaacagtctcttcaagtgatagttcgcagtatgtgcagtgcgtggccgggtgtttgcagctgatgctccgggtcaatgagtaccgctttgcttgggtggaagcagatggggtaaattgcataatgggagtgttgagtaacaagtgtggctttcagctccagtatcaaatgattttttcaatatggctcctggcattcagtcctcaaatgtgtgaacacctgcggcgctataatatcattccagttctgtctgatatccttcaggagtctgtcaaagagaaagtaacaagaatcattcttgcagcatttcgtaactttttagaaaaatcaactgaaagagaaactcgccaagaatatgccctggctatgattcagtgcaaagttctgaaacagttggagaacttggaacagcagaagtacgatgatgaagatatcagcgaagatatcaaatttcttttggaaaaacttggagagagtgtccaggaccttagttcatttgatgaatacagttcagaacttaaatctggaaggttggaatggagtcctgtgcacaaatctgagaaattttggagagagaatgctgtgaggttaaatgagaagaattatgaactcttgaaaatcttgacaaaacttttggaagtgtcagatgatccccaagtcttagctgttgctgctcacgatgttggagaatatgtgcggcattatccacgaggcaaacgggtcatcgagcagctcggtgggaagcagctggtcatgaaccacatgcatcatgaagaccagcaggtccgctataatgctctgctggccgtgcagaagctcatggtgcacaactgggaataccttggcaagcagctccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagctttccatggtaattcaacagacaaaaaataaatgttggtgtagtgataacggagtgatcgttcagaatttctgtcattacggtggatcgttttcgtccgaaaacagttagggtccaaaaaaaaggggggattccaggggccgcttaagggcaggaacaagggaagagaaggtgagtggtgacacttttggttaattaccc

SEQ ID NO: 97327 - DNA, 2111 bp, Homo sapiens
tgctagctgcttccgggcggaggtcctcggcctcccctaggcgaggcactaggtctgggggcggcgggtcttagcgtgcccgccacgctcgccgcctcccacctgccctggctggctggggcccgacccttgcgtcgctccggggcccaagttacggactcgggaatccagttgtccgcaccgaacaagccccgccgcagcgcccgcccctcctcttgctgctttggagtctcccggcttccgccttccgcagcagtcacgtgcctccgatcacgtgaccggcgcctctgtcattctactgcggccgccctggcttccttctacctgtgcggccctcaacgtctccttggtgcgggacccgcttcactttcggctcccggagtctccctccactgctcagacctctggacctgacaggagacgcctacttggctctgacgcggcgccccagcccggctgtgtccccggcgccccggaccaccctccctgccggctttgggtgcgttgtggggtcccgaggattcgcgagatttgttgaaagacattcaagattacgaagtttagatgaccaaaatggatatccgaggtgctgtggatgctgctgtccccaccaatattattgctgccaaggctgcagaagttcgtgcaaacaaagtcaactggcaatcctatcttcagggacagatgatttctgctgaagattgtgagtttattcagaggtttgaaatgaaacgaagccctgaagagaagcaagagatgcttcaaactgaaggcagccagtgtgctaaaacatttataaatctgatgactcatatctgcaaagaacagaccgttcagtatatactaactatggtggatgatatgctgcaggaaaatcatcagcgtgttagcattttctttgactatgcaagatgtagcaagaacactgcgtggccctactttctgccaatgttgaatcgccaggatcccttcactgttcatatggcagcaagaattattgccaagttagcagcttggggaaaagaactgatggaaggcagtgacttaaattactatttcaattggataaaaactcagctgagttcacagaaactgcgtggtagcggtgttgctgttgaaacaggaacagtctcttcaagtgatagttcgcagtatgtgcagtgcgtggccgggtgtttgcagctgatgctccgggtcaatgagtaccgctttgcttgggtggaagcagatggggtaaattgcataatgggagtgttgagtaacaagtgtggctttcagctccagtatcaaatgattttttcaatatggctcctggcattcagtcctcaaatgtgtgaacacctgcggcgctataatatcattccagttctgtctgatatccttcaggagtctgtcaaagagaaagtaacaagaatcattcttgcagcatttcgtaactttttagaaaaatcaactgaaagagaaactcgccaagaatatgccctggctatgattcagtgcaaagttctgaaacagttggagaacttggaacagcagaagtacgatgatgaagatatcagcgaagatatcaaatttcttttggaaaaacttggagagagtgtccaggaccttagttcatttgatgaatacagttcagaacttaaatctggaaggttggaatggagtcctgtgcacaaatctgagaaattttggagagagaatgctgtgaggttaaatgagaagaattatgaactcttgaaaatcttgacaaaacttttggaagtgtcagatgatccccaagtcttagctgttgctgctcacgatgttggagaatatgtgcggcattatccacgaggcaaacgggtcatcgagcagctcggtgggaagcagctggtcatgaaccacatgcatcatgaagaccagcaggtccgctataatgctctgctggccgtgcagaagctcatggtgcacaactgggaataccttggcaagcagctccagtccgagcagccccagaccgctgccgcccgaagctaagcctgcctctggccttcccctccgcctcaatgcagaaccagtagtgggagcactgtgtttagagttaagagtgatctcataaacgggtcgagatc

SEQ ID NO: 97328 - DNA, 1839 bp, Homo sapiens
tgctagctgcttccgggcggaggtcctcggcctcccctaggcgaggcactaggtctgggggcggcgggtcttagcgtgcccgccacgctcgccgcctcccacctgccctggctggctggggcccgacccttgcgtcgctccggggcccaagttacggactcgggaatccagttgtccgcaccgaacaagccccgccgcagcgcccgcccctcctcttgctgctttggagtctcccggcttccgccttccgcagcagtcacgtgcctccgatcacgtgaccggcgcctctgtcattctactgcggccgccctggcttccttctacctgtgcggccctcaacgtctccttggtgcgggacccgcttcactttcggctcccggagtctccctccactgctcagacctctggacctgacaggagacgcctacttggctctgacgcggcgccccagcccggctgtgtccccggcgccccggaccaccctccctgccggctttgggtgcgttgtggggtcccgaggattcgcgagatttgttgaaagacattcaagattacgaagtttagatgaccaaaatggatatccgaggtgctgtggatgctgctgtccccaccaatattattgctgccaaggctgcagaagttcgtgcaaacaaagtcaactggcaatcctatcttcagggacagatgatttctgctgaagattgtgagtttattcagaggtttgaaatgaaacgaagccctgaagagaagcaagagatgcttcaaactgaaggcagccagtgtgctaaaacatttataaatctgatgactcatatctgcaaagaacagaccgttcagtatatactaactatggtggatgatatgctgcaggaaaatcatcagcgtgttagcattttctttgactatgcaagatgtagcaagaacactgcgtggccctactttctgccaatgttgaatcgccaggatcccttcactgttcatatggcagcaagaattattgccaagttagcagcttggggaaaagaactgatggaaggcagtgacttaaattactatttcaattggataaaaactcagctgagttcacagaaactgcgtggtagcggtgttgctgttgaaacaggaacagtctcttcaagtgatagttcgcagtatgtgcagtgcgtggccgggtgtttgcagctgatgctccgggtcaatgagtaccgctttgcttgggtggaagcagatggggtaaattgcataatgggagtgttgagtaacaagtgtggctttcagctccagtatcaaatgattttttcaatatggctcctggcattcagtcctcaaatgtgtgaacacctgcggcgctataatatcattccagttctgtctgatatccttcaggagtctgtcaaagagaaagtaacaagaatcattcttgcagcatttcgtaactttttagaaaaatcaactgaaagagaaactcgccaagaatatgccctggctatgattcagtgcaaagttctgaaacagttggagaacttggaacagcagaagtacgatgatgaagatatcagcgaagatatcaaatttcttttggaaaaacttggagagagtgtccaggaccttagttcatttgatgaatacagttcagaacttaaatctggaaggttggaatggagtcctgtgcacaaatctgagaaattttggagagagaatgctgtgaggttaaatgagaagaattatgaactcttgaaaatcttgacaaaacttttggaagtgtcagatgatccccaagtcttagctgttgctgctcacgatgtggcgagtcgcccaggggacctctagagcggcgca

SEQ ID NO: 97329 - DNA, 390 bp, Homo sapiens
agagaaggggaatagggagcagaaggaggaaagcttggaataccttggcaagcagctccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtataaaagtaggtgattctgtatttaaagaaaatattactgttacatatactgcttgcaatttctgtatttattgttctctggaaataaatatagttattaaaggattctcactccaa

SEQ ID NO: 97330 - DNA, 756 bp, Homo sapiens
cgactcgcaacatcgtgagcagcaacagctaagacttggggagagtgtccaggaccttagttcatttgatgaatacagttcagaacttaaatctggaaggttggaatggagtcctgtgcacaaatctgagaaattttggagagagaatgctgtgaggttaaatgagaagaattatgaactcttgaaaatcttgacaaaacttttggaagtgtcagatgatccccaagtcttagctgttgctgctcacgatgttggagaatatgtgcggcattatccacgaggcaaacgggtcatcgagcagctcggtgggaagcagctggtcatgaaccacatgcatcatgaagaccagcaggtccgctataatgctctgctggccgtgcagaagctcatggtgcacaactgggaataccttggcaagcagctccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtataaaagtaggtgattctgtatttaaagaaaatattactgttacatatactgcttgcaatttctgtatttattgttctctggaaataaatatagttattaaaggattctcactccaa

SEQ ID NO: 97331 - DNA, 532 bp, Homo sapiens
  misc_feature (41)..(41): n is a, c, g, or t
  misc_feature (62)..(62): n is a, c, g, or t
cgccggagtgaggttaggggaggggtgctgagttcttgganagcaattccgtttacaaaccnccggtcatcgagcagctcggtgggaagcagctggtcatgaaccacatgcatcatgaagaccagcaggtccgctataatgctctgctggccgtgcagaagctcatggtgcacaactgggaataccttggcaagcagctccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtataaaagtaggtgattctgtatttaaagaaaatattactgttacatatactgcttgcaatttctgtatttattgttctctggaaataaatatagttattaaaggattctcactccaa

SEQ ID NO: 97332 - DNA, 647 bp, Homo sapiens
taaattcgcggccgctcgacctcttgaaaatcttgacaaaacttttggaagtgtcagatgatccccaagtcttagctgttgctgctcacgatgttggagaatatgtgcggcattatccacgaggcaaacgggtcatcgagcagctcggtgggaagcagctggtcatgaaccacatgcatcatgaagaccagcaggtccgctataatgctctgctggccgtgcagaagctcatggtgcacaactgggaataccttggcaagcagctccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtataaaagtaggtgattctgtatttaaagaaaatattactgttacatatactgcttgcaatttctgtatttattgttctctggaaataaatatagttattaaaggattctcactccaaatatgttttgattgtggtgtatataatactgtaacaaaatttttctttt

SEQ ID NO: 97333 - DNA, 1851 bp, Homo sapiens
gcaaatcttcagatacagagattaagttccaaattgattaagatcgttggaaacccggaatataattttggatttgttgaaagacattcaagattacgaagtttagatgaccaaaatggatatccgaggtgctgtggatgctgctgtccccaccaatattattgctgccaaggctgcagaagttcgtgcaaacaaagtcaactggcaatcctatcttcagggacagatgatttctgctgaagattgtgagtttattcagaggtttgaaatgaaacgaagccctgaagagaagcaagagatgcttcaaactgaaggcagccagtgtgctaaaacatttataaatctgatgactcatatctgcaaagaacagaccgttcagtatatactaactatggtggatgatatgctgcaggaaaatcatcagcgtgttagcattttctttgactatgcaagatgtagcaagaacactgcgtggccctactttctgccaatgttgaatcgccaggatcccttcactgttcatatggcagcaagaattattgccaagttagcagcttggggaaaagaactgatggaaggcagtgacttaaattactatttcaattggataaaaactcagctgagttcacagaaactgcgtggtagcggtgttgctgttgaaacaggaacagtctcttcaagtgatagttcgcagtatgtgcagtgcgtggccgggtgtttgcagctgatgctccgggtcaatgagtaccgctttgcttgggtggaagcagatggggtaaattgcataatgggagtgttgagtaacaagtgtggctttcagctccagtatcaaatgattttttcaatatggctcctggcattcagtcctcaaatgtgtgaacacctgcggcgctataatatcattccagttctgtctgatatccttcaggagtctgtcaaagagaaagtaacaagaatcattcttgcagcatttcgtaactttttagaaaaatcaactgaaagagaaactcgccaagaatatgccctggctatgattcagtgcaaagttctgaaacagttggagaacttggaacagcagaagtacgatgatgaagatatcagcgaagatatcaaatttcttttggaaaaacttggagagagtgtccaggaccttagttcatttgatgaatacagttcagaacttaaatctggaaggttggaatggagtcctgtgcacaaatctgagaaattttggagagagaatgctgtgaggttaaatgagaagaattatgaactcttgaaaatcttgacaaaacttttggaagtgtcagatgatccccaagtcttagctgttgctgctcacgatgttggagaatatgtgcggcattatccacgaggcaaacgggtcatcgagcagctcggtgggaagcagctggtcatgaaccacatgcatcatgaagaccagcaggtccgctataatgctctgctggccgtgcagaagctcatggtgcacaactgggaataccttggcaagcagctccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtataaaagtaggtgattctgtatttaaagaaaatattactgttacatatactgcttgcaatttctgtatttattgttctctggaaataaatatagttattaaaggattctcactccaa

SEQ ID NO: 97334 - DNA, 1937 bp, Homo sapiens
tgctagctgcttccgggcggaggtcctcggcctcccctaggcgaggcactaggtctgggggcggcgggtcttagcgtgcccgccacgctcgccgcctcccacctgccctggctggctggggcccgacccttgcgtcgctccggggcccaagttacggactcgggaatccagttgtccgcaccgaacaagccccgccgcagcgcccgcccctcctcttgctgctttggagtctcccggcttccgccttccgcagcagtcacgtgcctccgatcacgtgaccggcgcctctgtcattctactgcggccgccctggcttccttctacctgtgcggccctcaacgtctccttggtgcgggacccgcttcactttcggctcccggagtctccctccactgctcagacctctggacctgacaggagacgcctacttggctctgacgcggcgccccagcccggctgtgtccccggcgccccggaccaccctccctgccggctttgggtgcgttgtggggtcccgaggattcgcgagatttgttgaaagacattcaagattacgaagtttagatgaccaaaatggatatccgaggtgctgtggatgctgctgtccccaccaatattattgctgccaaggctgcagaagttcgtgcaaacaaagtcaactggcaatcctatcttcagggacagatgatttctgctgaagattgtgagtttattcagaggtttgaaatgaaacgaagccctgaagagaagcaagagatgcttcaaactgaaggcagccagtgtgctaaaacatttataaatctgatgactcatatctgcaaagaacagaccgttcagtatatactaactatggtggatgatatgctgcaggaaaatcatcagcgtgttagcattttctttgactatgcaagatgtagcaagaacactgcgtggccctactttctgccaatgttgaatcgccaggatcccttcactgttcatatggcagcaagaattattgccaagttagcagcttggggaaaagaactgatggaaggcagtgacttaaattactatttcaattggataaaaactcagctgagttcacagaaactgcgtggtagcggtgttgctgttgaaacaggaacagtctcttcaagtgatagttcgcagtatgtgcagtgcgtggccgggtgtttgcagctgatgctccgggtcaatgagtaccgctttgcttgggtggaagcagatggggtaaattgttcatttgatgaatacagttcagaacttaaatctggaaggttggaatggagtcctgtgcacaaatctgagaaattttggagagagaatgctgtgaggttaaatgagaagaattatgaactcttgaaaatcttgacaaaacttttggaagtgtcagatgatccccaagtcttagctgttgctgctcacgatgttggagaatatgtgcggcattatccacgaggcaaacgggtcatcgagcagctcggtgggaagcagctggtcatgaaccacatgcatcatgaagaccagcaggtccgctataatgctctgctggccgtgcagaagctcatggtgcacaactgggaataccttggcaagcagctccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtataaaagtaggtgattctgtatttaaagaaaatattactgttacatatactgcttgcaatttctgtatttattgttctctggaaataaatatagttattaaaggattctcactccaa

SEQ ID NO: 97335 - DNA, 1128 bp, Homo sapiens
tgtccccgggctcaagttagtaccgctttgcctgtgttgaaatcttattcccgaaaattgcataatgggagtgttgagtaacaagtgtggctttcagctccagtatcaaatgattttttcaatatggctcctggcattcagtcctcaaatgtgtgaacacctgcggcgctataatatcattccagttctgtctgatatccttcaggagtctgtcaaagagaaagtaacaagaatcattcttgcagcatttcgtaactttttagaaaaatcaactgaaagagaaactcgccaagaatatgccctggctatgattcagtgcaaagttctgaaacagttggagaacttggaacagcagaagtacgatgatgaagatatcagcgaagatatcaaatttcttttggaaaaacttggagagagtgtccaggaccttagttcatttgatgaatacagttcagaacttaaatctggaaggttggaatggagtcctgtgcacaaatctgagaaattttggagagagaatgctgtgaggttaaatgagaagaattatgaactcttgaaaatcttgacaaaacttttggaagtgtcagatgatccccaagtcttagctgttgctgctcacgatgttggagaatatgtgcggcattatccacgaggcaaacgggtcatcgagcagctcggtgggaagcagctggtcatgaaccacatgcatcatgaagaccagcaggtccgctataatgctctgctggccgtgcagaagctcatggtgcacaactgggaataccttggcaagcagctccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtataaaagtaggtgattctgtatttaaagaaaatattactgttacatatactgcttgcaatttctgtatttattgttctctggaaataaatatagttattaaaggattctcactccaa

SEQ ID NO: 97336 - DNA, 2358 bp, Homo sapiens
tgctagctgcttccgggcggaggtcctcggcctcccctaggcgaggcactaggtctgggggcggcgggtcttagcgtgcccgccacgctcgccgcctcccacctgccctggctggctggggcccgacccttgcgtcgctccggggcccaagttacggactcgggaatccagttgtccgcaccgaacaagccccgccgcagcgcccgcccctcctcttgctgctttggagtctcccggcttccgccttccgcagcagtcacgtgcctccgatcacgtgaccggcgcctctgtcattctactgcggccgccctggcttccttctacctgtgcggccctcaacgtctccttggtgcgggacccgcttcactttcggctcccggagtctccctccactgctcagacctctggacctgacaggagacgcctacttggctctgacgcggcgccccagcccggctgtgtccccggcgccccggaccaccctccctgccggctttgggtgcgttgtggggtcccgaggattcgcgagatttgttgaaagacattcaagattacgaagtttagatgaccaaaatggatatccgaggtgctgtggatgctgctgtccccaccaatattattgctgccaaggctgcagaagttcgtgcaaacaaagtcaactggcaatcctatcttcagggacagatgatttctgctgaagattgtgagtttattcagaggtttgaaatgaaacgaagccctgaagagaagcaagagatgcttcaaactgaaggcagccagtgtgctaaaacatttataaatctgatgactcatatctgcaaagaacagaccgttcagtatatactaactatggtggatgatatgctgcaggaaaatcatcagcgtgttagcattttctttgactatgcaagatgtagcaagaacactgcgtggccctactttctgccaatgttgaatcgccaggatcccttcactgttcatatggcagcaagaattattgccaagttagcagcttggggaaaagaactgatggaaggcagtgacttaaattactatttcaattggataaaaactcagctgagttcacagaaactgcgtggtagcggtgttgctgttgaaacaggaacagtctcttcaagtgatagttcgcagtatgtgcagtgcgtggccgggtgtttgcagctgatgctccgggtcaatgagtaccgctttgcttgggtggaagcagatggggtaaattgcataatgggagtgttgagtaacaagtgtggctttcagctccagtatcaaatgattttttcaatatggctcctggcattcagtcctcaaatgtgtgaacacctgcggcgctataatatcattccagttctgtctgatatccttcaggagtctgtcaaagagaaagtaacaagaatcattcttgcagcatttcgtaactttttagaaaaatcaactgaaagagaaactcgccaagaatatgccctggctatgattcagtgcaaagttctgaaacagttggagaacttggaacagcagaagtacgatgatgaagatatcagcgaagatatcaaatttcttttggaaaaacttggagagagtgtccaggaccttagttcatttgatgaatacagttcagaacttaaatctggaaggttggaatggagtcctgtgcacaaatctgagaaattttggagagagaatgctgtgaggttaaatgagaagaattatgaactcttgaaaatcttgacaaaacttttggaagtgtcagatgatccccaagtcttagctgttgctgctcacgatgttggagaatatgtgcggcattatccacgaggcaaacgggtcatcgagcagctcggtgggaagcagctggtcatgaaccacatgcatcatgaagaccagcaggtccgctataatgctctgctggccgtgcagaagctcatggtgcacaactgggaataccttggcaagcagctccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtataaaagtaggtgattctgtatttaaagaaaatattactgttacatatactgcttgcaatttctgtatttattgttctctggaaataaatatagttattaaaggattctcactccaaatatgttttgattgtggtgtatataatactgtaacaaaatttttctttt

SEQ ID NO: 97337 - DNA, 2465 bp, Homo sapiens
  misc_feature (2401)..(2401): n is a, c, g, or t
  misc_feature (2442)..(2442): n is a, c, g, or t
tgctagctgcttccgggcggaggtcctcggcctcccctaggcgaggcactaggtctgggggcggcgggtcttagcgtgcccgccacgctcgccgcctcccacctgccctggctggctggggcccgacccttgcgtcgctccggggcccaagttacggactcgggaatccagttgtccgcaccgaacaagccccgccgcagcgcccgcccctcctcttgctgctttggagtctcccggcttccgccttccgcagcagtcacgtgcctccgatcacgtgaccggcgcctctgtcattctactgcggccgccctggcttccttctacctgtgcggccctcaacgtctccttggtgcgggacccgcttcactttcggctcccggagtctccctccactgctcagacctctggacctgacaggagacgcctacttggctctgacgcggcgccccagcccggctgtgtccccggcgccccggaccaccctccctgccggctttgggtgcgttgtggggtcccgaggattcgcgagatttgttgaaagacattcaagattacgaagtttagatgaccaaaatggatatccgaggtgctgtggatgctgctgtccccaccaatattattgctgccaaggctgcagaagttcgtgcaaacaaagtcaactggcaatcctatcttcagggacagatgatttctgctgaagattgtgagtttattcagaggtttgaaatgaaacgaagccctgaagagaagcaagagatgcttcaaactgaaggcagccagtgtgctaaaacatttataaatctgatgactcatatctgcaaagaacagaccgttcagtatatactaactatggtggatgatatgctgcaggaaaatcatcagcgtgttagcattttctttgactatgcaagatgtagcaagaacactgcgtggccctactttctgccaatgttgaatcgccaggatcccttcactgttcatatggcagcaagaattattgccaagttagcagcttggggaaaagaactgatggaaggcagtgacttaaattactatttcaattggataaaaactcagctgagttcacagaaactgcgtggtagcggtgttgctgttgaaacaggaacagtctcttcaagtgatagttcgcagtatgtgcagtgcgtggccgggtgtttgcagctgatgctccgggtcaatgagtaccgctttgcttgggtggaagcagatggggtaaattgcataatgggagtgttgagtaacaagtgtggctttcagctccagtatcaaatgattttttcaatatggctcctggcattcagtcctcaaatgtgtgaacacctgcggcgctataatatcattccagttctgtctgatatccttcaggagtctgtcaaagagaaagtaacaagaatcattcttgcagcatttcgtaactttttagaaaaatcaactgaaagagaaactcgccaagaatatgccctggctatgattcagtgcaaagttctgaaacagttggagaacttggaacagcagaagtacgatgatgaagatatcagcgaagatatcaaatttcttttggaaaaacttggagagagtgtccaggaccttagttcatttgatgaatacagttcagaacttaaatctggaaggttggaatggagtcctgtgcacaaatctgagaaattttggagagagaatgctgtgaggttaaatgagaagaattatgaactcttgaaaatcttgacaaaacttttggaagtgtcagatgatccccaagtcttagctgttgctgctcacgatgttggagaatatgtgcggcattatccacgaggcaaacgggtcatcgagcagctcggtgggaagcagctggtcatgaaccacatgcatcatgaagaccagcaggtccgctataatgctctgctggccgtgcagaagctcatggtgcacaactgggaataccttggcaagcagctccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtataaaagtaggtgattctgtatttaaagaaataaatatagttattaaaggattctcactccaaacatggcctctctctttacttggactttgaacaaaagtcaactgttgtctcttttcaaaccaaattgggagaattgttgcaaagtagtgaatggcaaataaatgttttaaaatctaattacaatcactgcccgtcgttacacgtcngactgggaaccctgcgttaccacttatcgcctggagacatnccctttggcagcttgcgtatacg

SEQ ID NO: 97338 - DNA, 2134 bp, Homo sapiens
tgctagctgcttccgggcggaggtcctcggcctcccctaggcgaggcactaggtctgggggcggcgggtcttagcgtgcccgccacgctcgccgcctcccacctgccctggctggctggggcccgacccttgcgtcgctccggggcccaagttacggactcgggaatccagttgtccgcaccgaacaagccccgccgcagcgcccgcccctcctcttgctgctttggagtctcccggcttccgccttccgcagcagtcacgtgcctccgatcacgtgaccggcgcctctgtcattctactgcggccgccctggcttccttctacctgtgcggccctcaacgtctccttggtgcgggacccgcttcactttcggctcccggagtctccctccactgctcagacctctggacctgacaggagacgcctacttggctctgacgcggcgccccagcccggctgtgtccccggcgccccggaccaccctccctgccggctttgggtgcgttgtggggtcccgaggattcgcgagatttgttgaaagacattcaagattacgaagtttagatgaccaaaatggatatccgaggtgctgtggatgctgctgtccccaccaatattattgctgccaaggctgcagaagttcgtgcaaacaaagtcaactggcaatcctatcttcagggacagatgatttctgctgaagattgtgagtttattcagaggtttgaaatgaaacgaagccctgaagagaagcaagagatgcttcaaactgaaggcagccagtgtgctaaaacatttataaatctgatgactcatatctgcaaagaacagaccgttcagtatatactaactatggtggatgatatgctgcaggaaaatcatcagcgtgttagcattttctttgactatgcaagatgtagcaagaacactgcgtggccctactttctgccaatgttgaatcgccaggatcccttcactgttcatatggcagcaagaattattgccaagttagcagcttggggaaaagaactgatggaaggcagtgacttaaattactatttcaattggataaaaactcagctgagttcacagaaactgcgtggtagcggtgttgctgttgaaacaggaacagtctcttcaagtgatagttcgcagtatgtgcagtgcgtggccgggtgtttgcagctgatgctccgggtcaatgagtaccgctttgcttgggtggaagcagatggggtaaattgcataatgggagtgttgagtaacaagtgtggctttcagctccagtatcaaatgattttttcaatatggctcctggcattcagtcctcaaatgtgtgaacacctgcggcgctataatatcattccagttctgtctgatatccttcaggagtctgtcaaagagaaagtaacaagaatcattcttgcagcatttcgtaactttttagaaaaatcaactgaaagagaaactcgccaagaatatgccctggctatgattcagtgcaaagttctgaaacagttggagaacttggaacagcagaagtacgatgatgaagatatcagcgaagatatcaaatttcttttggaaaaacttggagagagtgtccaggaccttagttcatttgatgaatacagttcagaacttaaatctggaaggttggaatggagtcctgtgcacaaatctgagaaattttggagagagaatgctgtgaggttaaatgagaagaattatgaactcttgaaaatcttgacaaaacttttggaagtgtcagatgatccccaagtcttagctgttgctgctcacgatgttggagaatatgtgcggcattatccacgaggcaaacggtaagagaaagccattcatttcatttggtttcttgaaaccttcagtgtagagtcctaaataatgtacttatctaaaatggagtaggttagcaaaggaactaacaaagcaaatgaaatcaagattgccacaatagtgagaattatgataaacccagttaaaaatgagtagtataggccggttgcagtggctcacgcctgtaataccaccactttgggaggccgaggcaggcagatcacaaggtcaggagaccatcctggctaagatggtgaaaccccttctctactaaaaatac

SEQ ID NO: 97339 - DNA, 173 bp, Homo sapiens
ctctgaatccatcacatgacaaattgtatagtttctcactatcactttgtctaacccagaactttttagaaaaatcaactgaaagagaaactcgccaagaatatgccctggctatgattcagtgcaaagttctgaaacagttggagaacttggaacagcagaagtacgatgat

SEQ ID NO: 97340 - DNA, 687 bp, Homo sapiens
atcatagggaccgtttccctcatactgttctagtgggagtgaataagtctcacaacgtctgatggtttgataaagggaaacccgtttctcttggctctcattctttctcttgctgccgccatgttcaaggtcccctccaccttccgccatgatggtgaggcctccctagccatgaggaattatcactggaccagaggacaacttgtaaaaggatttcagaatggcataatgggaagaaacacgctaataaaacgatgagacatgaagagaatttaaaaatatacaatgatcagctgtgaagaattggccagacaagccttgattttactcattgggtgtccagtgtccatccagtcctcatataattcaagggaagcgactctcttttctctgcaagggagccagtcctgaactatccaagtcaaccgaggcaatcccatttccttgccgctacttggatgaaacatggggatgtgactcagctacagcgagagaggatgagaggcgtgctgagaacacctttgggaaggccgccgattcctgagaagaacatggcggcagagcagatggcctcaccctgcctctggaaattgcagtgtgtgtctgtgagaactgaaagggtgtggccatcttgaccccaagatgggagccaggctcaggacacgcagtgatgccggaatggctccc

SEQ ID NO: 97341 - DNA, 709 bp, Homo sapiens
gaacagtcttcttgccattatccagcctgggcctctcttcattggcctcccacttgagccgacatgggggagaagacaatgcgagtctccaccttcgcacgcaggctccctggcctccggtgaataccacgctggcctcatttatctcctgcactgttccttccctctgcatctgtgcagggagactcacgtcactgggggccactttcatgattttgttgccatcaggattagctggattaggggccagtacataaggaccccctggtgccgtgaggaagtttcatcaccgggtcagcatggtgtgaactatattctgtcaacaccaccacttcttatagccaccaaccaaaaaacggaagggtggaggtgggggcgtggcagagaaaatacctcaagtgcaaaatgtataaactcatcatagcaataaattcccgcatcatgcatttcaaagtaaaaaaaaaaaaaaaaaaaaaaaaaaaaaaaaaaaaaaaaaaaaaaaaaaaaaaaaaaaaaaaaagaaaaaagcaaaaaaagacaaaagaaaaaacagcaaaaaagaaagacaaaagaagaagaaagagaagacgagagccagacgccaaaacgagacaacggcaggaccaagcaagaggagcgaggcggggcggggggcaagcggcgcggagaggcggggcgggcggcgggcgccgagagccggtggaacgag

SEQ ID NO: 97342 - DNA, 422 bp, Homo sapiens
gcacttctcttaaacattctgtctagcctctatttgataaagaactcagcctccccagggagcccaggctctctcctgatagatctgaccaagaaactactacttctcatactgaggtaaaaagctctcatcttaacctctagtttgaattcatggaactaaagggcaggttaagcccagcttcgaatattcaatagcatttaacacattttcctatttcttctccaggataaacattcacaacatcttcaactcatccttctatgataaatctgcaatcctgttcctagttgcttttttttttagatggagtttcacccttgtcacccaggctggagtgcaatggcactatctcagcttactacaacctcctattccccagttcaagtgattctcctgcctcagcctctcgagtagctggg

SEQ ID NO: 97343 - DNA, 562 bp, Homo sapiens
atctgcggtgtttttttaaatcttgaattagttgtcaacagggagaaattgggaaattttaaataaaaatgggctggcattccccctgcagcagccagtgagtccggcacacgctcccaacaccctcggtcccccttggtcattcaggtcttacccggaccagaacaccagagggcagtgctgcctaggccaggtctcctcctgtgtctaggggccactcactgaagccttggctgagcgaagtctgggtgacaggccccgggggcatggcccaggccgggggtgtgcagagaaaaccccctggagtttctgttgtcttccagctgtgcagttcgttatttgcattgggaggggctgttcagagggagggaagaatgtctggggttcccacgtacctggggtggcccctcagcgcagggtcagagaccgcccatgttccctggggagcttatgccaagggccccacctgggtctccaattggaacctctacctgagcctctcgagtgacacctgcccttcaaattgcaggcccagtggtttgggtgcagccagatatgccac

SEQ ID NO: 97344 - DNA, 672 bp, Homo sapiens
caaaatggccgagtttaactggtatgtgaacgttttaagatttgactcaggggcataaggcagaaaaagagactgaggcaagttttagggcaggagtggaaggcaagaattgatgttgctgcagacctgtacggatttgctgctggaggtctcttttccactggagcctactttgaaatcagctgaggagccaccaaatcctatggccacctgggctgtgccctatgaacagctctctattgaaagagagctactaggttgactgatggcagttccaaggtggataatcaacatcctgtttggaagactattgtactacatcagatgatggaaaagttctgattgaggaaggttacatctactacaatactgcagatacagtataacattggtattgctggtatgattcctctcccttagaatcaggaagacagcctggcttgatgtcatgactacaggggtctaaaaacccagatgggaacttttgccttgaggttttctgaagctaagatgcatcacatagatcttggtgtttcagtctgaagacaggcagtctatgtgtgtgaataaggcccctggaaagcttgcacctgggccccaatgcttgccacagtatctttctcttgctgcaccgtatcctgtgcctttgaataaaagccacacagaagaaag

SEQ ID NO: 97345 - DNA, 752 bp, Homo sapiens
caaaatggccgagtttaactggtatgtgaacgttttaagatttgactcaggggcataaggcagaaaaagagactgaggcaagttttagggcaggagtggaaggcaagaattgatgttgctgcagacctgtacggatttgctgctggaggtctcttttccactggagcctactttgaaatcagctgaggagccaccaaatcctatggccacctgggctgtgccctatgaacagctctctattgaaagagagctactaggttgactgatggcagttccaaggtggataatcaacatcctgtttggaagactattgtactacatcagatgatggaaaagttctgattgaggaaggttacatctactacaatactgcagatacagtataacattggtattgctggtatgattcctctcccttaggatttgtttcccatttcagggaacaaacaagagtgccccaaagaagttctgagaggactattatcagtgattgccacattgattcattggatcatataaccttaggggtgtgccttcactctttatctgaccttcttctggatacagcaaacacttgtggaccagctgcactgaagcattaaacaaggttggtaagttaccaagaagcacacaaaccctgtaacttgagctgtggaaagttagacatgcaatacaagaggactaacattagattaacatgcctattctgagctccttccactatgacactgtttgaattatgcttctctgaa

SEQ ID NO: 97346 - DNA, 638 bp, Homo sapiens
caaaatggccgagtttaactggtatgtgaacgttttaagatttgactcaggggcataaggcagaaaaagagactgaggcaagttttagggcaggagtggaaggcaagaattgatgttgctgcagacctgtacggatttgctgctggaggtctcttttccactggagcctactttgaaatcagctgaggagccaccaaatcctatggccacctgggctgtgccctatgaacagctctctattgaaagagagctactaggttgactgatggcagttccaaggtggataatcaacatcctgtttggaagactattgtactacatcagatgatggaaaagttctgattgaggaaggttacatctactacaatactgcagatacagtataacattggtattgctggtatgattcctctcccttaggggtgtgccttcactctttatctgaccttcttctggatacagcaaacacttgtggaccagctgcactgaagcattaaacaagagacaagcctcatagccactacacatactgccaaatacagagatgatggaagacttgtatgtctgataatgaatattgaaagggaagaatcattcatccagaatttatgagaatctccctccacaactatcaaaag

SEQ ID NO: 97347 - DNA, 381 bp, Homo sapiens
aaaacctttatttcccccctaaacagtaggggagattcacttaattttttgagtcttgaaaagttagcatctaaatccaatgaaatgctttcttttaggttggtaagttaccaagaagcacacaaaccctgtaacttgagctgtggaaagttagacatgcaatacaagaggactaacattagattaacatgcctattctggtgagtgaatacatctacaatcaattttgaaagggctaaaatctcactaaattaacagaaatgatgtgaaaaaaatatgatgacatactatgtcttctgatcttgagaaagtcacttatgcttaattcttgcagttgtgaaaaagaatacttgggaccttatttttcaatagacactgtaa

SEQ ID NO: 97348 - DNA, 379 bp, Homo sapiens
agctttgactcttggccaagataagaacagtaagattaatgatgtgctgtttactgtctgaaactccccctgagagtttcatgtcccccgcatggccagtttgtttactgatggttttcatttggcagaatcaggaagacagcctggcttgatgtcatgactacaggggtctaaaaacccagatgggaacttttgccttgaggttttctgaagctaagatgcatcacatagatcttggtgtttcagtctgaagacaggcagtctatgtgtgtgaataaggcccctggaaagcttgcacctgggccccaatgcttgccacagtatctttctcttgctgcaccgtatcctgtgcctttgaataaaagccacacagaagaaa

SEQ ID NO: 97349 - DNA, 532 bp, Homo sapiens
gccacgaagcttccttttgagaagctgcttgtgttctgggcccccacccatgcagcgaatgaatgagcgttgaagttgagtttggacgtggttgcttcagtatccagcggtccttccctagcaacacaggccatttaggagcaccacctaaggcttcttccccttcctacagatggattgctgagttgatgagaggaggaactctgggacctgtgcctctgggaaagcagaatctttcagaagactggaagagaaaatctgaaggcagcaaatctcaggtgctagaacataaagtgaggactgagaagctggaaaagagagatggctgatgctgagtgctcagaggtggcttctggaagaaaaagacttgagctgagatggttcaaacaggcaggagtgaaggcattccaggctgggagcagagtatgagcaaaggcagggagattcctggcagtgactcagaatctggtagcccagagaccaagaaacctacatttatggatgaggaagttcaaagcatactcacgaaaat

SEQ ID NO: 97350 - DNA, 383 bp, Homo sapiens
ggaatactggctgcaaaagttcagcgtttggcatttgcaatgattgctgtttgattttctttatggttgtgttggcacattctggaaagtcaggaagctcaagtatatactgtgggagctctatggggtgggaataggagatatacaagctttgttttgtattataactattgcaacacatttccaaatgtcactttttgtccatggtgggagaacctggggatagttcaatgtcagatggtttcaagtgacataacactagtgcagtaatttatttattcaattattgtttattaagtgtctactatatgttgagtctggtgacactttggtttttctgtgctacatcagaatgaaacaataaaatttaaacacagtcgacg

SEQ ID NO: 97351 - DNA, 535 bp, Homo sapiens
aacgggtgatgcggttgggataaataatgccagggaaatctactgtctcagtcttattaaatatagactattgttgaatctaagtttcagtcaacaaccagagaagccactagcgatacctccatctacacaagctaacatattcaattcagaatctgtattacatgcacctcgtatcagtaaattctaaccaccttagtgtaatatcctgagactctgttttcacatgtccctcagatttctgcttttatatattagcaaaatcttggaattttttggcctgtaaaactgtttccattgtgtgtacctgtccccctacaacatgctgagatttgaccctagttatggctctagtgatgacggggttagctgtggttggttttgatgagaatgaacgtcctcctgtagggcatctattgcacatgaggatatcacatgattttccagcaaaagaaggctattctttttagatacagagggcaggtggaagtttgaaatagtcagtttcattctgatccaaccagatattcccatt

SEQ ID NO: 97352 - DNA, 442 bp, Homo sapiens
gcatgtgctgaggtgatctaaggatcccctcacgctttatacttcgtgctttttcaagcaattgcggttctcctgtctagcccgctgccactggactatgctgtaagtcctctctataaactctatgtcttgcttactggctctgggtctcctctgtagcctctcaaacatggtgccatccctaaaagtcaacagggctccaggatgatggcacatggagctctactaattctctcaatgtatacacctctgagactgaactctaattcctgtaaacctgaactactttcaactttccagtggttttggccaaaaaccttagtcattcttcacttctctctctcacaattgcaggcattctgtcaaaaaatcctttcattttactgcaaaatgtgtccagaagctgacctcttcacacctcctccacagctactaagtggag

SEQ ID NO: 97353 - DNA, 561 bp, Homo sapiens
ttttctcagcttctgatgcttcctttggtcttgtaaattggctctgaatggccatattgcgatcctgagccatttcaagttctttgtttttctcagttagtgccttcagttgattgttgagtttctctgaagtataaaccgttgagctcaacgctttatacttcgtgctttttcaagcaattgcggttctcctgtctagcccgctgccactggactatgctgtaagtcctctctataaactctatgtcttgcttactggctctgggtctcctctgtagcctctcaaacatggtgccatccctaaaagtcaacagggctccaggatgatggcacatggagctctactaattctctcaatgtatacacctctgagactgaactctaattcctgtaaacctgaactactttcaactttccagtggttttggccaaaaaccttagtcattcttcacttctctctctcacaattgcaggcattctgtcaaaaaatcctttcattttactgcaaaatgtgtccagaagctgacctcttcacacctcctccacagctactaagtggag

SEQ ID NO: 97354 - DNA, 707 bp, Homo sapiens
gtgatttgcccaggcaccccatctttttgctatatcaggagctccagtacgggtgggtagagaggctgggcaaagatgctgggagagttaaagtttatggtcattgggaggcttcaaaacttttagaaggctgagtggcaactttcagttgcttcagtttctcaggtctactggagaataagttcttggagcaatttgtcctacatgtttagcttatcatagggtggggaggtgacatgaatagataatcaaaggtcaggctgcatcctcgacacacagaggtctatgaggacctgccctgttgccatggtaacaaaaaggacagtggtggacttgctgctaggctggaaggtatatagctgaggtcataaactcacagctcatgggttgattctagttagcagacatatttcgactgagccataagtctataaaatttttataagttatttgctaacatctaaaatttgggatatttcatttaaaatccgaatttccaacttctcttgcaaatttgaaatctctggacacatggggcttcattccttcttgtcagtgattgcttagagtgggagatggcttccttttagagagaaccagagttctccagctttgtttacttgtttttccttttacctaacctttgtcatcactggtgttatcagcctattccctggcaccactgagtgtacaaccatcgctctata

SEQ ID NO: 97355 - DNA, 334 bp, Homo sapiens
cgaaatacatggagagacagaaagtagagtagagatttctgagggctggagagtttggagagaattgtataatatgtggtctttgtgtctggctctttttacttagcataatattttgaaggttaatccgtgttgctgcatgtgtcactacttcagtcctttgttgttaataatattccattgtatggatataccttgacatttatccaaatgtcaacatttggatatttatcttggacatttatccaagatgaccaacagcacatgagaagatgcttaacatcgttaagtatcatttaaatacaaatcagaactatagtgagataccacttca

SEQ ID NO: 97356 - DNA, 217 bp, Homo sapiens
ctttactcccatgttgtctggccatgtgatgttttgaaaagttttcaaaacaacatatatgggctcatttcaaagctgtttttaatataccacatgagaccagttctgattgtatgtagttttcctgtcttacagttgtccagtataagagtgacatttttctaggtcaaatgtcttgagttagagtccctgtgtgaccctgggcaagttatttcac

SEQ ID NO: 97357 - DNA, 408 bp, Homo sapiens
aaacacacacacacacacacacacacacacacactctcactctctctctctctccccgcacctccccccgaaactggtagaactaatgaatgaattccgtagtttcaggacacaaaatcaacatataaaactccatagcatctctatataccaaagatgaactatctgaaagggaaattaagaatgcaacctcatttactttagcaacaaaaattttaaaatacttaggaatttacgggactcagcaaaataactgacacaaataaatggaataaaaacacaaataagtggaaagacatctcatgttcacagattggaagaattaatatcgtctaagtgtccatactacctaaagcaatctacagattcaatgcaatccctatcaaaatcccaattgcactttttata

SEQ ID NO: 97358 - DNA, 463 bp, Homo sapiens
gaaagagccgaggtcgatcaaggactgctggaaaatggatccaagcacctttaagttccaggtgaccatagatcaggaaagaaaaaatgtcccctctctaaccgcaactctgcaaagattcgggaaacaaagttcccggcggtttctcagaacactaactagtcttcggatacagtctagcttttcctagcaatgtggttcgcaccaggaagctgaatggagcattaaaaagacggaaatgtcatttctgggcctggcgctgtggctcaggctgggcgccagtagctcacgcctgtaatcctagcactttgggaggccgaggctggcggatcatccgaggtcaggagttcgagaccagcctggccaacatagcgaaacccccgtctctactaaaagtacaaaaattagccgggtgtggtggcgggcgcctgtaataccagctactcaggaggctgaagcagga

SEQ ID NO: 97359 - DNA, 633 bp, Homo sapiens
tccagcagactcttgcaccggcagccccttttcatgagataagaaagcctaggagggttgggggcaggagggcacccatgaaagacagggtgtctggatgttctactggggattagaaaaacaaaacataaaatttccatatactctgctaaaaagtccattttagaagactacatggttacagggagaaatacgcatgttatattaagtaaaaaaacactgtggatactatgattttgtaaagtaagtataaatatatatgtatgtgtgtagaaaatgccttgaaaaatattcatactcaaaatgtagctgtgtcctagcggggcatggtggtgtgtgcctgtggtcccagctacttgggaggctgtggcatgagaattgcttgaacctaggaggagaaggttgcagactgtctcaaaaaaagatgtagctgtgtccaagtcatgttactaatgattgtgcatatatatggttcttgtgacaagtacacattagcttagtgacgaagctgtcacatgatttttgaggtcaaaagtttccaggccaggtgcggtggttcatgcctataatcccagcactttgggaggccgaggcaggtggatcacttgaggtcagaagtttgaaaccagcctg

SEQ ID NO: 97360 - DNA, 462 bp, Homo sapiens
agagcaagaaaatggaaacatgttcttctacgaactgtggaacaaggagggatctcagaagacatgtagtaacttcttttaataactacctgtgtcactttgggcaagatttgcactttgatgaatgccatcctggagctcctagaaaccagtgccatgagtaaagccagcctggaagagaaaagatctaagcccagctatgactgtgtctgtcacttgagtttcttaataagaccctacatgacctgaattacatgagtcccttctctactccttttctgttcaagccagtttcagttaaatttccatgtttgttacttgcaactaaaagccctaaaggagaaatgatatcttataataatggactctatcatttgtatgaactttctatctataaatgtgatggcctttgatgacttctaattgttatttcaagtcacacgaataaatacagatcggccg

SEQ ID NO: 97361 - DNA, 797 bp, Homo sapiens
cagttggggaagtctatggacatgtcctcagcttgcagattctctcctgggctgtgtccagtccactgacgtccgaggcacaatcccccgtgtgaccctgcctggcggcggcctcttgttagagctagaagaggtctcaccatgtcgcccaagctggtctcaaactcctgagctcaagtgatctgcctgcctcggcctcccaaagtgtcacgcctgtaatcccagcactttgagaggccgaggtgggggcggatcacctgaggtcaggagtttgagaccagcctggccaacatggtaaaaccccatctctactaaaaatacaaaaattagcctggcatggtggcaggcacctgtaatcccagctactcgggaggctgaggctggagaatcgcttggacccaggaggcagaggttgcaatgagcagagatcatgccactgcacgagtgaaattccgtctcattaaaaaaaaaagaaagaaagaaaaaagaaactaaacatcttaccttataattcagcagttgcactccttgatctttacccaaagggttaaaaacttatgtctacacaaaaccctgcacaccaatgtttatagcagctttagtaattgtcaaaaactggaagccaccaaggtgtctctcagtaggtgaatgaatagacaaactgtagtgtacatttgcaatggaatattatacagcaatgaaaaagagtgagccatcaagccatgaagcgatagtgaggaaacgttaggtgcacattaccaagtgaaagacactgatctgaagagtctgcctactgt

SEQ ID NO: 97362 - DNA, 374 bp, Homo sapiens
tcccattgtctggatgtaccacagtttatcattcacttactgaaggatattgagtttgcattgagtttttggtgattaagaataaagcttctggcctggcgcggtggctcacgcctgtaatcccagtgctttgggaggccaaggcaggcagatcacctgaggtcaggagttcaacaccagcctgacaaacatggagaaagcctgtctgttataaaaatacaaaattagccgggcgtggtggtgcatgcctgtaatcccagctacttgggaggctgaggcaggagaatcgcttgaacctgggaggtggaggttgccgtgagccaaagtcatgttgttgcactccagcctgggcaacaagagagaaactctgtctt

SEQ ID NO: 97363 - DNA, 278 bp, Homo sapiens
agagcaaaaccctgcctcaaaaaataaaataatataaataaaataggcacaaaatggggatgaaaacccctccctgcagtgaggattcctaggtaatggagggagctggaggtgttaagtacttcataaacaagagcagctgctgttaccatcatcagcaacagatcaatgccagcctcggaagagaatcccaaaccccagaaccctaacccggcctggcctccctctcctgccgtaacctgagtcggatcctccgatgtcgtcctcggagaagctct

SEQ ID NO: 97364 - DNA, 113 bp, Homo sapiens
gtgaagagggaatgctaggtggaagctaatcacagaaagtctgaatatgtaaagttattgcatcaggcaccttttactaactaatcttgtacagaagctagaaaaaaagcatt

SEQ ID NO: 97365 - DNA, 412 bp, Homo sapiens
actgggattacaggcatgagccaccgtgcctggccagaatattatatctttgagtgtgaatgttaaatggtggaaaaacaatagaatgatctctgtagattcaaaatctgcactgatcttttttgtccagattcatattacaatcttgaggaatttctcataattctttgttttagtggatgcatttcatgggctacagttttcatttttactcacctaactttatccaagtccttggtcaccttctctggaaaaaaatttgaagattatggcagctgttgaatccaaacagtttctcagtgatttttttttttttttttttttttttttgagatggagtcttgctctgtcacccaggctggagtgcagtggcacaatctcagctcattgcaacctccacctctcgggttca

SEQ ID NO: 97366 - DNA, 303 bp, Homo sapiens
gaattcagccctttccatcaacatcagcatagttagggtcttatgagtagtcagctactacagctgtgcttccagggaaagcctggcttccagaggcacatagacacattagtgcttctacagggcatttagccaggagggaaggaaggtctggaaagcaggttgggtgagaagagaggttcaaggtgcggggtttctcctaaacaccctggaccatttgttcgtggggctgtttgcacctcctgcctcttgttttgcttcgtgtatgtgtacaaataccttaaaagtataagtgttccagca

SEQ ID NO: 97367 - DNA, 365 bp, Homo sapiens
cccactgaccatgctggggcccctttcctcatcttccatgtccactagtgagtctgagggctcaccatctgcagccagcatcacccttcacccagaatatatctccttgttcccttcacacactttgggaggccgagacgggcagatcatgaggtcaggaggtcaagaccatcctggctagcacggtgaaaccccatctctactaaaaatatgacataacataccggacgagtgactcccgcgtcacgtcgccgggcacgcatggccgcagggcccgggccggcggaggccgacgacgggcgtgcacccggggaggcggagctggcagtaagcggaaatcggcgccaatggcacttccaccctgg

SEQ ID NO: 97368 - DNA, 411 bp, Homo sapiens
atacaaagattagccaaatgtggtggcaccgtgcctgtggtccccagctacctgagaggctgaggtggaaggattgcctgaccccaaggaagttgaggctgcagtgagctgagattgcaccactgcactccagcctcagtgataaagcgagaccctgtttgagaaaaaaaacagaaaacgaagatttggccacaaagacagacatacctagaaggcaatgtgcaaacagccacctgatgggggcaggattggggtgatgcgtctgccagctaagggatgcctgaggctaccagaagccagaagcaggtggaacagacccttccccagctccttcagagggagcatgctctgccacagcttgatttcagatttctggcctcaagaactatgagacaataaatttctgttcta

SEQ ID NO: 97369 - DNA, 624 bp, Homo sapiens
aaaggatatgcaacagaagttgaataaaaggagagactctgtttctgaatggaaaattaataaatgttaatttcatggaccagtttcatggaagataatttttccatggactggaggtggagggggatggtttcaggatgattcaagtgcattacatttacttagttaaaatataaatttgacacatttccattagtgtcccaaaaggtacttttctactgtacttgacagttgatactgtagttcatctggaagaataaatgagaaagtagtaaaatataaacaaattacagtaatacaagggcttgtttttatcaaatattaaaatggaccgtgaagccataggccagcatagttttggcagagaagagcaagatcagagaagaacggagaatccacagataggtccaagtatgtatgttggcttactatgtgacaaaaatggtaattcaaaccatggaaaacacatttagtcgtttatttatttttagaattgtgtttatccatttatttaataaatagataatagaacttaaataaatagagtatttgaaacaaaacaaaaccattctcccatgttacagtagacttactccctgatagacaatggagaaggaagggtga

SEQ ID NO: 97370 - DNA, 300 bp, Homo sapiens
ggctcactgcaacctccgcctcctgggctgaagtgagcctcccacctcagcctcccgagtagctgggatcataggcacatgccaccactcctggctaagtttttaaatttttagtagagatggggttttgccatggtgcctaggttggtcttgaactcctgagctcaagtgatttgcccacctcggcctcccaaagtgctgggtctacaggagtgagccactgcaccaggccttttcttgtgtatctttaaacctttttctctctctactgacacattcccatcagctcttaaacatgct

SEQ ID NO: 97371 - DNA, 636 bp, Homo sapiens
ccctcatcttaaaaaaaaaaaattaaaaaattagctgggtgtggtttcacttgcctatagtcccagctaactatccaagcaggaggatggcttgagcccaggagtttgaggctgtagtgagctatgattgtgttactatgccccagctgggatgatagaaagagaccccatctccaaaaaattctatttactgtcttaaaatgtgcttcactagctgggtgtggtggctcacgcctgtaatcccagcactttctgaggccgaggcgggcggatcacaaggtcaggagatcaagaccaccctggctaacacggtgaaacccctcgatgatagttccattcgattctatgcgatgattccattccattccattggaagatgattccattcgagaccattcgatgattgcattcaattcattcgatgacgattccattcaattccgttcaatgattccattagattccatttgatgatgattccattcgtctctactaaaaatacaaaaaaattagccgggcgtggtggcaggcgcctgtagtcacagctatttgggaggatgaggcaggagaatggcgtgaacccgggaggtggagcttgtagtgagcagagatcgtgccactgcactccagcctggg

SEQ ID NO: 97372 - DNA, 145 bp, Homo sapiens
cagtgtcaaaatgctgacaggtgaaataatatgggcaatgaaacatgtacattagggtcaggaactagaagttcacttagagcagtttcgatggagtcggagatggtagagcagacaaatgcatatgagaagagaagaggtcatg

SEQ ID NO: 97373 - DNA, 1937 bp, Homo sapiens
tcttttcttagagacatagatggctcctttctggggaatgctggttctgtgatacctcaagcagaatatgaatgggacggaaacagccaagtaggaattggagactacagaattcctaaggcgatgctcacattcttgaatggaagtagaattcctgtcactgagaaagcacctcataaaggaattattagagattcaacctgtaagtaccttccagagtggcagagctatcagtgctttgggatggaatatgcaatgatggttattgaaagtctggatcctgacacagaaactcgaagactttccccagtggctataatgggcaacggttatgttgatcttattaatggcccacaggatcatggctggtgtgctggatatacatgccagagaaggctgtccctgtttcacagcattgtggctctgaacaaatcttatgaagtttacttcactggcaccagtcctcagaatcttcgactgatgttgcttaatgttgatcataacaaggctgttctagtaggaattttcttttccacacttcaacgtttggatgtctatgtgaacaacttattggtctgtccaaaaactacaatatggaatgcccagcagaaacactgtgaacttaataaccatctgtacaaagaccaattccttcctaacctggattccactgtccttggtgaaaactactttgatggaacctaccagatgctttatcttttggttaaaggaactatacctgttgaaattcacactgccacagtgatatttgtttctttccaattatctgttgcaacagaagatgacttttatacctctcacaatctggttaaaaatcttgccttgttcctaaagataccaagtgacaaaatccgtatcagcaaaataagagggaagagtctgaggaggaagagatccatgggattcataattgaaatagagattggagaccctcctattcagttcataagcaatggcaccacagccataggtcagatgcagttatctgaactccaggaaattgctggttctcttggacaagctgtaattttaggaaacatcagtagtatccttggatttaacatttcgtccatgtctattactaatcccctccccagcccaagtgactctgggtggattaaggtgactgcccagccagttgaaaggtctgcatttcctgttcatcacgtggccttcgtgtcctcactcttagtgatcactcagccggtggcagcacagccaggacagccatttcctcagcagccttcggtaaaggcaacagattctgacggtaactgtgtatcagttggaattactgcactaactttgagggccatactcaaggactccaataataaccaagtcaatggccttagtggaaatacaacaattccgtttagcagctgttgggccaactacacagaccttactccccttagaacaggaaaaaattataagattgaatttatactggataatgttgttggggtagaatccagaactttcagcctgctggcagagtctgtctctagcagtggcagcagcagcagcagcaacagcaaagcatcaactgtgggtacatatgcccagataatgactgtagtaattagctgtctggttggaagaatgtggctcttggaaatatttatggctgcagtttcaactttgaatataactttaagaagctactaaagtgctgttccgaagaataggctgaaacaaaaatataagaattattagctactttgttgggcaataggcaaaagtctatagcattttcatgaaaatatactaaaaatatttttatgatatataaaatgtactaattagctttaaacactaaaatcagatttcttcaaaatataaatttgttttgattctttatatttatatgtttttatttcatttcaataaacttccagaaatttgtcatttgg

SEQ ID NO: 97374 - DNA, 1267 bp, Homo sapiens
aaaattaacactttattttttaaaatgacacatgataatagaaatgcatgataatgcttcattggtaaacaaagattggtaggagaaagtattaaattaagagacatatattctcccactatgttttcattcgtttttcttgtatctgttttatctacctttgtttttcctttaattccaacttaaaatatattctcctgagttcttccttttcctcccctcattaatatgactgctgtgttttgctcaggtaagactagaaagccttagaattctataatgtgatggagcaatgcaaagaatgctaaagtgaacccataggtcagatgcagttatctgaactccaggaaattgctggttctcttggacaagctgtaattttaggaaacatcagtagtatccttggatttaacatttcgtccatgtctattactaatcccctccccagcccaagtgactctgggtggattaaggtgactgcccagccagttgaaaggtctgcatttcctgttcatcacgtggccttcgtgtcctcactcttagtgatcactcagccggtggcagcacagccaggacagccatttcctcagcagccttcggtaaaggcaacagattctgacggtaactgtgtatcagttggaattactgcactaactttgagggccatactcaaggactccaataataaccaagtcaatggccttagtggaaatacaacaattccgtttagcagctgttgggccaactacacagaccttactccccttagaacaggaaaaaattataagattgaatttatactggataatgttgttggggtagaatccagaactttcagcctgctggcagagtctgtctctagcagtggcagcagcagcagcagcaacagcaaagcatcaactgtgggtacatatgcccagataatgactgtagtaattagctgtctggttggaagaatgtggctcttggaaatatttatggctgcagtttcaactttgaatataactttaagaagctactaaagtgctgttccgaagaataggctgaaacaaaaatataagaattattagctactttgttgggcaataggcaaaagtctatagcattttcatgaaaatatactaaaaatatttttatgatatataaaatgtactaattagctttaaacactaaaatcagatttcttcaaaatataaatttgttttgattctttatatttatatgtttttatttcatttcaataaacttccagaaatttgtcatttgg

SEQ ID NO: 97375 - DNA, 402 bp, Homo sapiens
cacattgcggtttaattacaaactttttttgtgacatactgttccccttgcctgcaaaggcatggattgtcaagagttgactgaaaaatgttttttagaaaccttgcaaattatcagcagattagtgatgtaacagagtacccccatttttctgataaagaacatgagttatttttaaaatgttattttcttttctctttcctccttttcccctgttccccacttcctacttatgtctttaggaatgcagttataaccttgaccttcccttcaccagacactccctacagggcgagcttatctaactgtgtgcttacttagaagctccagagcaggaactttctcccactgggagattgccttgagagacaacagtcaatttacaacgtaacatgtgcctgc

SEQ ID NO: 97376 - DNA, 327 bp, Homo sapiens
ggcaattacagaagccagaaagaatgcaaaacataccatctgcaagttggagcaccaggtaagccagtggtgtgatgcagtctgagttcaaaggcctgagaatgaggagagccagggtataagtcccagagtctgaagacccaagaaccaggagctctgatatccaagggcaggagaagatggatgtcctggctcaagaggagagtgacaatgcacccttcctctgcctttttgttctatttgggtgagccctcagtggattggatgataccagatgagacgacgcagatcttcttgactcattctactgattcaaatgctaatctc

SEQ ID NO: 97377 - DNA, 791 bp, Homo sapiens
agcaattccaagagtatcatctgagccagcctgaacttcctctgctactattattcaaataaggatttgaataagcagaatttgcttcagtgaggaaactgcctggggcatcagcctaggagaggtgtggaccatgagagtgggctgggggcggccctccctctcactcataggggagcaaaccaaacagctcaggctggaagtcctgcagggaattcagcaccggggtggcctttctcctcaagtctcagttcaaggttctgtctagaatgaagaccacttgcatcccagttgccagggttgcctccacctcattgagagcatcttcaaacaaggcacctctccataggaggacagggagagaacctgttggcacaagctgggaggatgttggggtctggcttgctgtgctgtacttcggggtcatctccctgcataatgtgagaaaacaggctgaagaactccttgtgtcagctcaccttcatctccaatgaggcagaccctgagctggtggccatggcaaagggaatgctgtgtttctgcaggtggacgatgagattctcagcccctggcatgagcacagctgtagggaacacttcctttaacttcgtttggctttcttccaccagttcctccttggacatcaggagctgcaagatgtctattataatctgtgctgcctctaatgcctacttacccattaccagggactttacaacccagctgtatttcttttcatagaaatcacatatttcttgaaacagcactgaatatagccattcagtatccag

SEQ ID NO: 97378 - DNA, 201 bp, Homo sapiens
cgccatgttggccatggcgcagggagcggatcgggcgggcgagcggcggatctagtgtgtggaggcggccgcgggcgcggggggctgttttcgggcggggtgggcgcccatgctgtggccgggggcagtgaggaggaggaggagcgggccggccgcgctgcactgaggaaggaggtggaggaggcggcgggagtcctcccc

SEQ ID NO: 97379 - DNA, 398 bp, Homo sapiens
gcatgaggtctctgtcctcaggatataatcacctgccaaaggctccacctcaaaatgacaacacattggggattaggtttcagcataagaattttgaggaggacacaaatattcattcaacggaatacggattatctttaaaccttacaaatctgtttgacatagctcttgttattaatatttccattttatatatgaggatatcattctcaaagttaattgtccagtatcaaatgactatttagtggtacagctaagcttgtctgactccacaacctcatctcaagtgatcctctcactttggcttctcatagtgctgggattacaggtgtgaacactgcacctggccaatctattattttctcaagtgagctttggtagttgagatgaggtcgacg

SEQ ID NO: 97380 - DNA, 291 bp, Homo sapiens
cactgatgcagggaattaagataaacctcctgctgaagatgatcatcaggagaaagtgattctgacaaatcagtgaaatgcataaagaaaggacaaagagacaggacatgtcacaaaagatttttttgcgctacgtcacctctgtgggttttaagagattgtattcaagtggatattcttagaccacattcttgaggcgttattagtataagaacctgcctatgggagaagtggacctaccatgaaagaagaaagctgaaattctgtctgttggagaacatggggaggaaa

SEQ ID NO: 97381 - DNA, 634 bp, Homo sapiens
accctgggtgactgtgttgcagatcagaaggagaattacagttcttatttgggatctgcttttgtgtgaccttggccgagtcagttaactcctcggggctatggtttcatcatctataaaattgagggtttgaaccaggtcccccgatttaaagctctcttgccaagacttttcaaccttacctgccagaatccccattctagaaagggagcctttttcagagagcatggagaccccaagtttatgtgaacaaaagtgattcctttagtcgtcttcccaccaacaaagaaatgcccgtggtgctccttgtaaatttccaccagtctcagctgtggtgattccacttgtagctgagatttgtatgcggatgaggcttttgcttcatctttctctgggagctacaaaaaggaggatgtgtggacaaatcaaaacagaaacaaatagcagcttcctgctttgtcctgtagaccaggtaccctgatgccttcctagcatgcggaggaatgaggaggaagccatgcccatccttgtcccctctagacactttcccggctcctgtccagcccagccctgatgcctggaaaaataaggaagggaaagcaggaggggaggacaaggagaaaaactcccagaa

SEQ ID NO: 97382 - DNA, 374 bp, Homo sapiens
aagcccaagtcaggggccaaaaatccatggaatgcaagacccagagctgcaggccacactgaacaccacctcaaagagggcttttcttctgcctcaagcaagggccctacatttgcaaaacactgtggatagctgcacagtgaggcttcccagctcaggttcctggctttaggctgccgtgtgctgtgtgtccccaggcaccgagggaccagattgggagaagcctcagggttcagtgaggctggcggggagctggactgcaggagtccaggtcctggcccggtttcatctaaccatgctgcgtctcagtttcttcatctggaaaatgggctaacagtcagatcttcctcttagggtcactgtaaactccttag

SEQ ID NO: 97383 - DNA, 520 bp, Homo sapiens
gttctttaaacagtagttctcaaactttagtttgagattgcaccactgcactccagcccgggggacagagcaagattccatctcaaaaaacaaaaaacaaataatcacctggagagtttgttaaaacaggttactgcataccactcctggagttttctaattcattgggtctagggtggggtctaagaagttcgcagatgatgcttctggtccaggaccactgtttaagaactgttggccttaaatgttaaccttatggcttttttcctatatcttttattctccccaggatgtattgttttcaacctgttgatcatactgtatgtgtctgccctgtttttgcttaatatttttgcaactgtttttcccagttaaaaataatgactaggggccgggcgcggtgtcacgcctgtaatcccaacactttgggaggttgaggcagacaaatcatgaggtcaggagattgagaccatcctggctaacatggtaaaaacccatctctactaaaaatacaaaaaaa

SEQ ID NO: 97384 - DNA, 292 bp, Homo sapiens
atttgttcccccttctactttttgcttccctgtggctgctgtttctatcctccagccagagagctagtgtttattttctccattgtgttacacacttgtgcagctgcaaccaccatatccagggcccaatggtaggaggtagagaagaaaagcaaaagggattggcctcatcctcttacaacgatagttccattgaatagagagaaaggttttcctgcctcagagtgttggctgcactaggcttttgttactgtagtctggccctgttaccatgggattgcttgcatgtggg

SEQ ID NO: 97385 - DNA, 369 bp, Homo sapiens
ggatcttttaaaagtctgattccctggggtcatcccagaccaattaatcagagtcactgaggtgggtcttcaggtgatttcaaagtgcagctgaggcacaaagtttctcaatttcagtgtgcattatccttgggcggcttgcctccacctgtccaccaccccaaagaaatttggtttcgtaggtgtgggattttctcacagatctacattcacacatgcatctcaggtgatgctgatgcagatgatctctggtccacatgtgactactgctaccggactgaagttcctgatttttcatcctcatcacttatcttttctgcttctccataaatcttctcccctgggctttgttcttgtggctcttcaccc

SEQ ID NO: 97386 - DNA, 399 bp, Homo sapiens
ggtcgtggtgatgatggtgttgacagcagtggtgatgatgataatggtggtgatggtgatgatggtggtggtgatgtcaatggcagtggtgatggtcatggtgaggatgatgatggtattggtgatggtgaggatgatgatggtggtggtggtggtgacaacgatgatgatgatgttaaggaaaaggagagggaggaagacagagagataaagagaagcaaatatgttacaacgttaacaactagtaagggggtatgggtgttcactgtatcattcttgcaaatattccattggtttgaaattgttcaaaataacaagttaagaaaaataaaccctgaagaaagtctttctcacatcttccatcactgacattccagtccaagtcccatctccctccca

SEQ ID NO: 97387 - DNA, 461 bp, Homo sapiens
tgtggtagcgtcccccgcctgcgccgcaatacaggaacacacaaaaaaaaaggtagcaggcctcctctgccatcataccagcaagggaaggtggatatctcctcactagtgcccaatgagggttgaagtccaggttctccacttggcctccactgacgttctagcaggggagaggagactcatcccttctgttccccagagatggggtctcactatgtagcccaagctggtcttgaactcctagcctcaagctgtgctcctgcctcagcctcctgagtagctgggattacagaatgtccaggggccaatttaacatatgatgcacattgcttgccttagctgaagatttctagtacactttataaagaattctcgtgggaacctagaagacttgaaaactctaatgtcagtaagtctaatttcattgttttgacactaatttaatcttttctcttggctgc

SEQ ID NO: 97388 - DNA, 195 bp, Homo sapiens
cagatcacttgagcccagcggttcaggagcagcttgggcaacacagcaaaaccctgcctctacaggaaataccaagaaaaaaaaaattagccgggcatggtggcacgtgtctgtaatcccagctacccaggagactgaagtgggaggatcgcttagcttgaaaggtcaaggctatagactcttgcctgtgagaca

SEQ ID NO: 97389 - DNA, 568 bp, Homo sapiens
  misc_feature (539)..(539): n is a, c, g, or t
ccatcagcacacgcagtttttctcagttttctgagatggggccatcttgaatccaacagacaacacacagcatcagccagactaacacaaaggacgtcatgggcatggacgtaaatactggtgtcaacactaggtctgcacctcgagaggagtggagcaaaaggatggagtggcagatgaaggtatgctgttcagaaaggaggcagaaatgaaaggaagaccatcagtgcgctccacagcttgaggaccgtcctggagggcaaatgccagctgctcacttctgaaaagaaaaattccagtgaaatgagtacagtcattcttaggattactcacttgatactgtgtatgtctcttcttggcttctcatctccacacaaaaccctcaggtggtaaaaatctaattaaaaaaattatataaagtcttgtagatttattagcctgaacataatagattttttttaagcacgttaagtcttccatggactaaaagaaatctaattaaaaaaattatataaagtcttgtagatttattagcctgnacataatagattttttttaagcacgttaa

SEQ ID NO: 97390 - DNA, 402 bp, Homo sapiens
  misc_feature (369)..(369): n is a, c, g, or t
  misc_feature (395)..(395): n is a, c, g, or t
  misc_feature (401)..(401): n is a, c, g, or t
atgaaaaggcaggctacagactgagagaaatattttcaaataacacatatgacaaaagactagcacctggaatatacaaagatctctcaaaactcaatagtgaaagaaaaaaaccccagtctacttagaaaatgggccaaagacatacatacatttcactaaataagatatacattcggcaaagaagcacacaaaaagctttggcataattaaccactgaggtaatgtaaattaaaaccacgatgagatgttactacatgccgttcagaattgctaaaataaaaagtagtcacaacagtggtcaggtgtggtactttgctcttcagccacagttaagttagttttagttccctgagtatgttatccggntctctgggttctgggctttgctcctntttccnt

SEQ ID NO: 97391 - DNA, 168 bp, Homo sapiens
tctcctgagagccttacaaacaatgtgacacacacacacacacaacctatatatacacacatgtattatatacacacacatatgtgtatatataatatatatgatgtgtatatgtatccatgggtgtttgttatgactattgtcatagtcataacatagtcatagtgc

SEQ ID NO: 97392 - DNA, 206 bp, Homo sapiens
ctctttctacggtttctctccatggttgatatttgaggagagggaaccaacaacagatagaatatgaaacatttcttccacatggtagttactcagtaaaattgttaaccaaacaacttagagtttaaaccattattttattgtgattggttggttggttggctggtcggttgattggcttgtcttttgaattatcttctgaccgc

SEQ ID NO: 97393 - DNA, 823 bp, Homo sapiens
gcacagctgcccgtcagaaagtgttctccctcgggcatttcgcactccacggaggccctgattaaggaagagcagtgtctcctcaccctgaagtaagatatatgagtcgcgagtccatcctgggatccctcacgtctccctgttttgtatatgaaattggaatggatgaaagagcttcaatataaatgcctatttgatctaacagagatgcacattcatagtcatttactcacttataaactgattcagttcccctggtatttggaggtgagaaggggcagggtatctggaagggagagggggagactgtggcatcaccaggtcgcccttgcctaccctcacccctgctgtctgtttcactccagcacctcctcacagcagtcttacactagtcactggcctagcaggttacaaagctggtctgtggcaggcacaggtttgtacctggcctcaaagcaaatctctttctcttccttcctccggtcttaatgggaagacatgagacacctgagaggaaagggggaaaaaaccccaaatgccagagtacaaaacaaaataaagcaagaggagcaggagagcgaaacaaattcttttgtactcgggccatttaatcgacaactgtggttactctgagagcactgcctgtgggtcagccctgctccgcaaggagcagtatttaaaaacaaaaacaaaaacaaaacctatacactggtaagcaggttttttggttattcaacctggaaaagcacaccacttaaactgcacagtataagccgtgcctacctacgtttgcaccgtttcgacctcccctgcgcccgcccca

SEQ ID NO: 97394 - DNA, 571 bp, Homo sapiens
ccctgctcccagcccctggcacctgccattctactttctgtctctatgaatgtgatgactctagggacctcatataagtggattcgtatggtatttgtccttttgtgactggctcatttcactcagcatgacatccccagggtccatccgtgtggcagcagttatcgacatttggatgtgtataaaacattttgtttactgagcttgactgttatgcagacagaatcattcagtatgcagctgggcacagtggctcacacgtgtaatcccagcgctttgggaggccaagatgggcagatcacctgaggccaggagttcgaaaccagcctggccaacatggcgaaaccccatctttcctaaatacaaaaaattagctgggtgtgagccacccagctaatttttaaaatttttgtacaaaatgagatttcactatgttacccaggctgctctcacctggccctcaagtgatcttcccacctcccaaagtgctgagattacaaggcgtgagccactgcacctggcctctcctgcatccccacatcgggaccctggtgattacattggggccatc

SEQ ID NO: 97395 - DNA, 421 bp, Homo sapiens
gtcacattattctctatttttattactctctgttttatatcgtatccgtcataatatgactacatgaaatgaaatagtagctacagtcaggtatgtgctaaacacgatacttatgtcctttatttaatattcacaacagtcctatcagatagctattaatagttccattttacagaaaagtaaagagaggcttaaagacattaacttgcccaattcaacactggtaagtggcagatctagaaatgtttgactattaaacaatgacttaattatatattttattattctattccaaaagctcctattacagtgccagtcataagaaggcagtcaataaatactgcctgatgattaacatgacactagaaaagaacccatatctcccacacagactataagaccctcacctttctacacacac

SEQ ID NO: 97396 - DNA, 445 bp, Homo sapiens
ctgcagtgcctccccaagttttgaatgacaaagcataataaagtgcatgttcttgtcatcgctgcaaatgagtaaacttttcatcaactgtcttactggaaaagctgattttactcagtatcattataagtaaaaccacttttcaattgattttctttttttgattaaatggtatggcctgatttggaagctattcctataccattgtggggacaatttctttgaatcagttcaaatttctgcaattatatattatgattaattttacatttacattgttttagggtttttcttccctgaggatcctgggcttaaactgtttttgtctatgaaatgaaagaatgatactgatttttttttttaatttctgagccactaagttcatgaaacaactacaatagcaattgaaatgctttgtgttgatgactgatgtagagaaataatg

SEQ ID NO: 97397 - DNA, 2405 bp, Homo sapiens
cgcagcgcccagcagcacccggagtcgcttggacgccggttcggggctattgcggggtggcgtcgctgggcccgggaaagttcgggactggagagtggcgacgccgggcggcgggacccatggaggcgcgcggggagctgggcccggcccgggagtcggcgggaggcgacctgctgctagcactgctggcgcggagggcagacctgcgccgagagatcccgctgtgcgctggctgtgaccagcacatcctggaccgcttcatcctcaaggctctggaccgccactggcacagcaagtgtctcaagtgcagcgactgccacacgccactggccgagcgctgcttcagccgaggggagagcgtttactgcaaggacgactttttcaagcgcttcgggaccaagtgcgccgcgtgccagctgggcatcccgcccacgcaggtggtgcgccgcgcccaggacttcgtgtaccacctgcactgctttgcctgcgtcgtgtgcaagcggcagctggccacgggcgacgagttctacctcatggaggacagccggctcgtgtgcaaggcggactacgaaaccgccaagcagcgagaggccgaggccacggccaagcggccgcgcacgaccatcaccgccaagcagctggagacgctgaagagcgcttacaacacctcgcccaagccggcgcgccacgtgcgcgagcagctctcgtccgagacgggcctggacatgcgcgtggtgcaggtttggttccagaaccgccgggccaaggagaagaggctgaagaaggacgccggccggcagcgctgggggcagtatttccgcaacatgaagcgctcccgcggcggctccaagtcggacaaggacagcgttcaggaggggcaggacagcgacgctgaggtctccttccccgatgagccttccttggcggaaatgggcccggccaatggcctctacgggagcttgggggaacccacccaggccttgggccggccctcgggagccctgggcaacttctccctggagcatggaggcctggcaggcccagagcagtaccgagagctgcgtcccggcagcccctacggtgtccccccatcccccgccgccccgcagagcctccctggcccccagcccctcctctccagcctggtgtacccagacaccagcttgggccttgtgccctcgggagcccccggcgggcccccacccatgagggtgctggcagggaacggacccagttctgacctatccacggggagcagcgggggttaccccgacttccctgccagccccgcctcctggctggatgaggtagaccacgctcagttctgacccaggcccggctccaccctgcacctcacacgagggagctgcccctgggtgggcggctcggggctgctggggtttccgaggaagtggggccagggcgtcaagggagggctggtgccttcggagcctcccactgccgaccgcacagctccctctctgggggctgagggacccacctggcccctcctctgacacagggctggcccgccaggtggcctcccagcaagccagccttttttgtaagcaaatttctcccctttattgaccaattaactgagcacttgctgctatttctagacatgaaatgtcaccttgctgaggcccagcccagcccagcatagcccgagggctggaaaaacgctttcatctctaaaactgagaaatcatcataattgtgctttcacttcccaggctccatgtgtcttggagccgtcaccccgaggctccctctttaggtcggagattggccttgcctgtcgaggcaagaggctgcagaggcggggacacacctgtgtcttccgggagaggccccctcttctccccagacccacagggggcctctgtgcctccagccccacttccccgggagaagctttccccaatccccaggtctctagatcattctgttctcgagtatcctgtggaggaggcaaaaatgcctggcgccccttctctccaagctcaattctctaagcccctcagggtctcctcctcaccccaccccaggcccttggtgtccaggctgcacccacagatgtctgttgccaaacagcctgccctccctgccggagccggctctgccagccccagattgggaagtctccccgctggagaagggtggggctcctctgagcctgccctgcctcctccatcagatcctttgggaagaagtttctgggagatgcccgcagctgtgcgtgccccagacacaaaggctggcctgtgtgtaagtcaaagtcactcccgcaaacctgaatctcgagctacctattggttctgtgaatgttctgtgtcttttatttattctcgggtgatcagctctttccaagacttcaataaatttgtcagttacctcgtgcc

SEQ ID NO: 97398 - DNA, 2183 bp, Homo sapiens
  misc_feature (4)..(4): n is a, c, g, or t
  misc_feature (6)..(7): n is a, c, g, or t
  misc_feature (65)..(65): n is a, c, g, or t
ggcncnngccccgcacgacgcggcgggacttgggagccccgaaccctccaggggacgctgacctnggaggagcgcgtctcgcgccactcggcctggtggccgcgatgctgctggaaacggggctcgagcgcgaccgagcgaggcccggggccgccgccgtctgcaccttgggcgggactcgggagatcccgctgtgcgctggctgtgaccagcacatcctggaccgcttcatcctcaaggctctggaccgccactggcacagcaagtgtctcaagtgcagcgactgccacacgccactggccgagcgctgcttcagccgaggggagagcgtttactgcaaggacgactttttcaagcgcttcgggaccaagtgcgccgcgtgccagctgggcatcccgcccacgcaggtggtgcgccgcgcccaggacttcgtgtaccacctgcactgctttgcctgcgtcgtgtgcaagcggcagctggccacgggcgacgagttctacctcatggaggacagccggctcgtgtgcaaggcggactacgaaaccgccaagcagcgagaggccgaggccacggccaagcggccgcgcacgaccatcaccgccaagcagctggagacgctgaagagcgcttacaacacctcgcccaagccggcgcgccacgtgcgcgagcagctctcgtccgagacgggcctggacatgcgcgtggtgcaggtttggttccagaaccgccgggccaaggagaagaggctgaagaaggacgccggccggcagcgctgggggcagtatttccgcaacatgaagcgctcccgcggcggctccaagtcggacaaggacagcgttcaggaggggcaggacagcgacgctgaggtctccttccccgatgagccttccttggcggaaatgggcccggccaatggcctctacgggagcttgggggaacccacccaggccttgggccggccctcgggagccctgggcaacttctccctggagcatggaggcctggcaggcccagagcagtaccgagagctgcgtcccggcagcccctacggtgtccccccatcccccgccgccccgcagagcctccctggcccccagcccctcctctccagcctggtgtacccagacaccagcttgggccttgtgccctcgggagcccccggcgggcccccacccatgagggtgctggcagggaacggacccagttctgacctatccacggggagcagcgggggttaccccgacttccctgccagccccgcctcctggctggatgaggtagaccacgctcagttctgacccaggcccggctccaccctgcacctcacacgagggagctgcccctgggtgggcggctcggggctgctggggtttccgaggaagtggggccagggcgtcaagggagggctggtgccttcggagcctcccactgccgaccgcacagctccctctctgggggctgagggacccacctggcccctcctctgacacagggctggcccgccaggtggcctcccagcaagccagccttttttgtaagcaaatttctcccctttattgaccaattaactgagcacttgctgctatttctagacatgaaatgtcaccttgctgaggcccagcccagcccagcatagcccgagggctggaaaaacgctttcatctctaaaactgagaaatcatcataattgtgctttcacttcccaggctccatgtgtcttggagccgtcaccccgaggctccctctttaggtcggagattggccttgcctgtcgaggcaagaggctgcagaggcggggacacacctgtgtcctcctcaccccaccccaggcccttggtgtccaggctgcacccacagatgtctgttgccaaacagcctgccctccctgccggagccggctctgccagccccagattgggaagtctccccgctggagaagggtggggctcctctgagcctgccctgcctcctccatcagatcctttgggaagaagtttctgggagatgcccgcagctgtgcgtgccccagacacaaaggctggcctgtgtgtaagtcaaagtcactcccgcaaacctgaatctcgagctacctattggttctgtgaatgttctgtgtcttttatttattctcgggtgatcagctctttccaagacttcaataaatttgtcagttacctcgtgcc

SEQ ID NO: 97399 - DNA, 190 bp, Homo sapiens
gagttgtaagggttgttaatagattcgggatacaagtccctcatcagtcatgtgatttacaactatttaccgcctttctgtaggtttttctgtttcttcactttcttcatggtgtcctttggtggaccaaagtgtttcattttaatgaagtccaattgatctgttttttcttttgtcgcttatgttttta

SEQ ID NO: 97400 - DNA, 900 bp, Homo sapiens
agcaagggctggtggaccttccccacattccagttcaggccagaatgggcctcgctccccacagccagtgctgctctgtttgagcagagaagccagctccagcccgctgaaaacagactggacccaaaggaagaggagacaaaccctactgtcggcctgccccaggccttttcccagatgggtgagcacctgccctgaaggcacaggaggaagtgagcgtggggctcagggaccaggcctgccctcccagttagtgccaaggacacagaaacagaggggagtgcccatcaacctctgcccaacacagagccccttaatgacttttagattaaaaagccaagacacggccatatccttaagatgcctaatgaagcaattggcccatcagccagtccaggcacccgcatgaagccccaaatgtagaaactcagccagtcttgccagacctgcttaatgcaaaattggtaatgtcatttacaagcctctcacacgcaggcctatgaataaaagaataatgctgaaaagcaaggctctccaatttctatacattgcaaacagctctgagcagttccttcttgtgcacttggcacagaccttccaccctgccagggctcgccttgaagatagagtgccccaatcctggaggcacagtggctggaattgctgcaaagtaccaggaggcaggaagatttacctccctggccctggagctccttccagccacacaactccagggaggctcagaggccagccctcggaccccaaggccagaagacatgtaaacagtgacataaatgcaccccaaccgcctctgtcaagcatcttgtaatgcttctccactcctgctgcaaaggctgctggaattttctgcctctactgcccccattaaatcagctgccc

SEQ ID NO: 97401 - DNA, 164 bp, Homo sapiens
cagacatctaagaatgggttccagccctacccctaccagctttgccactgaaggcaaaccatcaacctctggaacttagcgtctttacctataaaatggagaggctgaaataccacatccatggaattcaaactgtgcttcagagttcttagattcccttccta

SEQ ID NO: 97402 - DNA, 668 bp, Homo sapiens
cctacccagtttcagggacctgtgctaacttccggcctcagcgttcttcttattcactcagaccctggcgagcaccttcctccttattcttttacagaagtaccaaagccaagcaaacataatttcttttgttttttttttctctttttgagatggagtttcactgttgttccccaggctggagtgcaatggtgcaatctcaattcactgcaacctttgccccccggtttcaagcggttcttctgcctcagcctcccaagtagctgggactacaggcgcccgccaccacgcccggccaattttttgtatttttagtagagacagggtttcaccatgttggccaggctggtcttgaactcctgacctcaggtgctctacatgcctcggcctcccaaagtgccgggattacaggcgtgggccactgcgcccagccaaaacataatttctgaacacagggaacttggaacagggactcccctcttgcctcgtggttgatggaggcttatcttctgggtaggggcacagagatccttgtgtacttcgccaatgagccctatagtctgctcatctcagccatttcccacaagaaaggaaaatggatattgtcagagggtttcagaccccgtaaatgggatgtttccaagaggcttccctatcagtgattaatc

SEQ ID NO: 97403 - DNA, 395 bp, Homo sapiens
gtgggttgatcgtggcttgtgggttgaccgtggcttgtgggttgaccgtggcttgtgggttgaccgtggcttggctttgccctagcacgcggctacgctaggaggggttgtggcccaatttgcaactctggccccgggatttctgcactccatcagaaccacctgggaggctagtttaaactggattctagagacacattccacaagagaaacgggtgctggtgagaaaggaattacttagtaaactttaaataaagatcctgccacccactgtgtacacgcagtcctccttgggtcctccactctgtcccccaccccatgcaaacagcacaggcgtgcacaagcacgcacgcatgcacacacaccagtctctgaatagctgttctaggttgggg

SEQ ID NO: 97404 - DNA, 816 bp, Homo sapiens
ctttgggtagtctcatttttttcatactggtttcttttgtacccctaggtagattatcattatagaacacataaatagacacagattttgtgacatggggattttgaagtattgtcttttagtagatcctgccattttttaaaacatgtgaaatttattttgaaactctcacttggcttccaaaggactgcctagaaatctttttagaagactaacttggaataaaatagaaattacagtttgataggaatcctagaatcctaatttgtcccttgccttagagctagtgtactccagttaggctctgtgtgttcgtgtgtgtctgtgcaggtgcatgcacatgcgtgtatgtgactcagtaaaatgctgttacatactgcatatgctggatgagaactcttgaaaagccaagactaaaaaacaacaataacaacaacactcccagctcactgtatgctgatctgctgaagacacctccttactctattgtcatttcatattcaaggatttccctcaatgctgagcttcctgtagagcatttctttttgatcttccactcttccattatttgaactgcaccatgcccgtgcacacataacatatttattgacaacaaattttatctttgcattgaagccaaggcctttatttccctggtcttccaggttcaggcctgggaacctggaaggttccccaggtttccccaggaatgtaagccaactggtgtgccgagctttttctgtttcccgaggggcccaccatatggtgtgctccacctctagtggtcgctcacgtggttatccaacttatggggga

SEQ ID NO: 97405 - DNA, 208 bp, Homo sapiens
aatgatactaaatggaaaaatattcagaagacattagtagtaaatattaaatatgccaattcatttattcatatgttgtttacatagtagaccaataaaggataattttatttgtcagatagaagacagggtggtatagctgataccaccagaggaaagagagaaagtcctggtagtgagttttaaggtgggggtggtatcaggggta

SEQ ID NO: 97406 - DNA, 516 bp, Homo sapiens
gctatgatgtcactaggcaatgggaatttttcagctccattataatcttacgagaccactgtcatatatgcagcccattgttgacccaaacatcgttatgcagcgcatgagtaatcttatgaagttagcacaattttgacacagcaacttgataaagacattaccagaaaagaatgtaactgacctgtagacctcataaacacaggcaacaaatgcttagtgtaatattaacaaatctaatccagcaatatataaaaaaggataatacatcataaccaagtggagtttatcccaagaacacaaggttggcctaacattttaaaatcagtgtaattcaccacattaataaaaacaccatctgagcatccaatcaattcaaaaaagcatctgtccaaaatcaatacccactcatgataaaacctcttagcagacttggaacaaaaaacaacttcctcaatctggttaacggcatctattaaaaatctacatttatcatcacatttagtagtgaaatac

SEQ ID NO: 97407 - DNA, 550 bp, Homo sapiens
ctcagtccaatctcagatgtggccaagaagtttctaagcagagaaaaacgttcaagagagcgaaacccagaactgccataaatattcatcaaggaaaatctcttgagtagcagagcagatacttttcacatgtatgtattaatttactttagaaaagaggatgtttgtttcttattcttccattttccaaatgagagtattatggtagtgaccatattcctattctctattatattttatatcggagaggatttgatttagcccatgagtcaaaaaccactgcgcccagccagtcctacctatcaatttttacataaatgatactggccagaaagaataaagctgacaggataaaaagtaagggtacaattaaaggatacaaacaaatgtaatgtaataaatgaatagagaagtttccacatataggctgttatgatgctctgcttagtctttacttgactgtgttccatatgcatcatatagaaagttctcttcttgttactcatttttctctttgtgctttactaaatataatttctattgtattctc

SEQ ID NO: 97408 - DNA, 369 bp, Homo sapiens
agacagaggattttgccatgttggccaggctggtctccaactcctgactgcaagtgatccacccatctcaggttcccaaagtgctggattacaatccagccaccgcgcctggccatttttaagaaatacatacatttagaaatgcctcaaaagaaattatatgatgtctggattttcttcaaatcaatctgatgggaagagggaacggatggtggtatagatgaaatgagattggtcttgagttgctaattgttgaaactgggtgatggatacatggcagttcattgtacgatttccactttgtaaatgttgaatttttgataataaaaagctaagacaaaattaaattaataaaaattaaataaagga

SEQ ID NO: 97409 - DNA, 327 bp, Homo sapiens
gggtatgccaagttccaattcagccctcaggtttgggcacgagaagagggacattgttcaccactcggccacaaatgacaatttgactcacaacagccactgaaaccctgagtatcaatcatataacataattaagtgtgtgtgtggcggggggtaggatggtaaacaaggtacctttcttgcctccaagggactgacgacctgtatgatgcactctggcaatggtgcctgcacacaacagttgtgtggtcattgttggtgcaggtaggcgagaggagctgagaccgggacacccatcacagcaaaagacaaagcatagtaaagtga

SEQ ID NO: 97410 - DNA, 582 bp, Homo sapiens
aggttacactaatgtttatgttttgaaaatattacctcttccatttagtactatatgtattaaataaaagtagacagtttttttttttttggctttataatgtggttcagatttttttagaaagtctggctgtgtctacattgccttaaagcaataggatatttctctttatttatttatttgtttgttttttttgagctagagtttcgctcctgttacccatggtggagtgcggtggtgtgatctcggctcactgcaacatctgcctcccagattcaagcaattctcctagctcagcctcctgagtagctgtgattacaggcacccaccaccataccctcctaatttttgtatttttagtagagttggggtttcaccatgttggccaggtgggtcttgaactcctgacctcaggtgatcctcccgcttcagcctcccaaaatgctgggattacaggcatgaaccaccttgtcccgccaggaatgttttttaagaaggctatctacttacagaattcctggccttgagaggatattacttggaaaggaaaggatttgttttgtgattaaaaagtaagactct

SEQ ID NO: 97411 - DNA, 451 bp, Homo sapiens
ttcccggtaggctattctatgccatcctaaaagaacaagaaaatgtggccagtaggatagatgctgtcaaccccattttaaagatggagaaactgaggctatatgagtgaactgactttctcaggaccaacatttgacactgaggctgctgattctctggtctttttgtgctaccataatacgtgctcagcttatttttaacaaacctagagcatggcaatgtgaagggactggcagggaatggaaaagaagagcgtgtactgaagaaaaaaacaccagggaagggaaggaacagcctcactggagagggtcactgacagctgacagtgggtgcccctatggccctggggagctatgaactccttgcccagggctggcttgggagggtctacttgactctgggtccctgacttatctagttgcatctaggcctgggagcaaatgcaaactg

SEQ ID NO: 97412 - DNA, 1183 bp, Homo sapiens
cagcagagcaggtaacagctcttgcacctgtttctcttgcacctgacgtgcagctgctcctacccacctctcctggctgagccttgcctgatacagcagcccggaggcaccacttgcttcccgagtctcaccctcccaggcagctcctacactcaactgcttctctaggaaaggtctcacctccagcctggagcagtcgggattacagaaagccccatccttggcttagggagcgccatgacgactgaaattggttggtggaagctgactttcctccggaaaaagaaatccactcccaaacacaaaaaaatctgttgggcgcgcgcgcctggggccccaggagaggtttctaacaccccaatgccggtggggcgagcgggggcccacggtagcgcacggtagaacatggggcacaaacggggtccaaaaggaacaccggggggccgagcacacaagggcgggggagttctctcccccaatataaaaaaagcccgccgggggggacccaccggggcggttcgggacaccacctcccagagggggagccacgagggagggcaaaaacgggggggcacaacacaccaggggggtgcccaggggagcacagaaataaaaaaaattacgccggggcgcgcgcgtggggggtgcgaccacaccagaaaagcacagatgaaagaagcgcgaacaagccgagcaacagagagcggagcagcaagcagacagcaaacagaatgagtgacaaacgaccgagacacaccacgaacacacacagacaaagcaacgaaaagcaatacactagccacagacgatgcgtcagacgacgcagccaaagagcagggccagaaagggacaacagcaacacaaagaagggggacgagcaggagaggaagagacagcaaacaccggagaaagacaaggagcacgcaagcaaggagccaagaacagaaacgaggaacgagaacagagacgacgcaagcaagccgaagagaaaagagagcagaaacgcaggacgagcaggccaagatgcaggacaacacagagccaagagcgaggcagaaggagacagggaagggaagcaggaacgaggacaggcagagagacgagacacaggcaacgacgagagagaggagagcacggcaagatgcgaaaaagaaaagaaggcgaaagacggcgaggagaagaa

SEQ ID NO: 97413 - DNA, 1505 bp, Homo sapiens
cagcagagcaggtaacagctcttgcacctgtttctcttgcacctgacgtgcagctgctcctacccacctctcctggctgagccttgcctgatacagcagcccggaggcaccacttgcttcccgagtctcaccctcccaggcagctcctacactcaactgcttctctaggaaaggtctcacctccagcctggagcagtcgggattacagaaagccccatccttggcttagggagcgccatgacgactgaaattggttggtggaagctgactttcctccggaaaaagaaatccactcccaaagtgctgtatgagatccctgacacctatgcccaaacagagggagatgcagaacccccgaggcctgacgctggaggccccaacagcgactttaacacccgcctggagaagattgtggacaagagcacaaagggcaagcacgtcaaggtctccaactcaggacgcttcaaggagaagaagaaagtgagagccacgctggcagagaaccctaacctctttgatgatcacgaggaaggacggtcatcaaagtgaagggctgaggagggtgctagcacctcttggctccctgccatcagccagatctgagacaggaccttgccacgctggcctctttggccatagctgaagctgtggggccagttgatacctgctggcaggaaatggctgttttttaggtttgtatttatgtgccgccacttttgtaaggcctgggagatcccagggtcctccaccctccccctgaccacatacaaaggcactctagttcaagagtgaaaaatctcacccaggaggaacagccctccttgaagcaatggcagggccagcagggaggtgggcatggcagggaatggagagagtgagccagacagacttcacctccttactggacacagggtcaagggcgagtttcaattgctgctccctttactttctctacctgtgactactccctggaccaatcctgaggagggcacattttccagaagccacgtgataggggctggtttctgtggagccagaggcagagacactgaacttgagctcacctcctaacaccggcagtaaacttcctggaactttgccctcaggtgcggaggggacagaggaccctggcactctgttagggtgctgtagaagactagattgatggtagtttggcctgttagttcctgttttggccatgacttttgcagatggcaagtcacacaccctcaaagggaagctacacgggccaaatcgggggagtgggtggggaattttctcctctccctttcctactataatagtatttaagacatatcagctccagagatgagtcctggagccttgaattttgtttaacaaaataattgtaggtttctctctgtaataacaacgctggaaaggcagagaacctcttttatgctcatgtcttgcatttattgagatgactgtttctcatgcctttatgttccttcatgtaagtaaagtggacctttgtgctcaaa

SEQ ID NO: 97414 - DNA, 2320 bp, Homo sapiens
cagcagagcaggtaacagctcttgcacctgtttctcttgcacctgacgtgcagctgctcctacccacctctcctggctgagccttgcctgatacagcagcccggaggcaccacttgcttcccgagtctcaccctcccaggcagctcctacactcaactgcttctctaggaaaggtctcacctccagcctggagcagtcgggattacagaaagccccatccttggcttagggagcgccatgacgactgaaattggttggtggaagctgactttcctccggaaaaagaaatccactcccaaagtgctgtatgagatccctgacacctatgcccaaacagagggagatgcagaacccccgaggcctgacgctggaggccccaacagcgactttaacacccgcctggagaagattgtggacaagagcacaaagggcaagcacgtcaaggtctccaactcaggacgcttcaaggagaagaagaaagtgagagccacgctggcagagaaccctaacctctttgatgatcacgaggaaggacggtcatcaaagtgaagggctgaggagggtgctagcacctcttggctccctgccatcagccagatctgagacaggaccttgccacgctggcctctttggccatagctgaagctgtggggccagttgatacctgctggcaggaaatggctgttttttaggtttgtatttatgtgccgccacttttgtaaggcctgggagatcccagggtcctccaccctccccctgaccacatacaaaggcactctagttcaagagtgaaaaatctcacccaggaggaacagccctccttgaagcaatggcagggccagcagggaggtgggcatggcagggaatggagagagtgagccagacagacttcacctccttactggacacagggtcaagggcgagtttcaattgctgctccctttactttctctacctgtgactactccctggaccaatcctgaggagggcacattttccagaagccacgtgataggggctggtttctgtggagccagaggcagagacactgaacttgagctcacctcctaacaccggcagtaaacttcctggaactttgccctcaggtgcggaggggacagaggaccctggcactctgttagggtgctgtagaagactagattgatggtagtttggcctgttagttcctgttttggccatgacttttgcagatggcaagtcacacaccctcaaagggaagctacacgggccaaatcgggggagtgggtggggaattttctcctctccctttcctactataatagtatttaagacatatcagctccagagatgagtcctggagccttgaattttgtttaacaaaataattgtaggtttctctctgtaataacaacgctggaaaggcagagaacctcttttatgctcatgtcttgcatttattgagatgactgtttctcatgcctttatgttccttcatgtaagtaaagtggacctttgtgctcaaactgttcctttcaagcttcaggaagggttcccaggtgtgacaatgtaggaactgggtcactaatttttaccatcaaactagccttagtatggggatggggcagcagaaggagctagttacacctcagtggtcagttctctccagtcaacagagagcccgtcaggtgctctaagagagtagggcagacctttggtgattgaccccaaagtttcagtggtttggtttgggattaagattcaaactcgggctctaccccttagtagctgggtgaccttgggaacatttgcttgtactctgagcctcagtttcctcttctgtaaaagggggctgaaataatacctatctcatagggagtggtcagtattaagtggcctatgagaggtcccatagtaagtgctcagtttaatactggtttccttcccccttcctttataaggaactccaccataccccacagctttggtttaagaaaaaggagaaggtgggtatggtggctcaggcctgtaatcctagcactttgggggctgaggtgggaggactgcttgagcccaggagtttgagaccagcctaggcaacatagagagaccccatgtctaaaaaaaaaccaaccaacaaacaaaaagtagctgactgtggtggcacatgcctgtagtcctatctacttgggaggctgaggtgggagggttgcttgagtccaggagttcaagacgacagtgagccatgattgtggcactgcactaccacctgggtgacagaactaggtcttatctctaggggaaaaaaaaaattaataaataagagatgcttggcacggtg

SEQ ID NO: 97415 - DNA, 1008 bp, Homo sapiens
cagcagagcaggtaacagctcttgcacctgtttctcttgcacctgacgtgcagctgctcctacccacctctcctggctgagccttgcctgatacagcagcccggaggcaccacttgcttcccgagtctcaccctcccaggcagctcctacactcaactgcttctctaggaaaggtctcacctccagcctggagcagtcgggattacagaaagccccatccttggcttagggagcgccatgacgactgaaattggttggtggaagctgactttcctccggaaaaagaaatccactcccaaagtgctgtatgagatccctgacacctatgcccaaacagagggccagcagggaggtgggcatggcagggaatggagagagtgagccagacagacttcacctccttactggacacagggtcaagggcgagtttcaattgctgctccctttactttctctacctgtgactactccctggaccaatcctgaggagggcacattttccagaagccacgtgataggggctggtttctgtggagccagaggcagagacactgaacttgagctcacctcctaacaccggcagtaaacttcctggaactttgccctcaggtgcggaggggacagaggaccctggcactctgttagggtgctgtagaagactagattgatggtagtttggcctgttagttcctgttttggccatgacttttgcagatggcaagtcacacaccctcaaagggaagctacacgggccaaatcgggggagtgggtggggaattttctcctctccctttcctactataatagtatttaagacatatcagctccagagatgagtcctggagccttgaattttgtttaacaaaataattgtaggtttctctctgtaataacaacgctggaaaggcagagaacctcttttatgctcatgtcttgcatttattgagatgactgtttctcatgcctttatgttccttcatgtaagtaaagtggacctttgtgctcaaa

SEQ ID NO: 97416 - DNA, 1040 bp, Homo sapiens
  misc_feature (673)..(673): n is a, c, g, or t
cagcagagcaggtaacagctcttgcacctgtttctcttgcacctgacgtgcagctgctcctacccacctctcctggctgagccttgcctgatacagcagcccggaggcaccacttgcttcccgagtctcaccctcccaggcagctcctacactcaactgcttctctaggaaaggtctcacctccagcctggagcagtcgggattacagaaagccccatccttggcttagggagcgccatgacgactgaaattggttggtggaagctgactttcctccggaaaaagaaatccactcccaaaggtgctgtagaagactagattgatggtagtttggcctgttagttcctgttttggccatgacttttgcagatggcaagtcacacaccctcaaagggaagctacacgggccaaatcgggggagtgggtggggaattttctcctctccctttcctactataatagtatttaagacatatcagctccagagatgagtcctggagccttgaattttgtttaacaaaataattgtaggtttctctctgtaataacaacgctggaaaggcagagaacctcttttatgctcatgtcttgcatttattgagatgactgtttctcatgcctttatgttccttcatgtaagtaaagtggacctttgtgctcaaaaaaaaaaaanaaaacaaaaaacaaacagccaactcgtcaagcaacacgaaccaatccaaacagaacacagtcatgtagctagaacaacacaacagacaaaacaagaattgtggtgcggggcggccgcacagaagacattaaacaaacactctgggggggcgccaccaaaagaatagtagagtactctgattcacacgaacacgcgctgcaaggtgtccgtgttcacccaaaacaagccggaggagggcttcaacacaccgtgcgttgtttttgtctgcacgccgcgatccttcgccctctgtcgtcgggatccacgcatcaacacacagcacaccgaccaggcactaactgaaacgacgacgcagttgcactccact

SEQ ID NO: 97417 - DNA, 1420 bp, Homo sapiens
aactagctagtacagccggtgtgaatcggccgaggccgagtctcaccctcccaggcagctcctacactcaactgcttctctaggaaaggtctcacctccagcctggagcagtcgggattacagaaagccccatccttggcttagggagcgccatgacgactgaaattggttggtggaagctgactttcctccggaaaaagaaatccactcccaaagtgctgtatgagatccctgacacctatgcccaaacagagggagatgcagaacccccgaggcctgacgctggaggccccaacagcgactttaacacccgcctggagaagattgtggacaagagcacaaagggcaagcacgtcaaggtctccaactcaggacgcttcaaggagaagaagaaagtgagagccacgctggcagagaaccctaacctctttgatgatcacgaggaaggacggtcatcaaagtgaagggctgaggagggtgctagcacctcttggctccctgccatcagccagatctgagacaggaccttgccacgctggcctctttggccatagctgaagctgtggggccagttgatacctgctggcaggaaatggctgttttttaggtttgtatttatgtgccgccacttttgtaaggcctgggagatcccagggtcctccaccctccccctgaccacatacaaaggcactctagttcaagagtgaaaaatctcacccaggaggaacagccctccttgaagcaatggcagggccagcagggaggtgggcatggcagggaatggagagagtgagccagacagacttcacctccttactggacacagggtcaagggcgagtttcaattgctgctccctttactttctctacctgtgactactccctggaccaatcctgaggagggcacattttccagaagccacgtgataggggctggtttctgtggagccagaggcagagacactgaacttgagctcacctcctaacaccggcagtaaacttcctggaactttgccctcaggtgcggaggggacagaggaccctggcactctgttagggtgctgtagaagactagattgatggtagtttggcctgttagttcctgttttggccatgacttttgcagatggcaagtcacacaccctcaaagggaagctacacgggccaaatcgggggagtgggtggggaattttctcctctccctttcctactataatagtatttaagacatatcagctccagagatgagtcctggagccttgaattttgtttaacaaaataattgtaggtttctctctgtaataacaacgctggaaaggcagagaacctcttttatgctcatgtcttgcatttattgagatgactgtttctcatgcctttatgttccttcatgtaagtaaagtggacctttgtgctcaaa

SEQ ID NO: 97418 - DNA, 1882 bp, Homo sapiens
  misc_feature (1515)..(1515): n is a, c, g, or t
cagcagagcaggtaacagctcttgcacctgtttctcttgcacctgacgtgcagctgctcctacccacctctcctggctgagccttgcctgatacagcagcccggaggcaccacttgcttcccgagtctcaccctcccaggcagctcctacactcaactgcttctctaggaaaggtctcacctccagcctggagcagtcgggattacagaaagccccatccttggcttagggagcgccatgacgactgaaattggttggtggaagctgactttcctccggaaaaagaaatccactcccaaagtgctgtatgagatccctgacacctatgcccaaacagagggagatgcagaacccccgaggcctgacgctggaggccccaacagcgactttaacacccgcctggagaagattgtggacaagagcacaaagggcaagcacgtcaaggtctccaactcaggacgcttcaaggagaagaagaaagtgagagccacgctggcagagaaccctaacctctttgatgatcacgaggaaggacggtcatcaaagtgaagggctgaggagggtgctagcacctcttggctccctgccatcagccagatctgagacaggaccttgccacgctggcctctttggccatagctgaagctgtggggccagttgatacctgctggcaggaaatggctgttttttaggtttgtatttatgtgccgccacttttgtaaggcctgggagatcccagggtcctccaccctccccctgaccacatacaaaggcactctagttcaagagtgaaaaatctcacccaggaggaacagccctccttgaagcaatggcagggccagcagggaggtgggcatggcagggaatggagagagtgagccagacagacttcacctccttactggacacagggtcaagggcgagtttcaattgctgctccctttactttctctacctgtgactactccctggaccaatcctgaggagggcacattttccagaagccacgtgataggggctggtttctgtggagccagaggcagagacactgaacttgagctcacctcctaacaccggcagtaaacttcctggaactttgccctcaggtgcggaggggacagaggaccctggcactctgttagggtgctgtagaagactagattgatggtagtttggcctgttagttcctgttttggccatgacttttgcagatggcaagtcacacaccctcaaagggaagctacacgggccaaatcgggggagtgggtggggaattttctcctctccctttcctactataatagtatttaagacatatcagctccagagatgagtcctggagccttgaattttgtttaacaaaataattgtaggtttctctctgtaataacaacgctggaaaggcagagaacctcttttatgctcatgtcttgcatttattgagatgactgtttctcatgcctttatgttccttcatgtaagtaaagtggacctttgtgctcaaaaaaaaaaaanaaaacaaaaaacaaacagccaactcgtcaagcaacacgaaccaatccaaacagaacacagtcatgtagctagaacaacacaacagacaaaacaagaattgtggtgcggggcggccgcacagaagacattaaacaaacactctgggggggcgccaccaaaagaatagtagagtactctgattcacacgaacacgcgctgcaaggtgtccgtgttcacccaaaacaagccggaggagggcttcaacacaccgtgcgttgtttttgtctgcacgccgcgatccttcgccctctgtcgtcgggatccacgcatcaacacacagcacaccgaccaggcactaactgaaacgacgacgcagttgcactccact

SEQ ID NO: 97419 - DNA, 582 bp, Homo sapiens
aaacttggaataattatattctaaccattttgttttacaaagaaaccaaggttaacatagatggggactgttaccagtttttgctgctaattagttagaagtggaaggagaagtcaagcctcctgattcctagccagattttctttttctcacttctccttgctgaatcattggccaaaaatgtacaactaacttctccttttgggaagtgcatatttcatattaactctggcaatttatgaaaaaatgtagattcatttgctccattaacaaaatatcagtgcctaagaagaaataaggttgatttttgaaagaaatcaagtgcctactcagaatgtgcaggggatggcacctttcatttagcagcgttaagcttaatgtgttgttttacttatgatgtaatttctccccgatatatgaacaatgtaagttcacatcactacatatgtaaaatcactatctaactaaatgcctgtccttgaggtgaaatctttaataaactttcacccatcttgagttatttttcctctgattatacctgggaattaaggtatttaaaagttctaataaatttccatcttt

SEQ ID NO: 97420 - DNA, 151 bp, Homo sapiens
atgggttcatgcgttatgcatgagagatgctctggcacaaagggctgggccacagcctggggataggcaggagcaggcaggcatgtgtgcacatacacacacatacacatgcagacacatatgcatgtacagttcattatacacacacaca

SEQ ID NO: 97421 - DNA, 817 bp, Homo sapiens
ccagttgcacatatttggaagactcattatttcagcaattttgtgaagctgtacggatggtctccagtacaacattgaaaagaagtggtgagagagctaacatccttgccttgttcctgagtttataaagagtttctagatgcaaacacacacacacacaaaagtgtgcttccagaagatgctgctgggaaggccactgcatccctagggagccaaatcaaagcattttgtcctaatgtgtccggaattggtgggttcttggtctcactgacttcaagaatgaagccgtggaccctcgcggaaagatagaatagaagctacaagatctgcagttatgcttcctcttacccaatttacagataatatatgtttgtggctgtgatacacagaaaaatggcatccaaggaaagtccacctcctaatcctcagaagctgtgaatatgttactttatatggcaaaatggactctgcagatgagattaagtttctgcctgcctgacaatcactctgctgatggcaaccaaatattgtcttcttcctggagtctcagggaaaatgtggcctggggcagaccctagttcttcagatggaaggtgaaacttcaatacatcaccgcaacaggaaacaatctcaagaatttgtatttacacatcctggacaaagaaagtgtaaataagtctggaatgcagtcatcagttcccaggtcctggaaggcaggagtctggagtcaggcagaaagagaaagcaggcacagtgacaaccagcagtacacttaaggattagagtgcagatttttctaagctcccaggccaatgcc

SEQ ID NO: 97422 - DNA, 138 bp, Homo sapiens
ccaaccaggaggaaaaagctgtttgttggtggggggtggggagggagatgaggacttatgtccctgttgtttttgaacttgccatttgacattggtcaaacttttctgggtcccctttcttctctctcagctgaaatg

SEQ ID NO: 97423 - DNA, 295 bp, Homo sapiens
tagaggcgggatcttgctgtgttgcccgggctggtctcgaactcttggcctcaagcgatcctccctcctcggcctctccaagtgcggggattacgggcggagccaccgcgcacggccgtggtcagctttgaaagctgcgtagatccctttggctcatacgcctttctgctagcttaccctgattctgcttctggttcagatagtattttaatatttctagtgtgtctttttgtaagatatctgaaatctttttgtggaatgaagtggcatgaaaaataaaccaataatcgttagt

SEQ ID NO: 97424 - DNA, 126 bp, Homo sapiens
tccagtgattcaagtaattctcctgcctcagcctcccgattagctgggattacaggcatgagccaccaggcccggccctcacccccattttgtacactctctgccattcatttaccctgacaactt

SEQ ID NO: 97425 - DNA, 329 bp, Homo sapiens
gcgtcgaccacatttggcattttctctcaaatgtggcagatgctgaagctgaagaggaagaagttatgaacaacatatgaggtccctgaatgccaaggctggttctcactctgaatggcttctggggaaggggtgagtgaagggactgagggacttcctactcttgctgcgggcctctgggttcttagcttcagggaaccccacgctgcccacagatatttgagctgatgtgggggatctccccagagatttggcagaaacagagctacagcaggcaggtagctggggatctttgtgttgaggacagctccagggagactggccataag

SEQ ID NO: 97426 - DNA, 490 bp, Homo sapiens
tagagcatccgatagcatcctaaccaggccagaacagggatgtgatcagccatgtgtgattgggctgagaggtgaagatgaggccagaatttgcccactgccttggccgagatttgaagaccatcagcaatattgagtttctgtgggttgtattcctgtttcttcaaggggtgtatgtcagtgactgtttgcacaggtagcttatttatgtgcagcattgctgggagtgcatgagcatgtttaatgcctgccatccacgggaatatcggtgtgtgctacagtgtgcttgtatgactacgtgtgttgtgtgcctcagtgcctcagttcatgtggcacagacctgtgtctgtgagagtccacatgtgtgctcctctatgtgcagtctaaaattttggatctgtttctgtcaagctgtttccatgcacctctgtgctacgcagctctctgtatctctgcctgcaggcaaaagtatgtttgtgtctgggttggt

SEQ ID NO: 97427 - DNA, 387 bp, Homo sapiens
atgccacagcattccagcctgggtgacagagcaagaccctgtctcaaaaaaaataataataaaattaaagaacacatgatgctgactatgtacttggtgagggaaattgcatggagtggaggatgggagtcaggcagtgggacaaacgcaaggggctacagtgacctgagcaggatttttggaggggcctggagtttgaaccgggtctggaagggtgagaaaggtccaactatgcaaacaacagttgaccatgtagagcagggaagctgcttagacacatggatgtgaaaataagaatgaccagttatggagaaaaccaggaggcctgcctgtccaagtcagaagccctgtgtttgggtatagtggggcatgagatcagatagtgaa

SEQ ID NO: 97428 - DNA, 709 bp, Homo sapiens
ggctgtgtggggcgggctcccggccaggcgcggtcgggacgcccgccggtccccaggttcggggcagcgcgcagcgcgggtccgcggcggcttatcctttttcgcgacccggcctggcagcgccgcgctccgcttggagggcactcggcggcagagttccgcgctgggaggggtgaggggaccagccgcctcctctgcggactcagatcgagcaggagagagtgggcgcggagctggggccagcgcagggccgtgggctcctctctgggcacgcatcctttacgccacgggctttcaggggctgaggggcctcgaaccttgccaatcaccagtgctgtgcgccccgcttgctttggggtgcgttaaacgtcaggagagagctgctcagatggggtcaccagacgccttctcccccttttctcggagcccgcgggttgcgcgataagccaacccagccggacgctgcgctcctataaatagagcgcgtgtgcccgcttcgcgctctccgggctgcacgagggacgagaaagttgtgcgcagggactgggggcgggcggccaggcaggagaggaccccgccggaccagccgccctgaacgctgcgcccggcgccctggacctgatcctgcgaatccgcgctttcggtgcgagggacctggctagccgctgcctccctccctacctctgggtgacaccaggtttgggggatt

SEQ ID NO: 97429 - DNA, 388 bp, Homo sapiens
gatccagagagggctccaggtggagtccctttttctgcataaggggctgtgaccgaaggcacagaggggaaaaaaaaaggtggtgggagcctcctctggtttcacctgaagagggaggcggaagggcctgaaaattagattttgtttataaataatagatattataggtatatttacatatttttacataatgatgccaaccacaaacaatggaccataaagcactgacctcagaatgatcaattgcaaaatgtttaaaccctggaagcttttgcttaggagggcggatattctgtgttgatgttattctatagccataaacttccctgaattttctgctaatgtatccaagtccaggcaagtcacttaaactcttcaaatgcagctt

SEQ ID NO: 97430 - DNA, 648 bp, Homo sapiens
cctgggcaacagagagactgtctcaaaaaaaaaagaaagaaaatattaatactgtggaggttatgtgacagtctttaataacaacaaccagttatattactataataagctttccatgaaaacaccaaaaagtactttttgatatcttattaaaaattaagattctgtcatatttcttagaattatatacattataattttatgttttttagaataaactcagcaatactgtacaaggatatcgtaatctatatggaagcacaaaggaacatataaatttaaatccttttgctccatgatcagtcacttcttttcattttaaactttgaattttggacattccacaaaattgttaacctcttgagtgatgtggattgagtaagttgtattacaattgtaaaaacaaatgattcatttcaacttgtattgaacatcttatgtgcaagacactctgcttaacacttgaggggactacagagataaatcagtgaggtcagttctatgggaggggaatcagggacagctacacagaagcagcttaaggatgataaggcttccagtccacagaaagagaggggtgaagatgattccagtataatggaaccatgagaacacacagaggaataaaggtgtgtcacatcagctctt

SEQ ID NO: 97431 - DNA, 556 bp, Homo sapiens
gccaaatgttaaaagtatttttgagcttctcagaggaaaccaatgaactgaagttcaataatctgtggtttgtgttacaatattttgaatccttccggagactgaatgaaagatacatatttaaagtgaatgcagtaagtaggaagaggcactgcttcagcctggtaacatgcagttattgctttgagggtcttgcagaaagaatatgcacattgagtaagtaggagaaggtgtgtattttggaaaaatcaatcaacttagttcaacttgaaggttttcctatctgaaaagggatgtatcaaaagatattttttcttaggaggaaaaaatccacaactcgcaccagagcatttcattgagaattactgttatttacgttttggaatttacattgttaaaaagagagattttggaaaggcaggggtgggactagaattgtggcttgcatgttgcctataaacatagattcctttttttagatgtctgtgtttcttagtggattatgttcttaaaatagaacataccacattactctctggtttggcagggtgtggtg

SEQ ID NO: 97432 - DNA, 483 bp, Homo sapiens
tgtgactcactccaagcggtcacatgaggctgggaggggactctgctctgaggggcggagctaggccctggccccagagtttgccatcagagccgtgtcatgtcagagtgggtgcggtcacacttgaggaatttgtccccatacccagatggagagcagacagcagctgccctgggagctctgccttccaagaacaaaaggtatcctgtttttttgtaagcactaatatattcatttaacagacacagcccctgtgcctggggctcagctagtccctgtcctagttcctcttgtggggggtggtgggttctgcaagtccaggaagagggagcacagagggatgtaggcatagacacagccataggcaaatgtgtcagctcagagcatgtggcaatcacagagtccgcggcctgactcttgacagcaccaggcaagtgaggactttaccgccttctccctagactccaaccccaaggggcagaa

SEQ ID NO: 97433 - DNA, 184 bp, Homo sapiens
gatcgcttgaggccagaccagcctgggcaacacagtgagacatcatctctacaaaaccaaaaagccaaaaaacaaaatgaagactgcccccccaccccataatctgatgcaaatatggctcaacatgttaagacttgacaaagttgggtgggtacatggatagggtattcttatttctttgttt

SEQ ID NO: 97434 - DNA, 703 bp, Homo sapiens
cgatcgaatcgagctctgtaccgatgagtaatctgtgcgtgagcatgggctggtctggagagtccaagatagcttcattcacttatttgataagccttgagggaaatgattagaaggcagggttcagctaggattgtcaacaggaatgccaatgtgtggcttctccagcacaatggcctcaggtagtcagattggcttccctcagaacaaatgtctcaaagtaactaagggaaagctgcttctgaccaagcctcagaagtcacttggaataacttccaccacattttattgttcatgcaagtcttacggccagctcagatttaaagggagagaaactagactgcatttatcttggtagagaaacggcaagatcacattgtataacagcatgtgagatggcaatactattgtgactctctttgaaaaaataccattttccacaccctcacaatctaccctgcccctaagaaagtaaacctggccaggatgtatctgaagagtactgagaaattgcagcagacatctctatcttttgtactttccttatctccctcttttacactctgccttcttccaccttttcactttattttcttacttccctttctttcccccagtcttttagttaactaaactcacaaggacatatcttagtgtgttcctccccatctctcctacacatctgtaaatctttgatccctgg

SEQ ID NO: 97435 - DNA, 290 bp, Homo sapiens
atggaagaaaagggccacaagccaaggactgcaggtggcttctcaatagggcaaggaaacagatgctctcccagaacctcaaaaaagtgaaacagccctgccaacaccttgagtttagtcccctgagatgcttttcagacttctgacttccagaactgtgtgataagttgtgctgtaagaataggaagctcatacaagataagagaggagataaagttgaatcacataaaatgtccaattaaaaagaaataaaaggccaggcgcggtggctcacacctgtaatcccagca

SEQ ID NO: 97436 - DNA, 499 bp, Homo sapiens
cttccttctttcctctttttccttccttgattcctttccttcctcctaccctccctccttttctcctttcattccttcattcgttctttctttgtattatctttatctgtaacttttagttcaaaagcatggactttggaaccagacaacctgaactgaattccaacaaccccacctaacagctgtatatcatatggcaggttatttaccctctctgtgtctcagtttactgatctgtaaaatttgggtaataatagggttaattcttagggtattcttatgattcagtgagttaatatatgtgtaattattgcatagtgagttgtgttggctattattcactcatttatacacttacttattttataatccacacccatatcacattgactgaagacattttaggattcactgtgttagcttttaaatttagaaatgagaaatataaatgcaatgcattaaaaaaattctgtgtacattcaccccataaaaatgtaga

SEQ ID NO: 97437 - DNA, 331 bp, Homo sapiens
ttgagcctgcctaaaggccagatgctatcagaagctgaacagcatctacagaaaccagccgcaaagacagaaacagaacaactggattggtggagagatccgataacaaaaagttgggaaatagatgcggatcctgattcctgtgagaagtagctcaccgtgacaaagctgcctttgcttttatcgctttgcaaaacaaaaaaggggggcatgttggaaacaggcccccaaatctggctataaactggccccaaaactggccataaacaaaatctctgcagcactgtgacatgtttgtgatggccatgatgcccatgctgaaggttgtggg

SEQ ID NO: 97438 - DNA, 104 bp, Homo sapiens
ttcacagccttgggtaggtttaggacaaagggtcccagactctgcctgccaagaagatgccttgagaatgtcttctgcgggtgctactgacggcaaacacctac

SEQ ID NO: 97439 - DNA, 861 bp, Homo sapiens
ccacccacctcggcctcccaaagtgctgggattacaggcgtgagccaccgcgcctggccttgaatctgtgaatatttctataggctaaattcttagaagtggaattgctgaagtaaagggtatgtacatttcaaattttaatagctcttaccaaattgtgctctaaccagttattatcaagagcctataagaatactgatttctcacactctcaacaactaagtattgtcattaaaaaccattgccagagttagaaagagtaaatctgagattaataattagaagttacaggaggtggatttgggcatatgcatgaaaaaactttctaatgattactgcttctaaggaatggaagagatgttcgaagggtgttcagttctccatcactaagagcagcaactaacttgtgtgatttatagtttagggagttctttgacataaatgatctaatttatcttcatgaaaattcaagaataagtattaatatctttttttataaatgagaaaatggaggctcagtctcagtgtcactcaataagaggtgaaattaggacacaattccaggtttctggactctgaatcttttctctttccattgtgctatgcagagattaaaataattatccaatagattgctgtgaagttgaatgttgatttaattaagatactttccaacaccaaacttctttgattttgtgctagttcaataaagtagtggtttggagaagggaaaggagaggtgatgaagtcccaataatgtggtggcaatagtgatacaggacaagagaaaacaaatataaggaacatagagagcaaagagtctaagataatgctgggattctgagcatgggtcactagtag

SEQ ID NO: 97440 - DNA, 818 bp, Homo sapiens
agcggaagtgacggttattcctcctgcgcgggagctttggggacgcacttctggatgcctaggcctcttccgtttgcctctgggactggcgatactcgagatgtcttgaggccttccagaccttgctccacctccaccaccaggtctccagtcctgagccacatgctgccatttttgtctcagaagcacccctcttccaggtggaagattgaaggtctgaagagtgggaagtcccaggaacaggcaattccaggaagatatgaggaaaatcaagaaagagaaggaaactgaagctagtgggaagtgcttcaagttggagatgatgctgagatggccaaaaagtgagaggtggaaaacatttggagtgagttaaggagagaacgcgaggcaaggaagtgaagctgagtgagttggggagtggggtgcaggggcctttggccaccccaggctctttctatgtgaacattctgagactgattctgatttttttcccctcccaaattgctctcttttcctttcttcacctacttactccctggtcatccttcctttgggtcagtgaagttgctgattctttagggaacacttctctgattgctgaagctaatagtctctccctgcggttgccggttgtttccaatagttgactagttttcttccccagcacttacgagtacacagccagtcactctggttgctcactgtcttccttcttccttgactgtcagctcacaggaatgcagggcccttacttgttttactcaccactgcatcccaaggatatagcagagtgcctggcacacggtaggtgctgaata

SEQ ID NO: 97441 - DNA, 260 bp, Homo sapiens
  misc_feature (40)..(41): n is a, c, g, or t
ggcgcgaggggggaggggggaggagaagaaaaaaaaaaannttggccgcaactggctgtatatttgtattgggattcttattatactttaagttttagggtgcatgtgcacaatgtgcaggggtgtgacgtatgtatacatcggccatgttggtgtgctgcacccattaactcgtcatttagcattaggtatatctcctaatgctatccctcccccctccccccaccccacaacagtccccagagtgtgatgttcccctt

SEQ ID NO: 97442 - DNA, 625 bp, Homo sapiens
atcctgaggcctccagcctagtgaggactgtgccaggtgctggggcctctgtggtgtgagaaactgcagattcgacaacacttgctggtgcacactttgcaggaacctggcccagtgcctggtcctcactgtcctaaattctcaaggctctgggatggaggtggtcacctccattttaggggtatgggatggaggctctggatggcacttgttagcccaaggcccccagcagcttcagaacctgtgtctactgcgattccagagcccagacccttgaccatcacaaccgcccccttccgcccccaggttggggtctagggggacaaaggctgttccgaagtcctctaggtgttagtcattggcttggagacgctggactccctgcctagtggggtgtactgtccacgaggactcctacacgcagggctgctggctggttcaggggaaccccagcatagtgggagaagcacaagtggctcggaagttgagtgctgagatccatgcaacccccaaggaggcctcactcacccagcatcagggagagcaaggcaggtgtggagttcgagcagtcacacctccagtgtcagtggccctgtcccaggagcccagagctgtcaccttacag

SEQ ID NO: 97443 - DNA, 262 bp, Homo sapiens
ggagagctggctagaacgtcgctggtcgatagaggggcggggattgaacgcggcggggaggtaagggtgcggggatagaactcggggatcggggagaggaaggggtgtgaataacaaaacgggattgaaaaccaggagaggggtggggcgcagtggtttacgcctgtaatcccagcactttgggaagccgaggcggttggaccgcttgagctcgggaattcaagaccagcccgggcaacacagcaagacccagtctctacaa

SEQ ID NO: 97444 - DNA, 814 bp, Homo sapiens
atcagccagctcacaaagaactttagctgcaggatgttctacctccagtaacttcaggatggtgcaccaccgttagtaatggatacatcaccaatatcatccaccaacattttaaccaagccaactggaccaagagaactttttacagtattggcaatcaaagctgcagccataacgttctgggagcagatcgcctccccagtgctgcggtccccaaacacggacaaaggcctctccattttcacggcagcggtacacgttgaattctgctcacaccgcgggcaaccagtatcgcagcccctcggctgactggcgaccacagcggtggctgcgacagcgtggagcgaacccgagcgattctccaagaggtgctcaacccaagtctattttcaaataacactatactacttcacagtcaaaagacaccgaaggtcgtcgacacagcatccaaaaatgcttcctggggaagatggaccaagacgctgccgcgacaggctccaagaggaagagtggtagcaggctataacacagaggataatcttgtctccaaaagagccattgccagggccattgtcctgaaaacgcacaaaatgcagcatgtctgaactggaagaacgtttagagctttttcagtccaacttctcagattggaagtggaacctcagacaagtgtttgggccaataattcaacgcagtgtagcagataaaggacacgaaccgaggtttccagtcctcggtcttgtgattccactaaactactcctaattgaagaagagatggagagattataaaggattcatctgctgctttacat

SEQ ID NO: 97445 - DNA, 281 bp, Homo sapiens
tccctttcccctacccaggaggtcacgatgagattggggatcgcaaagccaatgctgctcttgcccacaacccatcagagtcctctcttgcaggctttgctttggcatagggagggtgcctgcttattaagcatccagatgagcaaactctgccactgcagttctccacccagcagctgggagcctgacagcaaccagatggaaccaggctgggcaggaatagggaggggcaattccctacaaggctggcccagaagacatggctgcagaagactgctggc

SEQ ID NO: 97446 - DNA, 719 bp, Homo sapiens
agcgccgcgtgcagccccggttcccgctggcgcctctccctccacacctccccgcaagctgagggagccggctccggccttggccagcccataaaggggctcccacagtgcagcggtgggctgaagggctcctcaagtgccgccaaagtgggagcccaggcagaggaggcaccgagagcgagcgagggctctgaggactgccagcacgctgtcacctctcaatagcaagaggggacagataaattccttggtagaacgggacagtgccgggtaaaacccaaacttcaagccacagacagtctgaaacctgaaaactgacctaccagttttgggtggagcccgtcaccggagtaagaacttctttacttcctggatgccttttagccaatcaaatggtgctttttccagacctgcccaaggaccaatcagcatgcactcctccattctgagcacatataaaccctggactcagcctcacaggtggctgctacctgctttccggcctcctctcccacggagggctgcccactttgggtcccctcttcttgtccagagattttctgttactcaatagaattattcttggccaggcgtggtggctcacgactgtaatctcagtattttgggaggccgaggtgggcggatcacttcaggtcaggagttcgagaccagcctgaccaacatggcgaaaccccgcctctgctaaaaataataataat

SEQ ID NO: 97447 - DNA, 777 bp, Homo sapiens
  misc_feature (71)..(71): n is a, c, g, or t
agcgggcttttgcgtcaggcttctgcctgagctcggttagggcctcaccgacctgcttccacccctcaggnaggcctcagtgattcggccacagcctcagcctccgtcgctctgtgacctgcgggtattggatgattcgtagctaagactctacgacatccctgaagccgggaaatggtgtgtgttctcattttacccaagatctttggccagtgcagggcatagaagattcattccacaaacttatactgagaagatatgagaaatgtggacagaagaatttacaattaaggaaaggctctaaaagtgtgaataagtgtaaggtgcagaaaggaggttataatggactttaccaatgcttatcaactacccagagcaaaataattcagtgtaatacatctgtcaaagtttttcataaattttcaaattcaaacaacataagacatactggagagaaatcatttaaatgtaaaaaatgtggcagatcatttcgcaagttcctccaactaacttaacataagggaatacatgctggagagataccctacaaataaatgtgaagaatgtggcaaagcctttaataggtccacaagcattactaaatatacagaaaattcatgctggagagaaacccctcatgtgaagaacgtgtcagaatctttacctcatcctcaagctttgacaaacataagagaattcatactggagagaaaccctacacgtgaagaatgtggcaaagccttgagacaatccacagttctgaatgaacataagaaa

SEQ ID NO: 97448 - DNA, 362 bp, Homo sapiens
gttatctatttaggaggtgattagatataagaataaggtgcaagtttctcttgaaacctagagaaatttcagaaagaaatgggacaagatttgaataacagattcaataaagatgatgaacaaggagtcaaatataattctaatatttttagcttataaccttggtcatgcagggtgaaaaaacatatactgcccattcttataccggatactgtaaagttgacaacaaaattaacatctgtaaatgggatgaaaaaagttgaacgacttaaattcaaaagctgaaaatttaccctcttggaatcatgtaactatgtaaaatatgaagtgaagtataaaaatgttgccatcaaattaatatg

SEQ ID NO: 97449 - DNA, 538 bp, Homo sapiens
aggtccttctccagctctccttctggcttcatcctgtcttccacggctctcctgtcccacctattctccctgccggtgcccaagttttagccttcactgccttcccctagaacacgccagggatattgcattctgtcctcactgtcttgaggatcttcctccccggctcatcactccccatgggcagctgccagggtaggcgctgtcaccttctgttgacaacagtcagtagctcctaaggactaaaactgttcagcccagcattcagctctttggaggagtccatctgtcccccagcacatccaggagtaaggattccgactggtccactcctcatcctggtgtcttcagcttctctgctgccatgttctttgctgggatggctgcttcccaactccacctccagaatcaaggatattcctccaagcccagctcgaatgcttgatctgcctggagccttcctggtcatccttgggtgacctggagctggtgctgttagagcacttctgctctgccctgatgtgcagttgttgtgaat

SEQ ID NO: 97450 - DNA, 225 bp, Homo sapiens
cccaggagtttgagactagcccaggcaacagagtgagatcttgtatctacaaaaaatttaaaattagctggacatgatggctcatgcctataatcctagctactagcgaggctgaggtgggaaggtcacttgagtccaggagtttgagacggcagtgagccacgattgtgccacagtactccagcccaggcacagagtgaggctgtctcaaaaaaaaagaaaaga

SEQ ID NO: 97451 - DNA, 327 bp, Homo sapiens
aatactgatgagcatttaaacagcttccagtttggagctattgtgaatatcttgtaccgcttataagcattcttgttcatgattttttgttatccttcctttagggtatatccataaaaagtgaaattgacacgtcactgaataggcaaatgttcagcttttacaggtacgaccagttttccaaagtggttatactaatttatattccctccagcagtatgtgagagttctctttgctccatatcttcaatggtatttgttgattcccatctttatcgttttagccatgctgtgcaatccacaaatgaaagttagtttagtgctttg

SEQ ID NO: 97452 - DNA, 504 bp, Homo sapiens
tagaccctgctgacctccaggctcagcagaggggccaaggctgggcagaaatccttttccctgtctctatcaacacctctctgtgatagctgttcctggagttccccgccctcaggccttggcatctagcttatttgagaaataagagacatgaggcataaacttggtcaacttcttggcccctacgccacaggtgtctgtatctgtccccatcctgactccaccctccaggctctggggatggcccaccttggtcccaccaaaggctgctcccttctcctgtgctctggaccccaggtccttgggggctccaccatccctacttctctcttcaacctcttcctctctcctggctcctcccagcagcccgtaagtgtcgccatcttagccagatgcacaggcattaataactcctgcaatgttctctctcactctagccaccctaccttctctctctgacaggggtgagtctctactgcacttccgcttcttcaccccccagca

SEQ ID NO: 97453 - DNA, 729 bp, Homo sapiens
taggagtatataaagtataattgtttccaaatataagctattataaatattgacatcttgcagtatacccagtattttaattatgaaagttaaaattatataaacaacatatatgtggtagtattttctcttacctttattataaattgatcaatataaaaataatggctaaatagattatagcctcaaagacagtaaatgataatttcctttccctagaaattgaaatagtccagtataaaatttgcttttgttaaaagcttaaaatttaggaatataaaatatatttactgtcatgtggaggatgtaatagcatcctgattcattacttgagctttgtccaaagacttttatgtcttcaaatatactctgtgatattttactttctctggttatgtataaagctaatcaagaagcgaatataatagctgctactttaggataaactaaagataggaaaataattatattttatatagaatgtatcagctatcctttaaatgcctatagtggtatcaaaactaacacatgctaatttagctaggtatcagcaataggctggcaattagtaagggtgctttgaagcaatcactgaagctacaacataaatctgtggcagacagcacaaactacattcttatgttgttaatcactcttcttaattttcagtgccagaaagaatggtccttttcaggctatctattgctgcataactaatcaccctgagaa

SEQ ID NO: 97454 - DNA, 439 bp, Homo sapiens
attgtaaaatgcgggagttggactggaaacaacacatgcaaccctcctctctcccccagggctgatgatgagtgctgctggcttgggcttggtgccttgaggcatcttcttagtccccacagagatcctgggaggctggtggtgttgtcagctagtttcacagaggtggaaaccaatgctcggaggagttaaagtcctgtttagtgtctccgggtctgatgactgtggccagtaaagggacaggtggtcctattttgaccccctgccgtcactgctgtgtctgcccctgccaaatggtgggcaggtggcaggaagcgcaggctgccttgtggagctgagcctggtctgagcagtgcacccctggctagttataaactggggccccctgtttgtgttcagcctggaaggagacaccacgtggtttccagtggaatgggcg

SEQ ID NO: 97455 - DNA, 377 bp, Homo sapiens
ggggctatctacctcccagtggccatcctgtgcccctaccctgcctcacccggctcacagggccccaggctttcccagctattagctccgccagccacctgaacaggtgccctccctcggggtcctaaactgtcttctttctggttgggagctgggactgttctgtgttctccccacagcccctagcccagccaggtgggcctagggtggctctgttggcagcacccacacagcccccagggtcccaggcctctcagctcccttgcaaggagtgcactatcgcccacatttggcaggccaggacgcagaggcccagagaggtgggctggggtctaagtccaggcaggctggctatagagctgggaagggtagctaag

SEQ ID NO: 97456 - DNA, 1184 bp, Homo sapiens
aactgttaactgaaggtgactcagggtaactaattctggatctttgggtgcacagcctctcactggagtctgagaggaggaggtggagactatcagtgcacggcccgcaaccaggaaggactcccagactaacgccaaaggtgtgttgggctcagctgctccactgtggaaaaggaaagccctggccctgtggcaggagaggattgttctagtcaagtgtggcgttgcacggacaggcggtgccgagtgtttgggtgcagacacaggcagctgctgccctccacttcctgctcttgcaagtcacagatgattccagtacaatgtgggaggtcctccttacaggggcacttgcaacaggaaggcagagagtttcgtcaattcaggtacaggtctgtctgggagacctggccctgtggaggcaggaacaccgtgcaggggcatggcagcgcctgtctttgctatcacatcatttgccttttccttgtaggacccaaagatctatgtccaaaacttagtccagaaacatctgcattcctgtttaaacttcagctcagtttcttaaccaagaaccacgtcaaccctccagggttgtggtttgtatttttgcctttaagcattatctcctttccaccaagaagcctacttaggtttaacacatgaaagcagtgtctaaaaattagatcggtcctaaattggaatgggatgtcttccttgcatgtcccataccagggaatttttttaacacacagtgtagagcctttgccagagatgttgaaagggagattaaaggcttgagggatgaatttgatcatcattcttaaagtcccttccaatcctgtgattctctgattccctgagtctcgtttattattggacatgcctagcccatcaccagtgacctgcccgcatattgctggcttcccttggataacggagagcctatcaccacatgcctttgttgtcttccatcatatcaagtgagttgctttctggactttttccatctagagcctgctaggtttggttttgagaaaagatggtgaagtttcttttcatgagtttgtagggcaaaaaaaattctttttaaagatggtaagggtggaaattaatcatggtaccatctcattaaaaatagatacctcaaaatgtttacctttacaagtcaagaagagtatctgactttc

SEQ ID NO: 97457 - DNA, 1129 bp, Homo sapiens
aactgttaactgaaggtgactcagggtaactaattctggatctttgggtgcacagcctctcactggagtctgagaggaggaggtggagactatcagtgcacggcccgcaaccaggaaggactcccagactaacgccaaaggtgtgttgggctcagctgctccactgtggaaaaggaaagccctggccctgtggcaggagaggattgttctagtcaagtgtggcgttgcacggacaggcggtgccgagtgtttgggtgcagacacaggcagctgctgccctccacttcctgctcttgcaagtcacagatgattccagtacaatgtgggaggtcctccttacaggggcacttgcaacaggaaggcagagagtttcgtcaattcaggtacaggtctgtctgggagacctggccctgtggaggcaggaacaccgtgcaggggcatggcagcgcctgtctttgctatcacatcatttgccttttccttgtaggacccaaagatctatgtccaaaacttagtccagaaacatctgcattcctgtttaaacttcagctcagtttcttaaccaagaaccacgtcaaccctccagggttgtggtttgtatttttgcctttaagcattatctcctttccaccaagaagcctacttaggtttaacacatgaaagcagtgtctaaaggaatttttttaacacacagtgtagagcctttgccagagatgttgaaagggagattaaaggcttgagggatgaatttgatcatcattcttaaagtcccttccaatcctgtgattctctgattccctgagtctcgtttattattggacatgcctagcccatcaccagtgacctgcccgcatattgctggcttcccttggataacggagagcctatcaccacatgcctttgttgtcttccatcatatcaagtgagttgctttctggactttttccatctagagcctgctaggtttggttttgagaaaagatggtgaagtttcttttcatgagtttgtagggcaaaaaaaattctttttaaagatggtaagggtggaaattaatcatggtaccatctcattaaaaatagatacctcaaaatgtttacctttacaagtcaagaagagtatctgactttc

SEQ ID NO: 97458 - DNA, 313 bp, Homo sapiens
aatgttgtcatggatacctctgcatttctaaatggtgaaaagcttctatgacacatgatggaaaaaaaaagccccatcgtgattttcccactgcacatctattagaatgactaaaagtaacaccaaacccaaacacccagacaatgcgaaatgctggcacagatgtggagcaactggaacccccatacgttactgatgggaatgcaaaatgatacagccactttggaaaagagtttggctgtttctgtttttctttttttggaaatggtgtctccttctgtcgcccaggctggagtgcagtggcctgatctca

SEQ ID NO: 97459 - DNA, 339 bp, Homo sapiens
ctttgcctgttcatccctccctccccatagcccctgaaaaccactgatctttttcactgtctctgtagttttgtctcatagtttttacgttcttccaaaatgtcatatagtcggaatcatacagtatgtagccttttcatactggcttctttcactcagtattatgcatttatgcatttccttcgtgtcttttcatggttctttttattttttaaagcattgagtaatattccattgtctggatgtaccacagtttatccattcacctacgggaggatatctcagttgctttcaaattttggcaattatgaataaagctgctgtaaacatccatgtgca

SEQ ID NO: 97460 - DNA, 178 bp, Homo sapiens
caacacaggatcgagccggtaccccctcaacctgtgcctctgtctcccctgggagatgcttagaaaggcaagttcatgggctccccccaccaaaccaatgaatcggatctctatggttaggcccagaatctgtgatttaacaagctctctagatgattcttacgcacacgcaagttag

SEQ ID NO: 97461 - DNA, 772 bp, Homo sapiens
ggaactttggcttttagtttcaaatttatctttctagccattttatttaagacgtttatacaagaagaaatacataaagaatgaggtaaatgacaaattagcaatgtaattgttatcaactagtggaggcacttttagcaggcaaattactcattattatggtcaattattttggcaaataattaaagaaaatgaaaaagaagaccaccagactatgaatgactttgcctttaactgatgctgatagaatttgttttaaaattttttcactattaggaagtagcctggttttgactaaactttttaaaaagaaaaaaaagtttgtttgaaataattacagattcacatgaacttgcaaagatagtacagagaggtcctgggtacctgtcacccagtttccccaaatgactacatcttatgtaactgtagtatattttcatagcccagaaattgatattggtacaatgtgtgtatatagttctgtgacattttatcacattatggattcatgtaaccacctccacaatgatgatacagaaatatttcaccataagagacataaattacagaactcaagaggagggggaaggaaagaaaatttgttgtattgacacatattttgcttaccatgttctttcttccttcctgatgttccaagataccctcttttatcattttcttttggtttagataacttcttttaactaatagggtaggtatgctggtgacaaaatcttagttttcctttatctgagaatgctttaatctcccc

SEQ ID NO: 97462 - DNA, 1512 bp, Homo sapiens
  misc_feature (1)..(1): n is a, c, g, or t
  misc_feature (4)..(5): n is a, c, g, or t
ncannagatgatgtcactgctctgttcaggatcttccagtggcttctcaccacactcagagtaaagagcaacactgcaaaggctgcctaggccctgtgagatctgcttccccctcccgccacctgacttcatttctatcgccaccactccctccaacccactccagccacgcatctttgctctcccctgaatatgccaagcaggctttgccttagggcatctgcacttgctctttcctctgtttggaatactcttgcctcagccacacaaagagcatgtttcctggtttccttaaggtttctgattaaaaatgtcagcttgtgaatgaaccctttctgccaacttatttcaaatagtaatgctgccattgctgggatcccatttccttctcacctggctttactgctccccctaacacgagcatttgatatgagagatgcttacttgtttattggttgattatctgtctccctcctccactctgctagaacataagctctatgtggatagggactatgtctgttgtgatcactcttgtattcctagaacctagaacagtgtctcatacataacagatgctcaataaatatttgttgaattgcatgttctccatgttcatcaggaaagttttcaagcctctcagatagggctgctggatttgattgtacaggggtgcactgcactctaggggtgcctttctcatcacagtccatgtgattgacaccccctggagttgtgcagtggacaacctgtacagacatgtgctattgccctggtgtcagtatctcagtagatttcaaaatcagggagttctgtgtaggaatttcaagactctggaagtataatacaacattgacaaattttcaagtaaataatttgatttcctcttcagggtaattcaagcagcatatgatgcagaaactactttttttctaccctccttgtctgtctaaatttcaaagatgtcaagtgtaagttgctcatttacctatgggatgctgtctgtaatgtagctgatggcagtatgtaatttgccaagaccttaagttcatgttcttaaattgctgctgggctccttaatagcagtgaattctttgcagaaattgtttgagtattttctaagttattaattttggcctgatttgcaaatataatctcagacaaattgtttattatcaatagtaatcattgtagtaacatagagcctactatatgccaggtacttttcgtgcattatctattccaataactctgtcaggtaaacatgattaagtcacccttatagatgtggatacaggttcaaaaatttaagtaactcacttgtgactaccaaactcatgaatggtggagaaggggcctcactccaggtaagtgtggctcccagccagcactatccattcccttctcgtaactgctcttactgaataaatcactgatgtggttaatttcaaaattcttaatagcttaataatattcatatgtaacaagattagcatgttgaggtccaaaaaa

SEQ ID NO: 97463 - DNA, 4505 bp, Homo sapiens
  misc_feature (1638)..(1638): n is a, c, g, or t
gccagggaaaggccttatcgctgtgtgtgtgtttcagtctacgtggattaaacattacttcgctccgtctgcctggattaaacgtgcactttgcagtcctcacttctccgtaccagtgatctggggatcgctacggaccttaaaatacccatagccccttcgcccctgcaacaggcacttctccccacgtttgatgtgtgaataattacattgactgagaaagaaacccagaagaggaagaagaggaaggaaaaggagtcagtgatggctactcaggggcatttgacattcaaggatgtagccatagaattctctcaggaggagtggaaatgcctggagcctgtgcagaaagctttgtacaaggatgtgatgttggagaactataggaacctggtcttcctaggtatctctcctaaatgtgtgatcaaggaattaccaccaacagagaacagtaatacaggagaaaggttccaaacagtggcactggaaagacatcaaagctatgatattgaaaatttatacttcagggaaatacagaaacatctacatgaccttgaatttcaatggaaagatggtgaaacaaatgataaagaagtgccagtgccccatgaaaacaatcttactggtaaaagagatcaacatagtcaaggggatgtagaaaacaatcatattgaaaaccagcttacatcaaactttgagtcacgtctggctgaactgcagaaagttcaaactgaagggagactttatgaatgtaatgaaacggagaagacaggtaataatggttgtttagtttctccacacattagggaaaaaacgtatgtatgtaatgaatgtggcaaagcctttaaagcgtcttccagccttattaatcatcagaggatacatactacagagaaaccttacaaatgcaatgagtgtggcaaagcctttcatcgggcctcactactaactgtacacaaggtagtccatacaagagggaaatcatatcaatgtgatgtatgtggcaagatcttcagaaaaaattcatattttgtaagacaccaaaggagtcacactggacagaaaccctacatatgtaatgaatgtggcaagtcctttagtaaaagttcccaccttgcagttcatcagagaattcataccggtgaaaaaccttacaaatgtaatctgtgtgggaaatcctttagtcagcgtgtccatcttagacttcatcagacagttcatactggagagagacccttcaaatgtaatgagtgtggcaaaacctttaaacggagctcaaacctcactgtacatcaggtaatccatgcaggaaagaaaccatataaatgtgatgtatgtggcaaggcattcagacatagatcaaatcttgtatgtcaccggagaatccacagtggagagaaacaatacaaatgcaatgaatgtggcaaggtcttcagtaaacgttcaagtcttgcagtgcatcgacgaattcacactgtagagaaaccttgcaaatgcaatgaatgtggcaaggtcttcagtaaacgttcaagtcttgcagtgcatcagagaattcatactggacagaaaacttacaaatgcaataaatgtggcaaggtgtacagtaagcattcacatcttgcagtgcattggagaatncataccggcgagaaagcttataaatgcaatgaatgtggcaaagttttcagcatacattcacgacttgcagctcatcagagaattcatactggagagaaaccttacaaatgcaatgaatgtggcaaggtcttcagtcaacattcacgtcttgcagtgcatcggagaattcatactggagagaaaccttacaaatgcaaagaatgtggcaaggtcttcagtgaccgttcagcttttgcaaggcatcggagaattcatactggagagaagccttacaaatgcaaagaatgtggcaaggtcttcagtcaatgttcacgtcttacagtgcatctgagaattcatagtggagagaaaccttacaaatgcaatgaatgcggcaaggtctacagtcagtattcacatcttgtagggcatcgaagagttcatactggagagaaaccatacaaatgtcatgaatgtggcaaagcctttaatcagggctccacactcaatagacatcagagaattcataccggagagaaaccttacaaatgcaatcagtgtgggaattcctttagtcagcgtgtccatcttagacttcatcagactgttcatactggagacagaccttacaaatgtaatgagtgtggcaaaacctttaaacggagctcaaacctcactgcacatcagataattcatgcaggaaagaaaccatataaatgtgatgaatgtggcaaggtattcaggcatagttcacatcttgtaagtcaccagagaatccacactggagagaaaagatacaaatgtattgaatgtggcaaagcctttgggcggttgttttccctcagcaaacaccaaagaattcattctggcaaaaaaccttataaatgtaatgagtgtgggaaatcttttatttgtcgctcaggcctcactaaacatcgaataagacatactggagagagccttacaactaaactcaatgtgacaaggccttagacgttgtcctagtttctggaatcaccgaataattcctacttactgatataccttgtatatttaccccttctcttgaaatccctgtggaattgtaatctccagtattggaggtggggcccattgggaggtgattgaatcatggaagtggatttctcaaactgagaaagatgtagcgtcatccccttggtgctgtcctggcaatagtgacttctcttgaggtctggctgtttagaagtgcatagcacttccctgtcgcttgccctcattctcaccatgtgaaataccgacacccgctttgccttccaccatgattttaaccttcctgaggcttccctagagggtgatcagatgccagcaccatgttttcatttaagccttcagaaatatgagccaattaaactcttttctttatacattagccagcctcaggtttttttttgtagcaatgcagttatgacctaatacatttacacatgcagtaaatatacctaagttttaagctagtattcactactcactaggtgtaagaatttgtatatatattcccggatgtatacatcctggagaaaaatcacagaagtgtaatacgtgtggcaagaattctactcaaaagccagaacttgtaaatctaggtaattaaaagggcatagatgtatgaaatgaaatgagggtggcaaaacctttactagagttcaatcactacttgtcataagagagtttatactgaaaggaaatcatataaatgtatgtgtcagaggctttccccaggcattggaactcactaggcatcagaatatacatctttgagaggaaccacagaaatgtaatgtgcatgctaaggtttttacccgaacatcaaaatggaaagagtattcatactagagacaaccttccaaataaatggttttaaaaaatgaaatgttcaaagacctggaatcaacccaaatgcttatcagtgatagactgaataaagaaaatgtggtacatatacaccatgggatactatgcagccatagaaaggaatgagatcatgtccattgcagcgatgtggatggagctggaagccattatcctcaggaaactaacacaggaacagaaaatcaaacagcacatgttctcacttaaaagtggaagctgaacaatgagaacacatatacccagggaggggagcaacacacactggggcctgctgatgggggtgggaagggcagggaagtggagcatcaggacaaatagctaatgcattttgccttaataccaggtgatgggttggtagatgcagcaaaccaccatggcacacattttcctatgtaacaaatttgcaaattgtgcacatgtacccagaacttaaagtgagacaaaaccaatgtccacgcctttgcagtttgattgaacgtataaaggagaaaaatcctgtaagtatgctgaacatgaaaggacctggaagcagtagtgtgtcttcagcctttaccaaattatccctacttgagagaaaacttggaaatgtaatcaatgtggcacaaatttcaaccagttttttaaacagactacacatctttgaaatcatactagggataaccaaatctgcttctccaagattggcctggaatattattacagaataactaccagacaacatttgttaaaactcaggacagtatgtattttaaaggagcaagtgcatgtgtgaaaatggctcattcagtttataaaatattacattaaatttgaggtttctgttttttttcttttgtgacagtcttgctctgttccccatgctgtagtgcagtggcaccagttcacctcactgtaacttccacatcctggtttcaagcaatttgtgcctcagcctcccaagtagctgggattacagtcatgccaccatgtccagataa

SEQ ID NO: 97464 - DNA, 760 bp, Homo sapiens
tgaggaagtgccgaggctgggagcaagggcagtggccccaggagtgtggagagttccatgaccactctgatgtggacagtagggaaaaagaggaacacacccacacatattcacgtgcgtgtatgtatatgtgtatgtaatgtatgtgtgtgtgtatactgctggtatacgcataaaatatcacaggggggtacaccggaaactgacatcatgggtacatctggagaagaagaaccaggtgttacaggatacagggatgaggaaaaggagactgagggatcggggtgtgcatcaactcctagagaagagaagtgggttctctgcaagttctgaaggcccaggggtggaggttaggggtggagcttcttgactcccacagttagagagagggcttctcagcaggatgatgaaggtggcccagcctcattaccagagcgtgggctctggagccagacgatctggttcagactctacctcatcactcagcagttgttgggcaagttcctttgccctgagggtctcagtttccgcaatggcaagatggggtggacagtggcacctccccaatggggttgtcgggaaagtgcttaggactgctcctggcaagtggagagcatgtggtaaatgttagctattattatcctcgtcccttgtgaaggtgacactgttcttgggcagcgggagcccagtgctccagtgccatctggtgcttcgtggccccggctggctccacaccagcaggtgcacagcagtgctgaga

SEQ ID NO: 97465 - DNA, 173 bp, Homo sapiens
taattttaacatgtgtatgaatgagagagtgtgtttgaatacatatatgtatacatgcataagattatatgcatgcactcatttattggtgatatgtggataaggtggacttaagtagacatttcatttccaaatgtgtttagaataaggttaaaagttgagccatagctttt

SEQ ID NO: 97466 - DNA, 727 bp, Homo sapiens
attctgaggtagccttggcgactttcgagactacccaggccgagcacacccagccccctcagacccaggcatttctgcgtcctctggtttggagggaacccagggggctgaggtgaagcaagccaggactgtttctctgactcttctggaagacgacccgctgctcgggccgcctcatcactgcgggccacgagtgcccttcttcattccagacatggtgctttgaacaatttgacttggaggcaagattgcgatatagaaaatgggccactgtggaggagataagtaaatgctttgtcgcttctaagtgacaggggaaactgatcacgattggtatacttctgacatgtaactttctatatctttagaagatcgtcagggaaatagaaaaaaaaatctgaaatctccaagtaggttctactttgtgtggttccaactaaatgaactaaatttgtgtttaaagattgtaagtctacatgtaatggtgaaagctgaaggttttacactgcacagaaatagtgatttccccccgtggagggcaagaagaccggaataggaggggtgggtgggggaatcaatgtgtaggccaaatatttgaaatttcagtgcaatcttcttagtcatcactttcatttctgtcttctagggaaatctgacacagctagaaagcaatggaaaacactaagagttgcatcagatgttgaagaggaactgatattatgggata

SEQ ID NO: 97467 - DNA, 1291 bp, Homo sapiens
agcagcagaactcccggctcagagagttctccaccgctcctcccaggctcacgaggctcacgggctacccagcgccagcggcccaggaggctggaccacagactacgaagctgcaccgtgtggggcccactttttatacaagcgggtggcggtggatccaggcgcacagacgggagtgaggcgtggcggagacgcgtgcacgctgggtctgtgcacttttgctgctgctgctttttttttttttttttttgtggagaagtggaagcccggggtggaacgtggagaactcttaattaaaaaaaaaaaaaaaaaaagtgtgggtgtggggtgggcccctaattatacaagtggcctttgtaagtgttgggaaggtgcggggtggtgtgcgagaacatctaattttttctctatttacgcggggctcttctcatacaattttttcaagaaaaaagggtgtgggatcgagatgtgagcccttgtgaagatattttccaaaatttcaggggggtttcggggcgcagtgggtggtggttccatattaaaacaaaacggggcgcgaaaatatgtagatgtgctcaccagaggggataaaaaataaccttttctgtccactatatagtatagcagaaacttgtggtgaccgcatgtcggctcccgggggaggaaatctacgtttttggagaccccacagggcgcggcgacaccctttttatctagcgggcggggggacaaccacctctcctctgttgtggctgccccaagtaataattcgtcgtcgccagtttttctataaaccaccctcagaaaagagaaaaacctccgggcgctttccctcctttaagagacaccaagcaggttcgtgctcccacctccgccagcggcgggctagtaagaatataacactacattttgtgtcgccctttctaaagagaaacccactagaaaatataatacaaaacaaaaaaaaaaccttctccgccgacacggcgcgggtggagatagatccgccgggggcagccacgaaaaatagagagggcgcggcccgaggaaaaaacgcctccacgacgaagagaggggagcagggcccgccgccgcaggggaaacacaccaccgtctttttgtgtggcgcccctccacttaagaagagagcaaggaggggaaaaacacatctccacaaacacacgtcggggcgggagaagcaacccgcggcgtcacgaataacggggggcgttccgccccgtgggctgacacaaccttggggttaacatccccggctgcacaagtgctcgaa

SEQ ID NO: 97468 - DNA, 744 bp, Homo sapiens
agcagcagaactcccggctcagagagttctccaccgctcctcccaggctcacgaggctcacgggctacccagcgccagcggcccaggaggctggaccacaggtaagacgaggcccaaggcctgcctctgggaactcggccctggcttggctctgccctcctcactcccacaggatctccgtgcccaccaggcctcagtcccgacttctccctgctgcccggcacgggaccctcccccaggacagccacctcccagtgctgaagagccggcccgcctcagagccgcccgccgttcctttttcctatgcatatacttctttgaggatctggcctaaagaggtatagggcatgggaaaacggggcggtcgggtcctccccagcggcacctgcaccagtgcacctgcacctgctccagcagcacctgcctcctgacttgggactccacctgcttcctttctcctcggccgggaaccccggggctttgacccccacatccttggggcagaaaggggccaaatattctagaacaaggaaaacgtggatgtgtgcttttgtgtgggttctggaagtgtctggggaggacgtggtccaggcctctgccctgggttgatctctgcagcccctgagctgggacccaggatgcagagaggagggctggagctgggcggtgctctgtgaccagtctgaccggagttgggggtggacccattacaggaggtggcgggagggacaacctgggctctgg

SEQ ID NO: 97469 - DNA, 368 bp, Homo sapiens
ggaggctcagttacctgttcatctctgtattcccctcagtgctcagccctgtagacagtcgtgacatagttttaactaaatgctgaaatgttgagtagggggaaagaaagagccatcttattattattatagttagcaaaatttttctgtaaagagccaggtagtaaatatttttgtctttatggatggctgtacattctttgtttttgtgtttataaccatttaaaaatgtaaaaagcattcttaccttacaatacaaaaacaggttgaagcacaggtattgcctgggacatgactgcaggttttagggcaggaaggaagaggcagcatgtgccggttcctcagcggccagccctgctttcatttcc

SEQ ID NO: 97470 - DNA, 235 bp, Homo sapiens
atctgaaacgaagccaagcaaagcaacatcaccttctggaaagtgcagaaactgcaatcaagatcaacaaagaaaagcacccttcccatagattcatctctttggcgtttaagtgtttgggcgagtctacaaaactcagattcctcatttaactagatgttccaggtcacagagatattctactaaggcaattttcaaaagaccataaaaccaccacatcaatttatgcttgcag

SEQ ID NO: 97471 - DNA, 391 bp, Homo sapiens
aaacttttcatcctctccctccatgccaaggggcccttgctcccagaagccagcaccccgactggcaggtgacctcccattgcctgtcactcacacggcttcccgcctctccatcctcatgaccatcactcctgcagcacaggctctggttacctctcaatgggactaggtacagcaaaggcctccaaatccatcttttcacctccatcctgcctttcttcaatcccactcctcctctgccacgctgcttgagtaatcttaaaaactctgaccctgtcactcaactgaaaagccatcagtgagtcactttccttgcaaaagaagtcaaaattccatagtctgaaactagaagcatgggctgaacattttgctcaatagactttgtggattt

SEQ ID NO: 97472 - DNA, 625 bp, Homo sapiens
ctctgcctcttcaccatttatccccagcctaacatctggtacatgacaggtagtcaaaatatttgaggaaaaggtagagcaggatgaaagaaatttttgcttatggttatacatataaaggcaacatagcagcacttaaaaacaacagtctctataagccacaggtgcctacgttataggaataacttaatgcagtaatttgacatcctgtcttttactttctttcagacatgaaatcagcttaaatggaagaaaattctaggctggagtcaccaaaccccaggctctgcctgttttatatataaagttttattagaacacagccatgcccattcatttatgtacagtctataggtgtttccaattacaacaagcacagttaccatatggttcccaagcctaaaatattaactacctggccctttcagaaaaggtgcgccaaaccccaccctaaacccaaacaacttgtgttctttagcaagcaaaaacaaactagaaacaagtccactcacattatttctaaattaagaataacagggaattttgtcatctgcaaatggcaaaaatcattgtgttataaaggttaagattttaatactggcttctcagttcaagatgttgacaa

SEQ ID NO: 97473 - DNA, 699 bp, Homo sapiens
cgctaatggaagataccttgcgattgctgtgaaataaatcgcccacttccgacacaattcatactgaaggcagggattaatgaatttgtacattgccattttagaaatgcttgaaatttagacactggcttaatgaaaatactttaatgttggcatctggaacacaaaacatttagttttgatatagttatgaactaatcttatagttaagtctttcttgaatggtcttaaagttgaactttaggaagtgtacacacacatctctcaaattaaggtaaaggatatatcttactatttctgtattccccaaagtaccagcatatagtaaaacctcaaactctgaaattaaacagaaagcaaaaacactatgatataactttaaaattaaggtttatatcactttgagcaaaatatgaaattgcttttaaaatcagtgtgactaggccaggagcagtggctcatgcctgtaatcccagcatttcgcaaggctgacgcgggcagatcacctgaggtcaggagattgagaccagcctggccaacatggtgaacaggcgtggtggtgtgtgcctgtagtcccagctactcaggaggctgaggctggagaattgcttgaacccgggaggcagaggttgcagtgagccgagattgcgccgctgcactccagcctgggcaacagagcaagactctgtctcaaaaaaa

SEQ ID NO: 97474 - DNA, 686 bp, Homo sapiens
aaattaatgacttcaagaacttttcctgtataacagaaattctgtgtagtaaagttgttgggattaatgaatttgtacattgccattttagaaatgcttgaaatttagacactggcttaatgaaaatactttaatgttggcatctggaacacaaaacatttagttttgatatagttatgaactaatcttatagttaagtctttcttgaatggtcttaaagttgaactttaggaagtgtacacacacatctctcaaattaaggtaaaggatatatcttactatttctgtattccccaaagtaccagcatatagtaaaacctcaaactctgaaattaaacagaaagcaaaaacactatgatataactttaaaattaaggtttatatcactttgagcaaaatatgaaattgcttttaaaatcagtgtgactaggccaggagcagtggctcatgcctgtaatcccagcatttcgcaaggctgacgcgggcagatcacctgaggtcaggagattgagaccagcctggccaacatggtgaacaggcgtggtggtgtgtgcctgtagtcccagctactcaggaggctgaggctggagaattgcttgaacccgggaggcagaggttgcagtgagccgagattgcgccgctgcactccagcctgggcaacagagcaagactctgtctcaaaaaaa

SEQ ID NO: 97475 - DNA, 249 bp, Homo sapiens
atacctgaaatgtcaacctgtaccaactgacatgtacatccattaggaggtacctactccggagataacactcaggtgcctatgatactgaagaaaccatctgcttagctcaaagtatggttttcatttaattcatacatcaaactgcaccttggttacactgaccacacaaatattgcaatggtctggcttaacttactgaggctcagtgattcctcacccagttgactggccacaaccacatctaca

SEQ ID NO: 97476 - DNA, 977 bp, Homo sapiens
ggctgcagggttccccttggcctgcaaacaggaacacagggtgtttctcagtggctgcgagaatgctgatgaaaaccccaggatgttgtgtcaccgtggtggccagctgatagtgccaatcatcccactttgccctgagcactcctgcaggggtagaagactccagaaccttctctcaggcccatggcccaagcagcccatggaacttcataacctgagctctccatctccctctctctcctcctctgttctccctccctccttctctccctcaccctcctctgctccctctgcctttaccactgtgggggggtcctctggagggccctgccaccccacctcttcctcgctggtgtctgccttcctggcaccaatcctggccctggagtttgtcctgggcctggtggggaacagtttggccctcttcatcttctgcatccacacgcggccctggacctccaacacggtgttcctggtcagcctggtggccgctgacttcctcctgatcagcaacctgcccctccgcgtggactactacctcctccatgagacctggcgctttggggctgctgcctgcaaagtcaacctcttcatgctgtccaccaaccgcacggccagcgttgtcttcctcacagccatcgcactcaaccgctacctgaaggtggtgcagccccaccacgtgctgagccgtgcttccgtgggggcagctgcccgggtggccgggggactctgggtgggcatcctgctcctcaacgggcacctgctcctgagcaccttctccggccctcctgcctcagctacagggtgggcacgaagccctcggcctcgctccgctggcaccaggcactgtacctgctggagttcttcctgccactggcgctcatcctctttgctattgtgagcattgggctcaccatccggaaccgtggtctgggcgggcaggcaggcccgcagagggccatgcgtgtgctggccat

SEQ ID NO: 97477 - DNA, 266 bp, Homo sapiens
taccagttattcctccctgtttctctcagcatcaccaaaataacaacttccagcaaccccactccagcccaacttcaaactccaattgttaatcttgcattcactactccacaaatactttttacttgtatacaaacttaatgttgattttaccttcattcaatgtttatttagttacctatatattttcttcatatttgtacatgtcagtctcacctgtcttaactagtaggttcctaaaggaaaaaatgaataaacacttgatt

SEQ ID NO: 97478 - DNA, 369 bp, Homo sapiens
agaggtgaaggctggagaggaggtggcgattgcaaccttcaattcaaggtccctgagaaagagggatttggggtaaagagctcatggggcagctctctgtctctgactccagcaggtctggcgctgaggtcttctagacttgtccctgacagtgggcacagcctcccgcagccccctgcagcctcctcggcctcctcccacaccaggctctgctcagcgggccgagggcgggctgggtgcagagagcctggcttaggaagaaacagggcttgaaaacatggtgtttttgttttttgttttgggttggggtatcactgtcacccaggctggagggcagtggtgagaccatgcctcactggagtctggact

SEQ ID NO: 97479 - DNA, 704 bp, Homo sapiens
acagtgggtttctaggataggtctgaaaattgctttcatttgcaacacatttagaaagtagctttatttggatattacagacaatctaaatatatcatcagtttttaaaagtgcctatgtgaagtgatttttaaaaagagcctatgtgaaggggtaatcttgcttgttcttgttactaatttctcatagattgtttttctgcatatataagaacgaaattatttatttactatggttgtacgtgcctcaaataaacaagaatgatatttcctgttttatttacttatgttgggtaaatatgcttattgaatttttaagagaggattttttaccatctccatttttcttgtcattatgttttgtagcttatttgagggtgtctaaatataatttcatattttattggttcaactttcactctgaagaaatccgtatgttagtacattttgaggtatttttcttgttcttgtgttgtttaactatgactcctaactgagtagtcttatatttcaattacaaaatacattttttaagaaagggaatagagcagcaaaaatgataaggaaaatgttaaaagttgtaatatttcctttactcttaacaggattatatatagaacatgctcacttacaaaaataggatgatgaagtttagagcataaggcaggcttcttgtatatacttatgctgtcaaatgttatattg

SEQ ID NO: 97480 - DNA, 793 bp, Homo sapiens
aaaagatgaagtaggatctggaatttcataacttaatacccaaaatgtctaggatataattaaaaattacttttcataccaagaaccaggacaatcacaacttgaattagacaatcaacagatgctgttatggattgaatgtttgtgtctcccccaaatttataagttgaagccctaaccctgcaatgtgatgtttggaggtgggacctttggaaggtaattagatttaggtgaggtcatgagggttaggctcaagagggattaatgtccttagaagaataagagagaccagtactctctctctctaccgtgtgaagacacagctagaaggtgattatctgtaagccagaaaggggaccctcaccaggaaccacgtcgactcattccttgatcttggacttccccagcatccagaattgtgagaaataaatgtatgttgtttaagctgcccagtatatgatattttgttatagcagcctgagaagactgagacagatgctaatactgaaatgactcagaagttgaaatcatctaacaagaattttaaaacaactattataaaattgcttcagcaagcaattatgagcacccttgaagcaaagtctcagcaaggaaacagaagataagaaaaaagaaccaaatggaattatagaactgaacaatataataactaaaactttaaaagtcaccagataggctcagtagcagaacagagatgacagagaaaagaatcagtaaacttaaagacagataaataaaaattacacagtctgaacaacaaagagaagataga

SEQ ID NO: 97481 - DNA, 620 bp, Homo sapiens
tgggtatagactttgtaccaccaacattgctgagtttcagaatatattgtcctccatcagtccgtatacagtctttgacaacaagagttgttttctgaatagtagatttaatttccattctagcagctgtttcttcaagttcttttccatcttttgaccaaacaacatcaggtataggtttgccacggatgtcggcttcaagaacaaaagtctctcctgcatgaacaacgatgacatctttatattttggatccagagaggcatttggtgcatcaatttcatctcttgcagtaatggcaccactactatcagatggttcactaaagtttccagctgcatttcttgcaattactctaaattcatatctttggtcttctacaagtccactcactgtaaattcagtttctaatacgttggtaaagctggctttcatccagcggccatcaggtagatctttcttttctacaatataacctgttattttgctaccaccatcataggcaggtttcttccatttcagtgtgacattgtttcttgtaataacaatggcttcagggcgaccaggtgggtcacatggatcacgagcaacaaagcattctgacactttgctaggcttgcca

SEQ ID NO: 97482 - DNA, 410 bp, Homo sapiens
tgcccaagatgtctgcaaacaggacttccttaggtgagcgagattcaaagctccaaaacagtaagcattgtagacaaactataatcattttattgaggatttactgtgtgcaaagcacaagctcatgtcttaaattactttcagatgccactagtaattttgataataactacctaccaatgccaaatgctcaaactagtacccaactagttcccctaacattccagtaatccatcctcaatctcattacctcttacccactggactattttctaggaacctcttactcatccccaagttggctgagacaccaccataatttttttactttccaagacacaacttggaacaccctagaagcctgctcaaaaaccttcaatgaaccctcagagcctgcttaaaaaacagct

SEQ ID NO: 97483 - DNA, 519 bp, Homo sapiens
tttatctgtcactcataagtctgtgggtcagctgcaactcaggtgcatctccagactccaggtttctagttgcccatttggttttctcagcatcccacctgaaagcccaaccacttcctgaagaagtcccttcccatgggggaggtaagaagctccaagatgagggagaaacagtacgtgatgattcttaaggcttcagccccgcatttataccctgtccactctgctcacattccattggccaaggcaagtatcacagccaggtccagagtaaatcggatggagaagtgagcttcacccacagaaaaccaccagaaacatagaagaatcatagacaaataatactattcaccatgctaatcatcaaatgtgtgcctagcacagtgcctagcatgcagtcctctctcaattagaattttttgaaagacagaatgagaatatttaagcaaagctctgatcgaggtgtcttgctagtgttgtgggggcagatcagtcaagttatagcatactctctgccct

SEQ ID NO: 97484 - DNA, 857 bp, Homo sapiens
atgccaggtagatggcactggggatttcagactccagaactgaaaacaagctgagcatctggtggagccatccgctgatccaaaaggctgctctctacagatgaatgggtgttaagacagctgtccttcctagaccatgagcagctgctggccagggttgctgcctgccaaaagggtggagttgggagaaaccaggagtcaaccacagctaccacagtctaatgagttagtttgataccagggacatattaggaggacttgctgctgccacgagcttgcacatgactcttctcaactgcagaggaaaaccagtatgatgccaggctagaagcagcagcatcaccatcagcctggtcacattctacttatagcccactccatctgacagcataaagctagacctgccctgggctgctggtagcataaagccagacctgccctgggctgccaaaaaagtcttcctgaaagccatgaatgacatgcaaaggagaaatatgaaacatctaagtgaatatagaggagagggcatttctgatagacactcatgagtcaggcccacaggcttaaaacacagtgatacttgtactggtttcttacagctgctgtgacttaaaacaacagacattttttctctcatgattctggaggctgaaagtctgaaatcaatgtgttttcagggccatgctctctctgaagtctgtaaggaagaatcctccttttcctcttccagcttttggtggtttctggcattccttggtttgtgggaacctaaattcagtctctgcctccatcttcattcacatggcctcttccctgggtctctgtgtgtttctcacagtcttcttatgatgtcacca

SEQ ID NO: 97485 - DNA, 197 bp, Homo sapiens
atcatgcagggccttgtaggctaagtgtaagccctttggcttccacactcagaatgaattttggagacatcgcaggttttgagcagaaaagtggcatgctctgacttatactttaaaaagagaactctggcttctatgttgagaataaactttaggagggcagatgtggaaagcaggaagacctgttggaaggctgg

SEQ ID NO: 97486 - DNA, 507 bp, Homo sapiens
taccccctaaggtctcctgctctcaggaggtgatattgccaagagtgaggtggattggagttaggcatagggagggaagtgctgtcccagtcccagcatgagcctctggacagatggaggccacctgctgcaatggggaggacaggagtcaagcagattggggggttggcagcaggcagggggtggtgcagagatcaaaggtttggatggaaaaatgttcggttttaggtgcttctgagatatccaggtaaagaagtgagaagaagagttgtatttatggatctgaagctcagtgagaggtcacaaaatttggaattgtcattgtatttgaaatgaagtggatgagctctccaagaaagagaatttaaagagtgagatggatttgtaaagaattgtgaagtttagaaatagaatatgagaaatgggatatgcagagacaagtggaaatgaggaagagtagccagaaaagatagaaggaaaccaagagggtgtcaaacctggagaact

SEQ ID NO: 97487 - DNA, 666 bp, Homo sapiens
aggcggagcttgcagtgagctgagatcgcgccactgcgacagagcgagactccgtctcaaaaaagagatttgtaagggaccagcctggaagcagggaatcggtcaggatccgagtcaccctggagcctaggcagagatcagcgaaagccctcgctgatgcataggtctggaaggcgtggggctccgggaggctgagcagctggactcggcatgaccagaggtcgtgaggccgttccgcaggcttgggacgctcctgaccctcagaatcaagcgcgggccactgcattagcatgggagaaatggcagagatagggcttgagggagggatgcccgagattaaaggtattaaaggtaaattggtgtcgccgcaaaaccagcgtgggagccaggaaacgagagtttcagtctttcttcgctaattccagagatagctgcatatcacaggaggagaagcgacgcagccatttttcttcgttattatcaaatttggctgctgccggacgccgtagatttgtggctcacccacccttagcccacctctccgcggcttttcactaagtttgaacccgacccctcgccgtagagtgtgtaatttctgtctccgaagctgacgtcaacttctgaacgaaagctaggagcggaagagcgtgcgtggaaatggcgctc

SEQ ID NO: 97488 - DNA, 345 bp, Homo sapiens
cataatactgaatgggaaaagttaaaagcattccctctgagaactggaacaagacaaggatgcccactctcaccgctcctcttcaacatagtactggaagtcctagccatagcaatcagacaagagaaagaaataaagggtatccaaattggtaaaggggaagtcaaactgtcactgtttgctgatgatatgatctttaccttgtaaaccctacggactcctccagaaagctcctagaactgataaaagaattcagcaaagttcctggatacaagattaatgtacacaaatcagtagctcttctattacatcaacaacggccaagcagagaatcaaatcaagaac

SEQ ID NO: 97489 - DNA, 567 bp, Homo sapiens
ctttaatccatgtcaaactaagaaaataaagtcagggaaagatcatcacatttcttgaatgcagaggaatttggggaccaaaacttgaaaggaaataaggaaaggagaactatgcagaaggagaagttgaatatgccttcaaaactgggacatgagagagtctggctctgttgtcgcccaggctggagtgcagtggcgcgtctcggctcaccgcaagcttcgcctcccgggttcatgccattctcctgcctcagcctcctgaatagctgggagtacaggcgcctgccaccacgcctggctaatttttttgtatttttaggagagacagggtttcactgagttagccaggatggtctcaatctcctcacctcatgatctggctgccttggcctcccaaagtgctgggattatagctgtgagccactgcacccggtgtccactgatgatattcttatggagagcctcagatgtgaactatcagcagttcacaacctgcttttgaagaaatgtgttctgaaagaggatctgggtgatccacctaagcatccaaaacaatgaagaactacc

SEQ ID NO: 97490 - DNA, 667 bp, Homo sapiens
accacaagcccttttgcgcccaccatgtcttcacctaagagatcttcaaagcccagtatgtctctggcacccagtggatcctccatgcccactgcggatcccaagcctcctgcctccttgaagtccaccaaatcagcaacacccaacagatccttagtgcccaccaaaccagcgacatcccgtaactcagtcatgagcccaagcagttccaagtccaccaaatcgaccagtacaaaaagagccccttctaaccggcccagcagcaggtcccgagtccgcagcaaagcaagaacacccagcagggtgagcaccgacaccaggaccagcaaagccagcaaggccagcgacgtgagatgccaccagcggaggggcacacacagccggggtaggacacctggcagaaggggaagccgcagctccaagaggtcacccagcagggccagcactcctggcaggataagaactcatggtgccagaccaggcatggccagcagggtgagaactcccacttcacagcaaaaagggagccggggaaagagttacggccggcctagaaccagcaacagggaaaggagtgacagccagcctagaaatctgagcaagaagagttaccgcccaccaggaggctcaggtatagggaggagttccgagctggctgtaactccca

SEQ ID NO: 97491 - DNA, 351 bp, Homo sapiens
cagatggaatctcgctctgtcacccaggctggagtgcaatggcgtgatctcggctcaccgcaacctccgcctcctgggttcaagtgattctcctgcctcagcctcctgagtagctgggattacaggcgcccaccactgcgccaggctaatttttgtattgttagtaaagacagggtttcgccaggttggccaggctggttttgaactcctgacctcagatgaccctcccatctcggcctcccaaagtgctggggttacaggcacaagccactattcctggccggttgattattttcttctattctggggatatttttaaaaatccaacttcttagaaatttgaaatcagaa

SEQ ID NO: 97492 - DNA, 302 bp, Homo sapiens
gaaattacccaatctgaacaaaagagagaaaatatactgaaaaataaaaatgaacaaatcatcagggacttgtgggactatttttaaaagttctaatatttgtaccatcagagtcccaggggagaagaaagacgatatggttgaaaaggtattcaaagaaatgatagcttaaaattttcaaacttggcgaaggacatattcaagaagaacttaagaagttcagcaaactctgaacaggaaaatcccaaagaaatccactccaacatacattataaccaaatttctgaccactaaatataaaa

SEQ ID NO: 97493 - DNA, 424 bp, Homo sapiens
acatataggatggatataggcatgtccacttggctatggtccaggcaggtctggctaacacaagcagaaacaagtggggtcagttggggtttcctaacagccctgccttatctaataagggaagtttctctgatcaaaagaaaataataagaagcaaaggtacaaacatattaagcagtagttagtttagtcaagcttacgattatcagagaattgtaaagaagatccactactggggtaggagaaaggagctgtagcctttttaatgacctagactctaggaaagttagaggaaataaaattcctttttcttctatttgtagaagaaaagtgctatgtcttagtacacagaggaaatttatagatttagatgagagatcttctttccctttatgtgcattgtatcttggcttttcccactatg

SEQ ID NO: 97494 - DNA, 818 bp, Homo sapiens
cccagacggggtggcggccgggcagaggctgcaatctcggcactttgggaggccaaggcaggcggctgctccttgccctcgggccccgcggggccgtccgctcctccagccgctgcctcccgggcggcgctcgccggcgcggcggcaaagactgagacagctccgctgcccgctgaactccatcctcccggcggtcgggcggcggcggctgcggtcggtcgcggcagcggctccgcttcatatctgcagctggggctcgcgggcgtcagcgccgcgactgtcccggctccgcactgccccgcgccgcagcgcagccgcgccaaccaccacccgcggccaccatggccggacgggctccctaagcccaacttttcaagaatagtcagtacaataagatataaatagaaacaacaaaaagttaaaaagcaggagaacgaaattaagagacaagatctcactgtgttgcccagcctggagtgcagtggtgtgatcacagctcactgcagccttgaaatcctggtctcaaataatcctctagccttggcctcccaaagtacaagaattacaggcaatggtcactgcacctggcctggatccacttttaaatttgtcaagaggttatgaccaagaaaatttagaatgatttatcattctaaatatataaaaatattatgtattctcatgcaatgtatcgactctacaaaagagatgccctcccccacagacacacacacactcacactcactcttatctttacttccactaaaacacactcctgtctcaattttaactgtagttggtatctccagtagaaaga

SEQ ID NO: 97495 - DNA, 692 bp, Homo sapiens
accatgttgcccaggctggtctggaattcctggacttaagtgatcctcttgcctcggcctcccaaaagtgctgggattacagatgtgagccacggtgcccagccctgaaaccttttctaaagctctttaaccctgtagcgcattctggctgggcctggaggacaggacatgggaacccagtctcacggcagaggccacatcagtgggtccccacagtccagggggcacttctgggtggctggagagccctgtgccagagccacgtggccatgagcttttctcctctgtgggctcagcacaccccagaagaagtgactgctcctttatgaccctctttatctgccccggagagggtcctggcataatcccagatgctgtggcctcggccctccgggacagcacatggcacctgcatctcccagctgcagctgtagaggcaggagtgatccgaggatgttaatgccaagtccaaattggtgatttgatttttctagtgctaactttgaaatgtagccagtagagtaattatgagtttattgtagtcaatttattatgcagcatttagaacaacatgttttgttgattactgctactgccagattgctggtggcatttatagtccattgttgtattgaaattgatctgccgagcgcctactgcgttcggtaaataataaatcagtctgttatccc

SEQ ID NO: 97496 - DNA, 358 bp, Homo sapiens
cttcacattgcccatcttcttttgcagagtgttatatccaggtgtatgtgcccagctctcctaccagactgttcatctgcctgtggcacggctccttgcacacagtacgtacaaggcttggtaacagaatcccatgttcattgaagggcctagactgatcacattttaaataatgcacaatgttctcacgtctatttaaggaagaaacaactgatttctatcttttaagattgcatttcaagaccatatcaaaggctttgaatctctcaccaagactaacaatgaaaaacaaatttggccaagtgcagtggctcacacctgtaatcccagcatcttggaaggccgaggtgggtggatc

SEQ ID NO: 97497 - DNA, 212 bp, Homo sapiens
cacatacacactctcacacatggtctctcacagacacactcacacctgttctttctgtcacatacacacactctctcacacatgtacacacacacacacacccctctaccactcataaggtggctgttcctcggggtctagcatctgtttgactttctttgttctggaaaggcttcttgtcagcactgtcctttccaagatctgcactgcac

SEQ ID NO: 97498 - DNA, 361 bp, Homo sapiens
ccatgaaaccaggttaaaaccaccaagggaataattatggccaaagaagagaagatgaccaagtactgagccctggggtcctccaagataaggaggtcagaggaggaggagaaagcagccaaaggactgagaaggatgaaacgaggagcctagcgtcctgaagtgaagtgtaggatgtgtatcacgcggaggcacgatcatctgtgccagatggtgctgctggagatcctaaagaggcagttttggtggaatgctagggaaaaatctgctcagagtgagtttaagagataacagaaggagaagaattggcaatagtccttttaagttttgctgtagaggggtggaaagaaaagagtgctag

SEQ ID NO: 97499 - DNA, 497 bp, Homo sapiens
cagcgaggacacaaagtcccagcctcagcagccctcagagaagagcaacttggtattacagcttgtgctatggtaggtgggatagggttgtttcaagagtaggggaggagggagagtagaaaggaagggagggagggaaaacattctcttatccttgggaaacttgcaggatcacttccctcaatgagtttatgcaagcaatctccacctcccactgctccttacaggtcagcgaacccattcagggattaggaagtgacccaaaagcaccggtgtgaggagaggctgcatagcagtggaaacgcttggagagaatgctgcatcctgtttaacttggccttgccaatgccaaaccctttctctgtggatgttttttttagttaaagagcgataacgtcctccttttaatggcctttcctctcacggaatgggctattctctgtacttgtgtacccactctcactgtgtcacttaaactctcctgctttagcctcctc

SEQ ID NO: 97500 - DNA, 103 bp, Homo sapiens
tctcccactggagcaccctgtctcccagggagcaccctgtctcccactggagcaccctgtctcccagggagcaccctgtctcccactcaagcaccctgcctcc

SEQ ID NO: 97501 - DNA, 562 bp, Homo sapiens
aaagctaaatacaatccagttcttgcactcgagaagctcacatctacatgggtatgtgtgtgtgtgtgcatgcacgtgcacgtatgggtatgcatgtgtgtgtgtgtgcagtaaagcagcaagggtgaaaacaagaaaaaggataaaagcaaaacaaagcatgcaatgtgaaaagtgcaagagagaagggagagtgagtctgatgggggctgagggcttgagggtccccttggtgggggttggtggagagtcctctgaatgagcacttctggagctgaaccctcaggagctggcttcaggggctgggagagcctgcagctgggtgagcctctgcactgcctgcctgtaggaccttaggggagttgcttgcatcttttcttgtttcattctcttctctgtaaaacagataatcctaacactgtccacatgaagaggtgttctcaggattaaaccatataatggatgtaaagtatcaaaattgttggtgccacttgatgggggtttcattgttggctggggactgtggcagaagaggggaaagggcacttatggctgagaggct

SEQ ID NO: 97502 - DNA, 340 bp, Homo sapiens
agccaaccagtatgatagtattggattcccagaaggggaagtgcaaacccatggtagtagagaaattatttggagaataaaatcatcaaaatttttcaaattggttaaagacaaaaatctacaaattcaagtaacttaaagaactgcatatagcataaagtcaaagagactcagacctatatgtgttatcatccaactctaaaagccagacaaagagataatctttaaataacaagagattttgggagccgaggcaggcggatcacctgaggtcaggagttcgagaccagcctggctaacatggtgaaaccctatttctactaaaaatagaaaaaattag

SEQ ID NO: 97503 - DNA, 3516 bp, Homo sapiens
tcggaataacccgtgtgttctctgcaccgataagaacctgcctgaatcacatgcaagcgagaaacctgccgttgctttgattggactccataccagctccttcacgagctccctaagcctgcgctacttcacctacgggattctctttggttgtggctgttccttcgcctttcagccatccctcgtcatcctgggccactactttcaacgccgcctgggtctggccaatggtgtggtgtctgctgggagtagcattttctccatgtccttccccttcctcatcagaatgctgggggataagatcaagctggcccaaaccttccaggtgctgagtaccttcatgtttgttcttatgctgctttcactcacctaccggcccctcctgcccagctcccaggacaccccaagcaagagaggtgtccgcaccctgcaccagcgctttctggctcagctcaggaagtacttcaacatgcgagtgttccgccaacgcacttaccgcatctgggccttcggaattgctgctgctgcccttggctactttgttccctatgtacacctgatgaagtatgtggaggaggagttctcagaaatcaaggagacctgggtgctcttggtgtgtattggggctacctcaggccttgggcgtcttgtgtcaggccacatcagtgactccatccctggacttaagaagatctacttgcaggtcctttccttcctgctcctgggcctgatgtccatgatgattcccctgtgccgggacttcgggggccttatcgtcgtctgtcttttcctgggcctttgcgatggcttcttcatcaccatcatggcccccattgcatttgagctggtgggcccaatgcaggcctcacaggccattggctacctcctgggcatgatggccctgccaatgattgctgggccccccattgcaggcctactccgcaactgttttggggactaccatgtggccttctactttgccggtgtgccccccatcatcggggctgtaatcctcttcttcgtccctctgatgcatcaaaggatgttcaagaaagagcagagagattccagcaaggataagatgttggcccctgacccagaccccaatggggagctactgccgggctcccccaaccctgaggaaccaatctaatgcctttcttgccattgtgtgccctttcccagctcttccccttcatcccaccctgctcagcatttacatttttgccaccagcacacttgttcccagacctgcgcacacagcatttcagccacctgacaatctccttggagtcaaagctccaggtgttccaaactcattaactaaattctccccagaatgcttttaaattttccagggcctttctcctcccaggatctgggaaagcttgggaaccacccctggcctttggaacctctccatatactttctaagctctgggggaggaggaggatgggacctcctggacccagcttgttagtcacccactataatcaactgccaaaggtgctactgtgtccccaggagcctaatagggtaggcccaaatctctgtttgctgaggaggtcattgccatccatatttgggagccactgggtggaggggcagggaggcaaaatgagacaagtagccttggttagtcttagagttgctgatgactgtggcttcccaagaactgggtacaagcagtgcccttattgtatggttggttaacagtctgctcccctcttcccttccttctttttttcctctactgacttctctccatactctttcccctctatttctttgtatgactgtcatagacacatgggtgcttgaagaaaggagggacccggaacttgggccaatcagcctcaccttgtcccagtccactcctaacactagcatcagtcccactcatctcaggctgagccacatctcactttttcgctcaagctatataatcctagactggaagagtagaatatcatatagggaagaaaccttaaacaccacagtgttccatgttccagtcactgatttttacaaatcttacagtccaaggcattaacctcaaggccctcccagcaccccattcttgtatacacatggcaaaatgtgaagaaactcctttcatctcagcaggtagaggaggactgatgacacgagctgccatggcgggaggaggggcagtagttattgatatggtgagccccatctctcagttttcatgacaggtctatatttctacctgggccaggccaggaaagagactatttaagaaaaaaaaaatcaattcctagcctggatcccaaaaaggtacaggcagcagttgcacatagggttggaaaatttcttttgggaaggggaagccatcccagcctttaccacccaatgtgtctcccatgctgggcatcctaggccactttgcttagagggcattaaaggtgccatgaaaggtagactctgaaccactttgatccctctgaagtaggtgactgatgcctccttatgcccaggctctggcaacagtcttactgaagaacattcccagtgcccctggctaggggcagagggcactgccaggctgtgttcagttagcacagctcacctcattaggagctcagcctctctcctcactctgcctctttgtgtctctttttctcctctctgagcctttgtctattgtgttcctgtcacccaccctttcatcatctttttgccaggcattcctggctgtcacttggagccaacagtaacttgccaccttaaggcagggtcatccccgggccaggaggatgaggttgtcctgaggggctccaaagaagacaatagttcccactcatgattttccgttacaaacaggcagctggggcatggttggcctccaatgatttcattcaaggccaaagtcctgagccccctccgctggtcccagtccagctcttatcaactccccaaaggaaaacccactggttcttagctctgtgggtaggaaggggccctagaaagggcctagttactatcctgtcagttctaacagtagtggaacaggagaatctgggccctaggagccctgtaactcccaggagagaccactgaaaatactggagcaacaatgcccctgcttccatttctccccacctcactctcaccaagtcaccagagggtggttctgtaggacctcttttgttgcttaagatgcagatggctcttaagaatcaggcagtcgcccacttctctccagatgaagggaagacattcataggtcccaaatctgcccattcagatgtcacataatatggtgggatatcaatttacttcttccacacatgtggttgtgcacatgtgagcttgtgtgcttttggagagaatgttgattggcaaaagcagcacagtattaatatttagagtaggatgcagcctcttatgcaccacagttaaatctagaacgaacaaaatttcagagctcaagacatgggacatttaaatcctcaaggagtttggaacaaaataaacagatctaaaaattt

SEQ ID NO: 97504 - DNA, 4317 bp, Homo sapiens
gggttcagtagtttgggaagggagctgggggaggcagtggcggctggagtaggtaggcgagtaaaaggaggaggaagggctggggagaagagcgaggctgtagcggctgcctgttgagggaggaagaggtggggggtgtggaggagggggaggagagagagatgacatggggagaggaggaggggggttggacgtgggaggaggaggagagggctcgagggaccgtctgtcgcgggacgggctggccagctggggcgcggagcctggaggaggaggcagcggcagcggcagcagcagccctccgagcagcagcagctgcagcagcagaaacaagtaccagccacaaagcggctcctctggcccaagcagccacagtccccccgccgcgatggcgctgcaaagccaggcgagcgaggaagcaaaggggccctggcaggaggcagaccaggaacagcaggagccggtgggtagcccagagccggagtctgagccggagcctgagcccgagcccgagcccgtgccagtgcccccgcccgagccccagccggagccccagcccctaccggaccccgcacccctgccggagctggagttcgagtccgagcgggtgcacgaacccgagcccacgcctacggtagagacccgcggcaccgcgcgcggcttccagcctcccgaaggtggcttcggctgggtggtggtgttcgctgccacctggtgcaacggctccatcttcggcatccataactctgtcgggatcctctactccatgctgctagaggaggaaaaggaaaaaaatcgccaagtggagttccaagcagcatgggtcggagccctcgcgatgggtatgatcttcttctgttctcccattgtgagtatattcactgaccgtttgggctgccgaatcacagcaaccgcgggggctgccgttgctttcattggcctccataccagctccttcaccagctccctaagcctgcgctacttcacctacgggattctctttggttgtggctgttccttcgcctttcagccatccctcgtcatcctgggccactactttcaacgccgcctgggtctggccaatggtgtggtgtctgctgggagtagcattttctccatgtccttccccttcctcatcagaatgctgggggataagatcaagctggcccaaaccttccaggtgctgagtaccttcatgtttgttcttatgctgctttcactcacctaccggcccctcctgcccagctcccaggacaccccaagcaagagaggtgtccgcaccctgcaccagcgctttctggctcagctcaggaagtacttcaacatgcgagtgttccgccaacgcacttaccgcatctgggccttcggaattgctgctgctgcccttggctactttgttccctatgtacacctgatgaagtatgtggaggaggagttctcagaaatcaaggagacctgggtgctcttggtgtgtattggggctacctcaggccttgggcgtcttgtgtcaggccacatcagtgactccatccctggacttaagaagatctacttgcaggtcctttccttcctgctcctgggcctgatgtccatgatgattcccctgtgccgggacttcgggggccttatcgtcgtctgtcttttcctgggcctttgcgatggcttcttcatcaccatcatggcccccattgcatttgagctggtgggcccaatgcaggcctcacaggccattggctacctcctgggcatgatggccctgccaatgattgctgggccccccattgcaggcctactccgcaactgttttggggactaccatgtggccttctactttgccggtgtgccccccatcatcggggctgtaatcctcttcttcgtccctctgatgcatcaaaggatgttcaagaaagagcagagagattccagcaaggataagatgttggcccctgacccagaccccaatggggagctactgccgggctcccccaaccctgaggaaccaatctaatgcctttcttgccattgtgtgccctttcccagctcttccccttcatcccaccctgctcagcatttacatttttgccaccagcacacttgttcccagacctgcgcacacagcatttcagccacctgacaatctccttggagtcaaagctccaggtgttccaaactcattaactaaattctccccagaatgcttttaaattttccagggcctttctcctcccaggatctgggaaagcttgggaaccacccctggcctttggaacctctccatatactttctaagctctgggggaggaggaggatgggacctcctggacccagcttgttagtcacccactataatcaactgccaaaggtgctactgtgtccccaggagcctaatagggtaggcccaaatctctgtttgctgaggaggtcattgccatccatatttgggagccactgggtggaggggcagggaggcccaagaactgggtacaagcagtgcccttattgtatggttggttaacagtctgctcccctcttcccttccttctttttttcctctactgacttctctccatactctttcccctctatttctttgtatgactgtcatagacacatgggtgcttgaagaaaggagggacccggaacttgggccaatcagcctcaccttgtcccagtccactcctaacactagcatcagtcccactcatctcaggctgagccacatctcactttttcgctcaagctatataatcctagactggaagagtagaatatcatatagggaagaaaccttaaacaccacagtgttccatgttccagtcactgatttttacaaatcttacagtccaaggcattaacctcaaggccctcccagcaccccattcttgtatacacatggcaaaatgtgaagaaactcctttcatctcagcaggtagaggaggactgatgacacgagctgccatggcgggaggaggggcagtagttattgatatggtgagccccatctctcagttttcatgacaggtctatatttctacctgggccaggccaggaaagagactatttaagaaaaaaaaaatcaattcctagcctggatcccaaaaaggtacaggcagcagttgcacatagggttggaaaatttcttttgggaaggggaagccatcccagcctttaccacccaatgtgtctcccatgctgggcatcctaggccactttgcttagagggcattaaaggtgccatgaaaggtagactctgaaccactttgatccctctgaagtaggtgactgatgcctccttatgcccaggctctggcaacagtcttactgaagaacattcccagtgcccctggctaggggcagagggcactgccaggctgtgttcagttagcacagctcacctcattaggagctcagcctctctcctcactctgcctctttgtgtctctttttctcctctctgagcctttgtctattgtgttcctgtcacccaccctttcatcatctttttgccaggcattcctggctgtcacttggagccaacagtaacttgccaccttaaggcagggtcatccccgggccaggaggatgaggttgtcctgaggggctccaaagaagacaatagttcccactcatgattttccgttacaaacaggcagctggggcatggttggcctccaatgatttcattcaaggccaaagtcctgagccccctccgctggtcccagtccagctcttatcaactccccaaaggaaaacccactggttcttagctctgtgggtaggaaggggccctagaaagggcctagttactatcctgtcagttctaacagtagtggaacaggagaatctgggccctaggagccctgtaactcccaggagagaccactgaaaatactggagcaacaatgcccctgcttccatttctccccacctcactctcaccaagtcaccagagggtggttctgtaggacctcttttgttgcttaagatgcagatggctcttaagaatcaggcagtcgcccacttctctccagatgaagggaagacattcataggtcccaaatctgcccattcagatgtcacataatatggtgggatatcaatttacttcttccacacatgtggttgtgcacatgtgagcttgtgtgcttttggagagaatgttgattggcaaaagcagcacagtattaatatttagagtaggatgcagcctcttatgcaccacagttaaatctagaacgaacaaaatttcagagctcaagacatgggacatttaaatcctcaaggagtttggaacaaaataaacagatctaaaaattt

SEQ ID NO: 97505 - DNA, 1698 bp, Homo sapiens
tcaagctatataatcctagactggaagagtagaatatcatatagggaagaaaccttaaacacaccagtgttccatgtcccactcatctcaggctgagccacatctcactttttcgctcaagctatataatcctagactggaagagtagaatatcatatagggaagaaaccttaaacaccacagtgttccatgttccagtcactgatttttacaaatcttacagtccaaggcattaacctcaaggccctcccagcaccccattcttgtatacacatggcaaaatgtgaagaaactcctttcatctcagcaggtagaggaggactgatgacacgagctgccatggcgggaggaggggcagtagttattgatatggtgagccccatctctcagttttcatgacaggtctatatttctacctgggccaggccaggaaagagactatttaagaaaaaaaaaatcaattcctagcctggatcccaaaaaggtacaggcagcagttgcacatagggttggaaaatttcttttgggaaggggaagccatcccagcctttaccacccaatgtgtctcccatgctgggcatcctaggccactttgcttagagggcattaaaggtgccatgaaaggtagactctgaaccactttgatccctctgaagtaggtgactgatgcctccttatgcccaggctctggcaacagtcttactgaagaacattcccagtgcccctggctaggggcagagggcactgccaggctgtgttcagttagcacagctcacctcattaggagctcagcctctctcctcactctgcctctttgtgtctctttttctcctctctgagcctttgtctattgtgttcctgtcacccaccctttcatcatctttttgccaggcattcctggctgtcacttggagccaacagtaacttgccaccttaaggcagggtcatccccgggccaggaggatgaggttgtcctgaggggctccaaagaagacaatagttcccactcatgattttccgttacaaacaggcagctggggcatggttggcctccaatgatttcattcaaggccaaagtcctgagccccctccgctggtcccagtccagctcttatcaactccccaaaggaaaacccactggttcttagctctgtgggtaggaaggggccctagaaagggcctagttactatcctgtcagttctaacagtagtggaacaggagaatctgggccctaggagccctgtaactcccaggagagaccactgaaaatactggagcaacaatgcccctgcttccatttctccccacctcactctcaccaagtcaccagagggtggttctgtaggacctcttttgttgcttaagatgcagatggctcttaagaatcaggcagtcgcccacttctctccagatgaagggaagacattcataggtcccaaatctgcccattcagatgtcacataatatggtgggatatcaatttacttcttccacacatgtggttgtgcacatgtgagcttgtgtgcttttggagagaatgttgattggcaaaagcagcacagtattaatatttagagtaggatgcagcctcttatgcaccacagttaaatctagaacgaacaaaatttcagagctcaagacatgggacatttaaatcctcaaggagtttggaacaaaataaacagatctaaaaattt

SEQ ID NO: 97506 - DNA, 4371 bp, Homo sapiens
gggttcagtagtttgggaagggagctgggggaggcagtggcggctggagtaggtaggcgagtaaaaggaggaggaagggctggggagaagagcgaggctgtagcggctgcctgttgagggaggaagaggtggggggtgtggaggagggggaggagagagagatgacatggggagaggaggaggggggttggacgtgggaggaggaggagagggctcgagggaccgtctgtcgcgggacgggctggccagctggggcgcggagcctggaggaggaggcagcggcagcggcagcagcagccctccgagcagcagcagctgcagcagcagaaacaagtaccagccacaaagcggctcctctggcccaagcagccacagtccccccgccgcgatggcgctgcaaagccaggcgagcgaggaagcaaaggggccctggcaggaggcagaccaggaacagcaggagccggtgggtagcccagagccggagtctgagccggagcctgagcccgagcccgagcccgtgccagtgcccccgcccgagccccagccggagccccagcccctaccggaccccgcacccctgccggagctggagttcgagtccgagcgggtgcacgaacccgagcccacgcctacggtagagacccgcggcaccgcgcgcggcttccagcctcccgaaggtggcttcggctgggtggtggtgttcgctgccacctggtgcaacggctccatcttcggcatccataactctgtcgggatcctctactccatgctgctagaggaggaaaaggaaaaaaatcgccaagtggagttccaagcagcatgggtcggagccctcgcgatgggtatgatcttcttctgttctcccattgtgagtatattcactgaccgtttgggctgccgaatcacagcaaccgcgggggctgccgttgctttcattggcctccataccagctccttcaccagctccctaagcctgcgctacttcacctacgggattctctttggttgtggctgttccttcgcctttcagccatccctcgtcatcctgggccactactttcaacgccgcctgggtctggccaatggtgtggtgtctgctgggagtagcattttctccatgtccttccccttcctcatcagaatgctgggggataagatcaagctggcccaaaccttccaggtgctgagtaccttcatgtttgttcttatgctgctttcactcacctaccggcccctcctgcccagctcccaggacaccccaagcaagagaggtgtccgcaccctgcaccagcgctttctggctcagctcaggaagtacttcaacatgcgagtgttccgccaacgcacttaccgcatctgggccttcggaattgctgctgctgcccttggctactttgttccctatgtacacctgatgaagtatgtggaggaggagttctcagaaatcaaggagacctgggtgctcttggtgtgtattggggctacctcaggccttgggcgtcttgtgtcaggccacatcagtgactccatccctggacttaagaagatctacttgcaggtcctttccttcctgctcctgggcctgatgtccatgatgattcccctgtgccgggacttcgggggccttatcgtcgtctgtcttttcctgggcctttgcgatggcttcttcatcaccatcatggcccccattgcatttgagctggtgggcccaatgcaggcctcacaggccattggctacctcctgggcatgatggccctgccaatgattgctgggccccccattgcaggcctactccgcaactgttttggggactaccatgtggccttctactttgccggtgtgccccccatcatcggggctgtaatcctcttcttcgtccctctgatgcatcaaaggatgttcaagaaagagcagagagattccagcaaggataagatgttggcccctgacccagaccccaatggggagctactgccgggctcccccaaccctgaggaaccaatctaatgcctttcttgccattgtgtgccctttcccagctcttccccttcatcccaccctgctcagcatttacatttttgccaccagcacacttgttcccagacctgcgcacacagcatttcagccacctgacaatctccttggagtcaaagctccaggtgttccaaactcattaactaaattctccccagaatgcttttaaattttccagggcctttctcctcccaggatctgggaaagcttgggaaccacccctggcctttggaacctctccatatactttctaagctctgggggaggaggaggatgggacctcctggacccagcttgttagtcacccactataatcaactgccaaaggtgctactgtgtccccaggagcctaatagggtaggcccaaatctctgtttgctgaggaggtcattgccatccatatttgggagccactgggtggaggggcagggaggcaaaatgagacaagtagccttggttagtcttagagttgctgatgactgtggcttcccaagaactgggtacaagcagtgcccttattgtatggttggttaacagtctgctcccctcttcccttccttctttttttcctctactgacttctctccatactctttcccctctatttctttgtatgactgtcatagacacatgggtgcttgaagaaaggagggacccggaacttgggccaatcagcctcaccttgtcccagtccactcctaacactagcatcagtcccactcatctcaggctgagccacatctcactttttcgctcaagctatataatcctagactggaagagtagaatatcatatagggaagaaaccttaaacaccacagtgttccatgttccagtcactgatttttacaaatcttacagtccaaggcattaacctcaaggccctcccagcaccccattcttgtatacacatggcaaaatgtgaagaaactcctttcatctcagcaggtagaggaggactgatgacacgagctgccatggcgggaggaggggcagtagttattgatatggtgagccccatctctcagttttcatgacaggtctatatttctacctgggccaggccaggaaagagactatttaagaaaaaaaaaatcaattcctagcctggatcccaaaaaggtacaggcagcagttgcacatagggttggaaaatttcttttgggaaggggaagccatcccagcctttaccacccaatgtgtctcccatgctgggcatcctaggccactttgcttagagggcattaaaggtgccatgaaaggtagactctgaaccactttgatccctctgaagtaggtgactgatgcctccttatgcccaggctctggcaacagtcttactgaagaacattcccagtgcccctggctaggggcagagggcactgccaggctgtgttcagttagcacagctcacctcattaggagctcagcctctctcctcactctgcctctttgtgtctctttttctcctctctgagcctttgtctattgtgttcctgtcacccaccctttcatcatctttttgccaggcattcctggctgtcacttggagccaacagtaacttgccaccttaaggcagggtcatccccgggccaggaggatgaggttgtcctgaggggctccaaagaagacaatagttcccactcatgattttccgttacaaacaggcagctggggcatggttggcctccaatgatttcattcaaggccaaagtcctgagccccctccgctggtcccagtccagctcttatcaactccccaaaggaaaacccactggttcttagctctgtgggtaggaaggggccctagaaagggcctagttactatcctgtcagttctaacagtagtggaacaggagaatctgggccctaggagccctgtaactcccaggagagaccactgaaaatactggagcaacaatgcccctgcttccatttctccccacctcactctcaccaagtcaccagagggtggttctgtaggacctcttttgttgcttaagatgcagatggctcttaagaatcaggcagtcgcccacttctctccagatgaagggaagacattcataggtcccaaatctgcccattcagatgtcacataatatggtgggatatcaatttacttcttccacacatgtggttgtgcacatgtgagcttgtgtgcttttggagagaatgttgattggcaaaagcagcacagtattaatatttagagtaggatgcagcctcttatgcaccacagttaaatctagaacgaacaaaatttcagagctcaagacatgggacatttaaatcctcaaggagtttggaacaaaataaacagatctaaaaattt

SEQ ID NO: 97507 - DNA, 3073 bp, Homo sapiens
gtttctgtcctgctccaggaaagtaagcagtaggggattctggatatgcctacagttaaccagtcagctcctctttctcctcctgtttctggggatccttgtgctatgcttttcagatgaagtatgtggaggaggagttctcagaaatcaaggagacctgggtgctcttggtgtgtattggggctacctcaggccttgggcgtcttgtgtcaggccacatcagtgactccatccctggacttaagaagatctacttgcaggtcctttccttcctgctcctgggcctgatgtccatgatgattcccctgtgccgggacttcgggggccttatcgtcgtctgtcttttcctgggcctttgcgatggcttcttcatcaccatcatggcccccattgcatttgagctggtgggcccaatgcaggcctcacaggccattggctacctcctgggcatgatggccctgccaatgattgctgggccccccattgcaggcctactccgcaactgttttggggactaccatgtggccttctactttgccggtgtgccccccatcatcggggctgtaatcctcttcttcgtccctctgatgcatcaaaggatgttcaagaaagagcagagagattccagcaaggataagatgttggcccctgacccagaccccaatggggagctactgccgggctcccccaaccctgaggaaccaatctaatgcctttcttgccattgtgtgccctttcccagctcttccccttcatcccaccctgctcagcatttacatttttgccaccagcacacttgttcccagacctgcgcacacagcatttcagccacctgacaatctccttggagtcaaagctccaggtgttccaaactcattaactaaattctccccagaatgcttttaaattttccagggcctttctcctcccaggatctgggaaagcttgggaaccacccctggcctttggaacctctccatatactttctaagctctgggggaggaggaggatgggacctcctggacccagcttgttagtcacccactataatcaactgccaaaggtgctactgtgtccccaggagcctaatagggtaggcccaaatctctgtttgctgaggaggtcattgccatccatatttgggagccactgggtggaggggcagggaggcaaaatgagacaagtagccttggttagtcttagagttgctgatgactgtggcttcccaagaactgggtacaagcagtgcccttattgtatggttggttaacagtctgctcccctcttcccttccttctttttttcctctactgacttctctccatactctttcccctctatttctttgtatgactgtcatagacacatgggtgcttgaagaaaggagggacccggaacttgggccaatcagcctcaccttgtcccagtccactcctaacactagcatcagtcccactcatctcaggctgagccacatctcactttttcgctcaagctatataatcctagactggaagagtagaatatcatatagggaagaaaccttaaacaccacagtgttccatgttccagtcactgatttttacaaatcttacagtccaaggcattaacctcaaggccctcccagcaccccattcttgtatacacatggcaaaatgtgaagaaactcctttcatctcagcaggtagaggaggactgatgacacgagctgccatggcgggaggaggggcagtagttattgatatggtgagccccatctctcagttttcatgacaggtctatatttctacctgggccaggccaggaaagagactatttaagaaaaaaaaaatcaattcctagcctggatcccaaaaaggtacaggcagcagttgcacatagggttggaaaatttcttttgggaaggggaagccatcccagcctttaccacccaatgtgtctcccatgctgggcatcctaggccactttgcttagagggcattaaaggtgccatgaaaggtagactctgaaccactttgatccctctgaagtaggtgactgatgcctccttatgcccaggctctggcaacagtcttactgaagaacattcccagtgcccctggctaggggcagagggcactgccaggctgtgttcagttagcacagctcacctcattaggagctcagcctctctcctcactctgcctctttgtgtctctttttctcctctctgagcctttgtctattgtgttcctgtcacccaccctttcatcatctttttgccaggcattcctggctgtcacttggagccaacagtaacttgccaccttaaggcagggtcatccccgggccaggaggatgaggttgtcctgaggggctccaaagaagacaatagttcccactcatgattttccgttacaaacaggcagctggggcatggttggcctccaatgatttcattcaaggccaaagtcctgagccccctccgctggtcccagtccagctcttatcaactccccaaaggaaaacccactggttcttagctctgtgggtaggaaggggccctagaaagggcctagttactatcctgtcagttctaacagtagtggaacaggagaatctgggccctaggagccctgtaactcccaggagagaccactgaaaatactggagcaacaatgcccctgcttccatttctccccacctcactctcaccaagtcaccagagggtggttctgtaggacctcttttgttgcttaagatgcagatggctcttaagaatcaggcagtcgcccacttctctccagatgaagggaagacattcataggtcccaaatctgcccattcagatgtcacataatatggtgggatatcaatttacttcttccacacatgtggttgtgcacatgtgagcttgtgtgcttttggagagaatgttgattggcaaaagcagcacagtattaatatttagagtaggatgcagcctcttatgcaccacagttaaatctagaacgaacaaaatttcagagctcaagacatgggacatttaaatcctcaaggagtttggaacaaaataaacagatctaaaaattt

SEQ ID NO: 97508 - DNA, 2520 bp, Homo sapiens
gggttcagtagtttgggaagggagctgggggaggcagtggcggctggagtaggtaggcgagtaaaaggaggaggaagggctggggagaagagcgaggctgtagcggctgcctgttgagggaggaagaggtggggggtgtggaggagggggaggagagagagatgacatggggagaggaggaggggggttggacgtgggaggaggaggagagggctcgagggaccgtctgtcgcgggacgggctggccagctggggcgcggagcctggaggaggaggcagcggcagcggcagcagcagccctccgagcagcagcagctgcagcagcagaaacaagtaccagccacaaagcggctcctctggcccaagcagccacagtccccccgccgcgatggcgctgcaaagccaggcgagcgaggaagcaaaggggccctggcaggaggcagaccaggaacagcaggagccggtgggtagcccagagccggagtctgagccggagcctgagcccgagcccgagcccgtgccagtgcccccgcccgagccccagccggagccccagcccctaccggaccccgcacccctgccggagctggagttcgagtccgagcgggtgcacgaacccgagcccacgcctacggtagagacccgcggcaccgcgcgcggcttccagcctcccgaaggtggcttcggctgggtggtggtgttcgctgccacctggtgcaacggctccatcttcggcatccataactctgtcgggatcctctactccatgctgctagaggaggaaaaggaaaaaaatcgccaagtggagttccaagcagcatgggtcggagccctcgcgatgggtatgatcttcttctgttctcccattgtgagtatattcactgaccgtttgggctgccgaatcacagcaaccgcgggggctgccgttgctttcattggcctccataccagctccttcaccagctccctaagcctgcgctacttcacctacgggattctctttggttgtggctgttccttcgcctttcagccatccctcgtcatcctgggccactactttcaacgccgcctgggtctggccaatggtgtggtgtctgctgggagtagcattttctccatgtccttccccttcctcatcagaatgctgggggataagatcaagctggcccaaaccttccaggtgctgagtaccttcatgtttgttcttatgctgctttcactcacctaccggcccctcctgcccagctcccaggacaccccaagcaagagaggtgtccgcaccctgcaccagcgctttctggctcagctcaggaagtacttcaacatgcgagtgttccgccaacgcacttaccgcatctgggccttcggaattgctgctgctgcccttggctactttgttccctatgtacacctgatgaagtatgtggaggaggagttctcagaaatcaaggagacctgggtgctcttggtgtgtattggggctacctcaggccttgggcgtcttgtgtcaggccacatcagtgactccatccctggacttaagaagatctacttgcaggtcctttccttcctgctcctgggcctgatgtccatgatgattcccctgtgccgggacttcgggggccttatcgtcgtctgtcttttcctgggcctttgcgatggcttcttcatcaccatcatggcccccattgcatttgagctggtgggcccaatgcaggcctcacaggccattggctacctcctgggcatgatggccctgccaatgattgctgggccccccattgcaggcctactccgcaactgttttggggactaccatgtggccttctactttgccggtgtgccccccatcatcggggctgtaatcctcttcttcgtccctctgatgcatcaaaggatgttcaagaaagagcagagagattccagcaaggataagatgttggcccctgacccagaccccaatggggagctactgccgggctcccccaaccctgaggaaccaatctaatgcctttcttgccattgtgtgccctttcccagctcttccccttcatcccaccctgctcagcatttacatttttgccaccagcacacttgttcccagacctgcgcacacagcatttcagccacctgacaatctccttggagtcaaagctccaggtgttccaaactcatttttttcaccactctgtgcatgtcgatggatggccccaagaacacagcatgtgttgattttggggttacaaaatatagcttagtatagtaggcaaattcacaaatacggatagctgtgaataatgaggactgacggtatttgccaagagccacatggagaggcttatttgttagtgcgctgataccatttggtctctgatgtagatgtcaaagggatagaagctagggagtgtgtcactgtgtgtgtgtgtgttggcgggagatgcggcccatcaggtaggcttgatggggttaggcttgaggggaaggacacatctgtgcacactccgaatcacatagaggaac

SEQ ID NO: 97509 - DNA, 476 bp, Homo sapiens
gcctaactgctgggggcaggctactgggacaccgctggattttggtaggagtcactcagtgattgaataaagcccgaatcccacagaccctaaggatgctcctgcacaaaaaaccaactgaaataatgcccaaagaataatgctttgctaaggcagggaagattgcatttgtttttataacagtctaccttcaaaaaaaggtagtcctttctatagctataattaagtcattatttgtgtcattatgagttttaagtgtatctttccctctagttatttgtatggctcaatcctgtatatctagtgcctctctcaggatatatgataaatgtttgtgaggatggatatgttaattagcttgatttaattattccacatttgtattacaaaatcatagcatcattttgtactctataaatacatacaactataacttgtctatttacaataaactttttataacaaggaaaaaaaaa

SEQ ID NO: 97510 - DNA, 2128 bp, Homo sapiens
tcctggaacatcaagagtgtgaagactgaagataacctgaggcctaccagacatcctatattcaccaagattcacattttttggtatgtgtgcctacattttagcaaaaattggttggttaatccttctaaaattagagggatgacattgggtaacaaagtcttcccagcctttggcattatagtaatttctcgcaatagaaattccatacagatattattgccagtgaagagagctattcttgtttattatcagttctatatttttagctgaagcaacttagccctaaaaaaccccaaaatcaacttcttcctccaaattaaactctcccccaaatttaatggtttctgttttcttaaatgtttttctacttgacactgttatgtcagtctcatgtaactgaataattgttcataatttctgaagagcatttagtctttgccatctggcttcagtgccaaatgattttcaattcttgtttttggagactaatgactttttccttaatttattatcaaatttgccacattttagagctcacttttagaagttctgctatggttaatgaaaacaagctagaatgacacagtagaaattggttaatacgtcacattttacatcactattttgtagaagatttttagtaagtttctctatttttattccttgccactctggattttacaaatattctgacctagttgatccatcacatggtctcatatcacaactgttgcatcgctatattcacatagatgtttttctgtttaatttagaagacagtatttctgaaaaagtatgaaacgaccccaaatccaaaagttatggtgcacaatgaaaatgtatgcttttaataatgctggcttctgcagtaggtgtagaccatgtttcaaataaccacagactaatcagaaactccacctgtgaaaggaacttgaaattgtgctattcctccaagcttataacaccagcaaattgggtcaataggttattcctttaaaataggactatgagcctacagaggctcactctgaagaactcagccgtggagttagttctgtactatatccatcacaacagacatgcttcatcccatagacttcttgacatagcttgaaatgagtgaacccatccttgatttatatacatatatgttctcagtattttgggagcctttccacttttttaaaccttgttcattatgaacactgaaaataggaatttgtgaagagttaaaaagttatagcttgtttacgtagtaagtttttgaagtctacattcaatccagacacttagttgagtgttaaactgtgatttttaaaaaatatcatttgagaatattctttcagaggtattttcatttttactttttgattaattgtgttttatatattagggtagtacatttcctaccctacctgaagacttgagattatagtctttggggggatgggcaaagtactctctttttttgcatcttttaaattgtgatttttaaaaacacatataaattttactatcttaaccatttttatgtgtatagttcaatgagattaagtccagtcacattggtgtgaaacagatcttcagaattttttcatcttgcaaatctgggactctatacccattaaacaactcccattttccccttccccacagccttggcaaccatcattctacttttctctatgaatttcactactttagatacctcatataaatggaatcatacaggatttgtccttttgtagctgacatatttcacttaacataatgtcctcaaggttcatccatattgtagaatgtgataggatttcctgccattttaaggctgaataatattccactgcatgtatttaccacatttttttatccattcatctgttggtggacgtttgggttgcctccatctcttggctattgtgaataatgctgctgtaaacatgagtgtgcaaatatctataattttttaacacagtactttattttcggtatttaatcatatggaatttttgtcaattatgttaaaggattttacaacaacccaactatagatttatatatatatgtattattgttgttccttctaagcttaagaagtctctaataaaatccatacttccttata

SEQ ID NO: 97511 - DNA, 2072 bp, Homo sapiens
tcctggaacatcaagagtgtgaagactgaagataacctgaggcctaccagacatcctatattcaccaagattcacattttttggtatgtgtgcctacattttagcaaaaattggttggttaatccttctaaaattagagggatgacattgggtaacaaagtcttcccagcctttggcattatagtaatttctcgcaatagaaattccatacagatattattgccagtgaagagagctattcttgtttattatcagttctatatttttagctgaagcaacttagccctaaaaaaccccaaaatcaacttcttcctccaaattaaactctcccccaaatttaatggtttctgttttcttaaatgtttttctacttgacactgttatgtcagtctcatgtaactgaataattgttcataatttctgaagagcatttagtctttgccatctggcttcagtgccaaatgattttcaattcttgtttttggagactaatgactttttccttaatttattatcaaatttgccacattttagagctcacttttagaagttctgctatggttaatgaaaacaagctagaatgacacagtagaaattggttaatacgtcacattttacatcactattttgtagaagatttttagtaagtttctctatttttattccttgccactctggattttacaaatattctgacctagttgatccatcacatggtctcatatcacaactgttgcatcgctatattcacatagatgtttttctgtttaatttagaagacagtatttctgaaaaagtatgaaacgaccccaaatccaaaagttatggtgcacaatgaaaatgtatgcttttaataatgctggcttctgcagtaggtgtagaccatgtttcaaataaccacagactaatcagaaactccacctgtgaaaggaacttgaaattgtgctattcctccaagcttataacaccagcaaattgggtcaataggttattcctttaaaataggactatgagcctacagaggctcactctgaagaactcagccgtggagttagttctgtactatatccatcacaacagacatgcttcatcccatagacttcttgacatagcttgaaatgagtgaacccatccttgatttatatacatatatgttctcagtattttgggagcctttccacttttttaaaccttgttcattatgaacactgaaaataggaatttgtgaagagttaaaaagttatagcttgtttacgtagtaagtttttgaagtctacattcaatccagacacttagttgagtgttaaactgtgatttttaaaatgtgttttatatattagggtagtacatttcctaccctacctgaagacttgagattatagtctttggggggatgggcaaagtactctctttttttgcatcttttaaattgtgatttttaaaaacacatataaattttactatcttaaccatttttatgtgtatagttcaatgagattaagtccagtcacattggtgtgaaacagatcttcagaattttttcatcttgcaaatctgggactctatacccattaaacaactcccattttccccttccccacagccttggcaaccatcattctacttttctctatgaatttcactactttagatacctcatataaatggaatcatacaggatttgtccttttgtagctgacatatttcacttaacataatgtcctcaaggttcatccatattgtagaatgtgataggatttcctgccattttaaggctgaataatattccactgcatgtatttaccacatttttttatccattcatctgttggtggacgtttgggttgcctccatctcttggctattgtgaataatgctgctgtaaacatgagtgtgcaaatatctataattttttaacacagtactttattttcggtatttaatcatatggaatttttgtcaattatgttaaaggattttacaacaacccaactatagatttatatatatatgtattattgttgttccttctaagcttaagaagtctctaataaaatccatacttccttata

SEQ ID NO: 97512 - DNA, 194 bp, Homo sapiens
atttttagagatcgtcttgctgctttgcccagactggcctcaaacttctgggctcaagcgatccccttactcagcctaccgagtagctgcgactacaggcattctccactgtacctgactgaagtctaaaattttgaatcaagtctaagcagcatttacttatgatggcagaataaagatattttcagacatag

SEQ ID NO: 97513 - DNA, 263 bp, Homo sapiens
agttccacagtccatagcccaaacaaataaatgaatgaaataaccagaatgatttttgccaacatacatcaaattatcactgccttgaatcaaatcgttcagggactccccactagtatgtaggataaaaatgtgcagttcatagtccagcctgtaaggccctatatgatctactacttcatctttcacctcacattttgtgcccttcactctcctcggtctcatacagcagatatcattcagtactttccttccaatctggg

SEQ ID NO: 97514 - DNA, 595 bp, Homo sapiens
cattcctctttcctccatttcacagctatatccttattttcacacatgaccaacaaaagagacagcaagcaaaacaaagatcctccaaaattaccttaaaagacccaaaataaaaagagctcactcttcaaatcaaaagggacaaagaaaccatgaaaggtattcattcaagtgaggcttagaggctgtggggcgaagaaatacacggatgtccagagctgccttatgcagacagagtattttgcaaatctgttccaggcgtctgctgaggtttctgcctccttcagggaatgtattgccgtcattaatgcacactgactggtatgctttccctccaactggttttgcagagaagtaggcagcatgcaccctcataggcaagatgcaaaaggagagcagagaggcaggatgtccatgtatatgcagaaaccttgcccagaagatgacttattacattaaaggtgatcaagcttgggaaggaaccatgaaaactctattatgctgttaggaatattcacagccaagtatgtgataaactgcacccctcccttgtttcttgccaaacaggctgatgtgctgtgctgcttatgattta

SEQ ID NO: 97515 - DNA, 348 bp, Homo sapiens
atcacatatatccatgtatccattcttctacctatcatactcctttttctttgatatattttaaagtaattgcaagtgtgagctaccacgcccagtgtatgtacttttatataagacttctttccctaagcgttatgtttttgggattcatctatgtttcatgtctcagtagttcataatattacacgattaacttttaaaagctcacgataaatattgttaaattgccctccaggaaaatgtgatgaaattttgtaattaaaaaatccctgagtggctgggattataggcatgcactactttaccctgccttgtggtcagatttttatttcataaggagcatgtgag

SEQ ID NO: 97516 - DNA, 809 bp, Homo sapiens
atcagtacacgaatgaacaaagaaaatatagtacatatacacaacggaatactattcagccataaaaggaatgagatcttgttatttgcaacaatatggatggaactggaggtcattatgttcagtgaaataagccaggaatagaaaaactaactttgcatgttttcactcatttatggaagctaaaaattaaaacagttgatctcatggagataagagagtagaaggatggttaccagaggctggagaagggtagtggggtagtgagagggaaatggaatgcttaatggctacaaaagcatagtttgatagaatgaataagacctaatatttgatagcacaacagggtgactgcagtcaacagtaatttattctacattttaaaataactaaaagtgtaataggaatgtttgtaacacaaaaaaaggataaatgcttgagatgatggatactctatttaccctgatgtgattattacatattgtatcctgtatcaaaatatctcaggtaccccataaacatatatacctactatatacccataacaattttaaatttaaattaaaaaatcattttatcattgtcaacaaatggaaatgtatagaattttccatgatgatatttaggagaaaaatcctgggtcaagctataaggatctatctaaaatatattaatatattaactttaacaaatattgaatattatgaaagcatacataataatatatgtattatatatattatatagcatagtgtattactgtgacccccataagtcagcaagacccccaaatgttagtttatatatac

SEQ ID NO: 97517 - DNA, 417 bp, Homo sapiens
gagaaggagaataaggacctcttcaatggtatgatgcagaggttgccgctagagttcgctacagcaggactacacactaggtaccgtgcgctcgttcaccctggtctcaccttgatctcacaggtcttaggaattaatcaaaccaaacttgttgagtattgccaagtaactaagacttacccaggtgagtaataaatggttaagccaggccgggcacactggctcactcctgtattcccagcactttgggagggcgagacgggtggatcacctgaggtcaggtgttcgagatcagcctggccaatgtgatgaaaccctgtctctactaaaaattcaaaaattagctgggcgtggtggcaagcatctgtagttccagctactcgggaggctgaggtgggagaattgcttgaatccggg

SEQ ID NO: 97518 - DNA, 493 bp, Homo sapiens
cccatttgtccacgaccgggttctctcttcatctcccatcttgagttacctatttcagttcatttttgatttgcttaaggttctttctggagtatttttctcagatgggatacctggataatatacttttctcttttcagtgactttattttaatgagttttcagacttacagaaaggtgctcttcagatggggctgtgtcactggtcaaccatcttcactgtggagtcctagtcactacgattttgtgttgcatatcatgaagattcattcaaattgtctcctcttcctttccttcataataggttacatggtctgaaagtacatccctccttctctagtacattgtattcaaagaggttgctgctgcttctccattgtcattaatcttttcatcatcttcttattcctcttagcacagttggggcataatatattatcttctatgcctggggatgggaaaatgcaggcaggtaacaagaagagagaaatca

SEQ ID NO: 97519 - DNA, 657 bp, Homo sapiens
agttgctggcagagctgagctatggcgtcatccacggcacttccatgtctttaacagctttgaatggtggttccacactccggaagccgatgcaggaacgggaagcatctagtcccagaaggagagactcagagccagattcccagggctcaaccccacaaccatccctgcagtggaccaccaacgtctaggggaaggatattctgttttgtcacacaacttcccatgtacgtctgcagagatgtgcaggcgagtcaatggcagtactagattcacaacacttcgtcaatccaacttctgcacaatacagctgaaagatgggagaagtggcctaaatgtctgctccttacttcccatgtaggacagaccctaaataacctagaaaaacatgtctactttttctttcaaatctcctacaatccctcgatggagtctatgttctcagagccctgctggcttcctaaagcctaacttaagttcttgcaaatataactgaaatgcaatcttaggcaatgtgtccttccaagttctctcttcagagaggaagtacccggtgctactattgaatattgaagcaggcctggcggtgagagacggctgggcccgggtatggggagagagaattcattatgctcttctctctacttctgcatatgt

SEQ ID NO: 97520 - DNA, 838 bp, Homo sapiens
ggcacagtcataaatacagagggttttcagaaccacctcagagaagatgtttaaatcgctgacaaaagtcaacaaggtgaagcctataggagagaacaatgagaatgaacaaagttctcgtcggaatgaagaaggctctcacccaagtaatcagtctcagcaaaccacagcacaggaagaaaacaaaggtgaagagaaatctctcaaaaccaagtcaactccagtcacgtctgaagagccacacaccaacatacaagacaaactctccaagaaaaattcctctggagatctgaccacaaaccctgaccctcaaaatgcagcagaaccaactggaacagtgccagagcagaaggaaatggaccccgggaaagaaggtccaaacagttgaccctagaacaacaagaatttgaactgtggtaccacttatccctggattttcttccttctctgccatctgtgagacagcaacacgatctctcctcttcttgctcctcctcagcctactcaacatgaggacaactggatgcagacctttctgatgatccacttccacttaggcaatagtaaatatatggtctcttctttatgattttaataacattttctcttctctggcttgctttattgtaagaatgcagtatgtaacatgtataacatgaaatatgtacccatccatatgaacaagtaaggcttctggccaacagtaggctattagtagttaagtttgggaggagtcaaaagtcatatgcaattttcagctacacaggaggtctagtgcccctaacctctacatcatttatgggccaactgtaatttgcaataaattttgactgctaga

SEQ ID NO: 97521 - DNA, 4343 bp, Homo sapiens
  misc_feature (3643)..(3643): n is a, c, g, or t
  misc_feature (3661)..(3661): n is a, c, g, or t
ggcacagtcataaatacagagggttttcagaaccacctcagagaagatgtttaaatcgctgacaaaagtcaacaaggtgaagcctataggagagaacaatgagaatgaacaaagttctcgtcggaatgaagaaggctctcacccaagtaatcagtctcagcaaaccacagcacaggaagaaaacaaaggtgaagagaaatctctcaaaaccaagtcaactccagtcacgtctgaagagccacacaccaacatacaagacaaactctccaagaaaaattcctctggagatctgaccacaaaccctgaccctcaaaatgcagcagaaccaactggaacagtgccagagcagaaggaaatggaccccgggaaagaaggtccaaacagcccacaaaacaaaccgcctgcagctcctgttataaatgagtatgccgatgcccagctacacaacctggtgaaaagaatgcgtcaaagaacagccctctacaagaaaaagttggtagagggagatctctcctcacccgaagccagcccacaaactgcaaagcccacggctgtaccaccagtaaaagaaagcgatgataagccaacagaacattactacaggctgttgtggttcaaagtcaaaaagatgcctttaacagagtacttaaagcgaattaaacttccaaacagcatagattcatacacagatcgactctatctcctgtggctcttgcttgtcactcttgcctataactggaactgctgttttataccactgcgcctcgtcttcccatatcaaaccgcagacaacatacactactggcttattgcggacatcatatgtgatatcatctacctttatgatatgctatttatccagcccagactccagtttgtaagaggaggagacataatagtggattcaaatgagctaaggaaacactacaggacttctacaaaatttcagttggatgtcgcatcaataataccatttgatatttgctacctcttctttgggtttaatccaatgtttagagcaaataggatgttaaagtacacttcattttttgaatttaatcatcacctagagtctataatggacaaagcatatatctacagagttattcgaacaactggatacttgctgtttattctgcacattaatgcctgtgtttattactgggcttcaaactatgaaggaattggcactactagatgggtgtatgatggggaaggaaacgagtatctgagatgttattattgggcagttcgaactttaattaccattggtggccttccagaaccacaaactttatttgaaattgtttttcaactcttgaattttttttctggagtttttgtgttctccagtttaattggtcagatgagagatgtgattggagcagctacagccaatcagaactacttccgcgcctgcatggatgacaccattgcctacatgaacaattactccattcctaaacttgtgcaaaagcgagttcggacttggtatgaatatacatgggactctcaaagaatgctagatgagtctgatttgcttaagaccctaccaactacggtccagttagccctcgccattgatgtgaacttcagcatcatcagcaaagtcgacttgttcaagggttgtgatacacagatgatttatgacatgttgctaagattgaaatccgttctctatttgcctggtgactttgtctgcaaaaagggagaaattggcaaggaaatgtatatcatcaagcatggagaagtccaagttcttggaggccctgatggtactaaagttctggttactctgaaagctgggtcggtgtttggagaaatcagccttctagcagcaggaggaggaaaccgtcgaactgccaatgtggtggcccacgggtttgccaatcttttaactctagacaaaaagaccctccaagaaattctagtgcattatccagattctgaaaggatcctcatgaagaaagccagagtgcttttaaagcagaaggctaagaccgcagaagcaacccctccaagaaaagatcttgccctcctcttcccaccgaaagaagagacacccaaactgtttaaaactctcctaggaggcacaggaaaagcaagtcttgcaagactactcaaattgaagcgagagcaagcagctcagaagaaagaaaattctgaaggaggagaggaagaaggaaaagaaaatgaagataaacaaaaagaaaatgaagataaacaaaaagaaaatgaagataaaggaaaagaaaatgaagataaagataaaggaagagagccagaagagaagccactggacagacctgaatgtacagcaagtcctattgcagtggaggaagaaccccactcagttagaaggacagttttacccagagggacttctcgtcaatcactcattatcagcatggctccttctgctgagggcggagaagaggttcttactattgaagtcaaagaaaaggctaagcaataaatgtttgattatctttagatgtgatatagctagttcccaaagtgattgtacctaggattgtaacttaaattaacgaggggaaacgacatgctgggacccttgagaaacgaaaggcaaatccctagcttagtttctaggacttatctgagagtgtgatttcatgcagtggtaataagaagattattaaaagccatccctattctccgttttcattaactttatgcaattgctatatcttctaattgtatgtagtaagtttccttttcctttggttctttcctgatgatgtctcttccttccagttttattagcttgctcttggctgtgatgtgattcactaaccttttctcttaatttttattgtgtttaatttcttctttggcactctaaagcctggctaattgttctaggtttatgaatttcacctcttacatgtaaagggtataagattttaatgtaataggtcaaaaatcagattattttcattcaaatgaggatgatgagtcactgtaatatcaaaaaatccccagcagctgggactgaagggaagcagagatcatgaagctttctgaatgagaagtctgatttttggaacagtcccctgaagaccaatgttggtcggcagaattagcaaactggcaaaatcacattgcaggaacatattggaaaaattgtaccctttactaaagaaataaacttcaatattttctcttctaaccaacttaaaagacaccaatctacctaactcatctggctcaagggacttggactggaggatacaggctaaagtgacacttatcagaatcttcctcaagcacttgctggaaaagatatcagattggaacttcttgtttaaaattaagctttagtaaaacaaagtgatgaggttaggaaggcagactctacacatgtcagattgacatatccccacaatttccggaacctacatgtatagctgtttacaaaatctccaagttaattaagggcactttagaagttgtcctcatgaattagctagcattagcataattaccgacgttgcatgctgtgaggaggctacaaaggccaggctggtgtcggaagtaataatacatatagaattccattctaataaatgccattagtgtataacatcaagttctgtgtaatgaggctatttccaagtcnccaaagatggtcactgtnacagcactttgctgagagggttttaacaaatcatattagccaaaaagcctacaacatagatgcatttagcaaaccatgtacaaatcaatcactataataaactgcatcatttgatagagtcaccgtttttgcatgtagtgttagagtatcacaaaatataacaagttttactaaaggatggttggttttttcaggatttaagggaatatggacaaattgttaaatagtatttatttgataaatgggagtttgtatgcagaaagagtgaattgcgtataaaaagggtgatttaaaaacccagaaacaaaaggtagaatagggctgaagcatctgataataggaaaagaaaaggacaaaagtcctcaacttgtgagcaatatgctttccctttacaccctgtaatttattcaaatgatattaaaatacaagaccattgcaatttatgcttttcgcctggcagttattttcccccccaagctatcctgtttcagataatatcaatttatttccaatccatcagactaaaatctaagaaaattcaagaactcttttattgttgatttggtgccaccaaattctttttctttttaaatctttctaattatcctttctttttcaatcccattgctaacacccagaacatattttctgttcaatgcaaataaacattcactttttacct

SEQ ID NO: 97522 - DNA, 2376 bp, Homo sapiens
ggcacagtcataaatacagagggttttcagaaccacctcagagaagatgtttaaatcgctgacaaaagtcaacaaggtgaagcctataggagagaacaatgagaatgaacaaagttctcgtcggaatgaagaaggctctcacccaagtaatcagtctcagcaaaccacagcacaggaagaaaacaaaggtgaagagaaatctctcaaaaccaagtcaactccagtcacgtctgaagagccacacaccaacatacaagacaaactctccaagaaaaattcctctggagatctgaccacaaaccctgaccctcaaaatgcagcagaaccaactggaacagtgccagagcagaaggaaatggaccccgggaaagaaggtccaaacagcccacaaaacaaaccgcctgcagctcctgttataaatgagtatgccgatgcccagctacacaacctggtgaaaagaatgcgtcaaagaacagccctctacaagaaaaagttggtagagggagatctctcctcacccgaagccagcccacaaactgcaaagcccacggctgtaccaccagtaaaagaaagcgatgataagccaacagaacattactacaggctgttgtggttcaaagtcaaaaagatgcctttaacagagtacttaaagcgaattaaacttccaaacagcatagattcatacacagatcgactctatctcctgtggctcttgcttgtcactcttgcctataactggaactgctgttttataccactgcgcctcgtcttcccatatcaaaccgcagacaacatacactactggcttattgcggacatcatatgtgatatcatctacctttatgatatgctatttatccagcccagactccagtttgtaagaggaggagacataatagtggattcaaatgagctaaggaaacactacaggacttctacaaaatttcagttggatgtcgcatcaataataccatttgatatttgctacctcttctttgggtttaatccaatgtttagagcaaataggatgttaaagtacacttcattttttgaatttaatcatcacctagagtctataatggacaaagcatatatctacagagttattcgaacaactggatacttgctgtttattctgcacattaatgcctgtgtttattactgggcttcaaactatgaaggaattggcactactagatgggtgtatgatggggaaggaaacgagtatctgagatgttattattgggcagttcgaactttaattaccattggtggccttccagaaccacaaactttatttgaaattgtttttcaactcttgaattttttttctggagtttttgtgttctccagtttaattggtcagatgagagatgtgattggagcagctacagccaatcagaactacttccgcgcctgcatggatgacaccattgcctacatgaacaattactccattcctaaacttgtgcaaaagcgagttcggacttggtatgaatatacatgggactctcaaagaatgctagatgagtctgatttgcttaagaccctaccaactacggtccagttagccctcgccattgatgtgaacttcagcatcatcagcaaagtcgacttgttcaagggttgtgatacacagatgatttatgacatgttgctaagattgaaatccgttctctatttgcctggtgactttgtctgcaaaaagggagaaattggcaaggaaatgtatatcatcaagcatggagaagtccaagttcttggaggccctgatggtactaaagttctggttactctgaaagctgggtcggtgtttggagaaatcagccttctagcagcaggaggaggaaaccgtcgaactgccaatgtggtggcccacgggtttgccaatcttttaactctagacaaaaagaccctccaagaaattctagtgcattatccagattctgaaaggatcctcatgaagaaagccagagtgcttttaaagcagaaggctaagaccgcagaagcaacccctccaagaaaagatcttgccctcctcttcccaccgaaagaagagacacccaaactgtttaaaactctcctaggaggcacaggaaaagcaagtcttgcaagactactcaaattgaagcgagagcaagcagctcagggtcagttcttacctgtgtccttcactgctgggatattcttaggtcacctgagactctgaactggaataattgactctcttgctcctttcctctgccgtaggagcagcacatcccagataaggctgttccttcagcctgagtcccaatataagaaacatggagagaactccagcctagctgcatgtaaaatgagcaagaaataaactgttgtcattaaagccactga

SEQ ID NO: 97523 - DNA, 966 bp, Homo sapiens
ggcacagtcataaatacagagggttttcagaaccacctcagagaagatgtttaaatcgctgacaaaagtcaacaaggtgaagcctataggagagaacaatgagaatgaacaaagttctcgtcggaatgaagaaggctctcacccaagtaatcagtctcagcaaaccacagcacaggaagaaaacaaaggtgaagagaaatctctcaaaaccaagtcaactccagtcacgtctgaagagccacacaccaacatacaagacaaactctccaagaaaaattcctctggagatctgaccacaaaccctgaccctcaaaatgcagcagaaccaactggaacagtgccagagcagaaggaaatggaccccgggaaagaaggtccaaacagttgaccctagaacaacaagaatttgaactgtggtaccacttatccctggattttcttccttctctgccatctgtgagacagcaacacgatctctcctcttcttgctcctcctcagcctactcaacatgaggacaactggatgcagacctttctgatgatccacttccacttaggcaatagtaaatatatggtctcttctttatgattttaataacattttctcttctctggcttgctttattgtaagaatgcagtatgtaacatgtataacatgaaatatgtacccatccatatgaacaagtaaggcttctggccaacagtaggctattagtagttaagtttgggaggagtcaaaagtcatatgcaattttcagctacacaggaggtctagtgcccctaacctctacatcatttatgggccaactgtaatttgcaataaattttgactgctagaaataataagaaatattagtttttatgatatttattctttcttatagtgtaatttacatgtccacaatagtaaatttgaaaaatatcacaaaataaaagtaaaaatgacttataatcactcagatataa

SEQ ID NO: 97524 - DNA, 570 bp, Homo sapiens
gctgttattctaccttttttgttacatatagatttgtaattattattcccttggccagtttaacagtgagagaaaagttattttcacacaattagcagtactttgtttctctctccccagtatgtcagccacctccagatgtcctgcatgctgagcgtacccaaagggacaaggacaacttttcacccgggcaggaagtgttctacagctgtgagcccggctacgacctcagaggatctacgtatttgcactgcacaccccagggagactggagccctgcagcccccagatgtgaaggtgactagactcttatctggcttggtatttttagcttgcgtctttattctccacatgccagttatttctgttcgtttttctttttttccagtgaaatcctgtgatgacttcctgggccaacttcctaatggccatgtgctatttccacttaatctccagcttggagcaaaagtggattttgtttgtgatgaagggtgagtatgagcttgcctgacctgctggacattgaaattggggttaggaattagtccaaaaaggggagatttgatgtgg

SEQ ID NO: 97525 - DNA, 331 bp, Homo sapiens
tccagcacagactcttatctccagccctgactgccgaaaccctccagccccagctccagcccctcaggaggggactgcgtgggaggaatgactccagcaagccggcagctgacccgtctcctgcctgcacgcctcccgctgtggtccactgccggtggtcttcagctctctcctcgtcccacccccatggtctgctgacagcccagctcagtgcatccctgccatctctgctctaccgctggtcctcccaacaaccaacttacaggtttgggggcacacgtgaaggtttgacatatagtaaacacatgtcatggtggtttgttgtacagat

SEQ ID NO: 97526 - DNA, 357 bp, Homo sapiens
gagcccccagcgctggggagagctgtgcagaataggactggaggtggaagtgttggagattaacagccaggtggaggggacgggggaggccctgggtcagtcctcagggaacccccattgtgaagggggaaagggaaactcaggcccagtcctcaggggcccccagtctgagaggaaggaggacacacgagccatatttgcagagaaacaccagcctgcgagaggagggcttgaccctggggactgagaggtggagaagacacagtcccatctgtctcacggcagagacaggtttgggggcacacgtgaaggtttgacatatagtaaacacatgtcatggtggtttgttgtacagat

SEQ ID NO: 97527 - DNA, 660 bp, Homo sapiens
gctggagcggctgcaggagggtgagtggacagaagggaggcaatggctgaagtggaaacgatcaaatgaagcaatgagcagcagaattggtcagcctgcagagtggctcgaggggagaggacagagtcttggaggggaggaagtcaagacacagagaagccagcatttgaaggtggggatggctacaaatgatggaatgatgacagggctgtgctgggaacagcaagccagccggagctgaccacagcaaggaggagtgttcggggatccgaggaccacagcagtgaagtgagtcagactggcacagtctgatggcgtggactccaaagctgggggtcctgggtgggggaggtagaaggtctggaaatggaaaagaagatcaagccgtacagctccttgtaatgcatcaaaaatacctcagcacaccattggttccattgacaatactacaggttgaacatacctaatccaaaaacccaaaatccatattgctccaagattcaaaactttttgaaatggttaatcagtaagtataatgcaaatattcaaaaatctgaggattaaaaaaaaaacaaaaccaaatctgaagcacttctggacctaagcattttgaataagagatactcaacctgaagtataaatgtaattttaataatcatg

SEQ ID NO: 97528 - DNA, 305 bp, Homo sapiens
tagacacagttgaaaaaatgatgtagtgctgaagacagggattcagtgaaagttaatccctggaatgttgaggccttaaccttcttcccagatttttaaagcacacataaccagactcatagcttctaggcaggaaatagggtgtatcttccctggagaatatgaccagtccaaggaaaaagatatcaagataccaacgtcagaggctcccagatgcaatggtcaccctagaaaacctaagactggccgggcacggtggctcatgcctgtaatcccagcactttgggaggccgaggcgggcagat

SEQ ID NO: 97529 - DNA, 259 bp, Homo sapiens
gggaatctttgtttttataaaaaatagaattcatactgacatttccagtacaattaacatcacagggtttttatttaactttttggatttttataaatgtatcatttctcggttttgttgaaaatcctcattcctaggccaggcacatggctcatttctgtaatcccagcactttcggaggctgaggcaggtggattgcctgagcccaggagttcgggaccagcttgggcaacgtggtgaaaccctgtctctacaaaaa

SEQ ID NO: 97530 - DNA, 628 bp, Homo sapiens
gttttttttttcaaattatttaagcaaaggatcagcaatgtcagtcttgaaacacaagtcttacttacactgctacaaggtaaatatcctttgcccttactgaatgcagcccccactaagttattaacattgtagaaaagattcgagagcaaaatttaagtgctcatgcaatttaaaataggctgaattaaatggaaaagaagaggggctcctgaaaatagggtaagagagccatggcctctttatgtcttcaattcagactgctcaacaggagagtccactgagccacagaaaaacaaatccggattgttatgaactgaatgtctgtctccaaaattcacattttgaaatcctcacctccaaggtgatggtgttaggagatggagttctttggaaagtaattatgccataagggtggagccttcatgaataggattggtgcctttccagagatttattttcaccttaccccttgcaccacatgaggacgcagtgagaaggccctgtctgtgaaccagaaagcagaatctcaccagaagctcaatctgttggcaccgtgaccttggacttgccagccaccagatctgtgaacaataaattcctgtcgcttataaaccaaaaaaaaaaa

SEQ ID NO: 97531 - DNA, 517 bp, Homo sapiens
gtgttctcccagatccttctcagaggtgcatgtgaacattgccctccccaagcgcgctcatcacctggtgagcagagtcagccagggcctggggaacagcctcacaggagctctgggcctcccaggcatagggcgtgggccatgtcaggctcagctctgcaggataggtcacagtttaacagactctgttgaaagctctttcctgtcccgcatgcaggcttctcactcacagtttactaaggacttaaaggtaggccatgtttgtgatcactgccatgaaaacattgagcaacagatcctcggtcaggagcctaacctgctattacaacgttgttcctgtggggaaatctgcttctgtcttttcaataaacattagccgtcccgagactgtagcacacagtctgagaaagtgaggaatgaggatgggaataatctcctccccagtcccccaccacctctctacctattcacctaagacctgcatgccaataatacccaaaatttatacagccaggcc

SEQ ID NO: 97532 - DNA, 869 bp, Homo sapiens
acccagaagagacagcacttctttaggtcctgtacggaaaccatccagatgcttccatgtgttgcagaggggatgttagctgagatctagaaaatacctctgttctgggtgttttcataatccagcaccccactgggggctcaagtcacatatttctgcccaatagtacagatgagaagaccaaggcctagaggaaaggagaaaactgccaacggctaatagcaactgctgaaaacccgtccttggctgccagcaggacctgaagctgaggtcacttctctctctggaaagactctgaggatggaaaagtacagccagcccccagactgggaatcctggaagacataactcatcccagtgccccccttcccttggagtccttggagtccctttccctaaggaagtccacttgacagccagttcacggagccagtggcggcgaagaaagagatcaactgattgttcgtgcaaagtcccttttggaaaacagaacccctgaccgagatctggaggacagactccggttgctggccaggtccctgtggcagctgtgatgggatcagattcccaggaaaggaggaggctgccacatttgcaaagggagcaaagaggacaggcaggcagcctctgaaaccagagacagacacagagaaaaacagagagtgagaaaatgctcccccgaagacatagtgagattattttctgtaaacctgtaagggaagacaaagttacacagtgagtccaccttctgaaaagcaacaggcagacaggaccgagggccatgctcttaaggggagccgtgatggagccgggaggagaggcgcatcctcagcagagcttccctcccttgcacacgagctgacggcgtg

SEQ ID NO: 97533 - DNA, 704 bp, Homo sapiens
gagggaagggaagcggctgaactattccagatgcacagccatctccctgcctccccacgagatacctctctgaggctctctaaactaccactgaccaaagagccctgtgtccatcctgcaaagctaatggagtataacagtcaccccagcaaggtcagaacacagtatcaaaccccagcattcagaactcacagctgtgatcctttgccaatcaaacctaggtgtagcgtgcctggcgaaaatttaaattcccttcatataaatgaccaatattaaacaaaaactccctcctttgtatttctttagtctgtgatgatgcatacatttatcattttcagggtgttttcataatccagcaccccactgggggctcaagtcacatatttctgcccaatagtacagatgagaagaccaaggcctagaggaaaggagaaaactgccaacggctaatagcagtgagtgagtgactgggtggcagggctagggtgagaacccgtgcaaccctaccccaccactggtatgtctctacctctgcacactatttcccttggcagctacccgctcccaggtggtcacctgaatggggctcagttgggccttgaactggcctgagttcctgggaacgtgcaagcctccagtcaagcgtgaggaagatccgccatatccccacgacatgatacgggtacgagctcgattcgtatcga

SEQ ID NO: 97534 - DNA, 342 bp, Homo sapiens
ttatgttcactgctcttcaacactatcgcttattgtcttttgctaataacagtgcagacattttctttttcctaataacactgtaaatagtgtttctttttttttttgagatgaagtctcgctctgtcaccaggctggagtgttgtggcatgatcttggctcactgcaacctccatctcttgggttcaagtgattctcctgcctcagcctcctgagaagctgggactgtagacatgtgccaccacgcccggctaatttttgtacttttgtacttttagtagagacggggtttcaccatgttggccaggatggtctcgatctcttgacctcgagatccgcctg

SEQ ID NO: 97535 - DNA, 269 bp, Homo sapiens
actgggtctgcaggggcaggcctggagtctgagacaaccagggatgatcctggagcccggatccgccagggtgagtctggaggccaagtctgctggggtgggtttggaacctgagtccatggatggtgggcctgggtcctgggtccactgcagcatggagccatggagactagtatgtgtacatatatattaggtctacataaactatcaatcaagttaaagggcataatgacatttttatacatggtgtattcataatttcctactac

SEQ ID NO: 97536 - DNA, 328 bp, Homo sapiens
  misc_feature (27)..(27): n is a, c, g, or t
  misc_feature (35)..(35): n is a, c, g, or t
  misc_feature (37)..(37): n is a, c, g, or t
taggaataatacaagaaaactaccagnacccgtgnanaggccgcttgtaggagttggtatggacagacgcaatctgcatgctatgaaagttggcagcctggcaagcaacagattcatactgaaatatttacagattacattatacaatacttgaaattggcttcaaaataatatggaagaggagaattggacaggcatatagatgaagcagggtggccatgagttgatggctgttgaagatgggtgacaggtacatggggattcattatgctatactctctacttttgcatgtattcaaaattttccataataaaaagtttaaaagaa

SEQ ID NO: 97537 - DNA, 168 bp, Homo sapiens
ctcatagaagttagcaaggacccagagaactgagttgccataacatctctctaagacctgcttcaggcagtgcatttcagcaaggagcagaccatggaggatcacagggatctgaatttgcaggtacaaatacagtcagttcagagttgacactcactttcaaggatg

SEQ ID NO: 97538 - DNA, 739 bp, Homo sapiens
ggattagtgcctgtgaaagagctcaaggttgaagggatcaccctctcgcacttttgccatatgaggacacagcattcacccccctttctttgcctttccatcccttctgccatgtggggacacagcaagaaggcccttaccagacacaaaacctgccagtgccttgatcttggacttcctagcctccacaactataagaaatgaatttctgttccttatgaattacccagtctgtgatattgtgttttagcagcacagatggactaagatagtggggagcttcctcctgggcctcctggagagcccacaccctccctgccctctcccacactcctgcttccctgactctccaatagatgtctctgcaggaatccccttctcaggctctgctgctaggaagatcaacctaagatacattgccttgtccatcgtatgcacctcttgcctgcctgtaaagctttctctggcgatgtaagactggcaagtgcagacaacataggaagcacccggggccaagtgggttcctgcagtctggcaggtatggagggagtgccatagagtgggcatatatgaaagccactctgccagggcccagagctgaggaaaccagcgcatggccttccctggggcactcaggcatacaccaccactccttggtgagctggctctcctgatgccaatactcactccttagccttccttccttacttctaatgccagaagaaaaagtagggggagg

SEQ ID NO: 97539 - DNA, 361 bp, Homo sapiens
taaaaagatcaagtagtgttcctaatattttgtcccttctaaagtctctctcaatacttataaggagatgacagaaactttgaagaggtcaaagcaactagattcaaggctctagagtaattatctctggttctcctactgaactgtatcttcttactctcatccccagtgcctagtacaatgtttgggaaataacacacctttaatctttaatgagtaaatgaatatctatgactataatgtcttccctctatagttcagcaatcttcattttttttcccttcatgcaggaaactcatgaaaactcaccataaaatttattatcagtaattcaaagagatggcaacagtaacttctcagt

SEQ ID NO: 97540 - DNA, 504 bp, Homo sapiens
ttttttttaacggagagagtttctctagacttcaaagggggaatgtgtgaagggagaactgggttttatctttctgcctcttacaacattgggtcactagaatcttaccagcaagaaagaggagtcactgtgtgagtaaagagaaagcacatctggaaaatatcaacattttagttcattaatggtgtgtttggaaagcaaaagtgcatgttgtattatcttttttttggtcagtggaggcctgaaggaggggggcactgaaggaaagaaaagaggggcaagacatcatctcgtttccccttgtacttgctccccattatctcttcttccttcatcttggtgagactgcccccacagagcaggccaagccaatctccaaaacattaggtttccaggcagggcttttaggggcagctatcccctagatgcagattggcttagaggtccctgagcatctgctgtttgccttcctggaaggcagccctaatgcacaatccatcaatc

SEQ ID NO: 97541 - DNA, 395 bp, Homo sapiens
aggtccaaaccctccatgagattctttgatgacttcccaaaaggcaagagaacctctaactttactgagtgatttttttctggaagaaccaagaatgacattccactgttcttcaccaataaagtcctgcttggcccttttgacaggcagaattcagttgtcccctggtgcactgcgcataatccctgggactgtaaatatgatggattttactcctgtggttgtgtgatgttacatgccacagttgactttaaggacaaggaactgccctctatgggtatgatctaatcaggtgatcccataaaagagacagggctctcttcctgaagtcagagagtccaaccatgtgggtgattcaatccaagggaaattctccatcactggcttcaaggatg

SEQ ID NO: 97542 - DNA, 536 bp, Homo sapiens
aattggtttagatgcagttggggggaggattcagatggcaattgtgagaaactattccagtgaaggccaagctagcactcattgttttgttctggcctcatgtatactaagttaaattgtggacatcttttctgagtgtgagttggagatgctagtgccttaactttttaattccaggagtttcagtataaaacataaacctgagatgaggccaatgtaggaatgaaatgaagaggaagagggcaagatggcagtctttttggttctcttaagtttaccagaatgaaaattaatgatgaagtattaatagaacttactacattttacttggaagtaaatgttaatgaaaaccagatgataatgaagattaaaaaatgcttacttatccaaaggaagtaatttctacttgtgaatttctatgatctaatgaggaactattttctaatttgaattgtaatagtgtaccaagtgagaacataaatgacgctagtataatctgagtccacagtatagaatttttactaagccagttccaa

SEQ ID NO: 97543 - DNA, 470 bp, Homo sapiens
tattgcggcgcctttcccagacctgagactcttcagctacttcctatttcaggctgattttgagacagtgaaatacatcaaggacaagttctggggtgtcccctagctcattttccctactctgtgaaccaagaacttttctcagcccctccagacctgacctactcctactttattaaaaaaaaattggaggctggcaatacggccaaataggaacagctctggtctgcagttcccagtgagatcaatgcacaaggtgggtgattgctgcatttccaactgaggtacccggcttatctcatttggactggttagacggtgggtgtagcccacagagggtgagctgaagcagggtggggcgtcgcctcacccgggaagtgcaaggggttggagaactccctcccctagccaagggaagccatgagggggactgtgctgtaacagtgcattctggcccagatactacactt

SEQ ID NO: 97544 - DNA, 260 bp, Homo sapiens
ggcgtggtcatgtgactaagtttggaccagtggttgtgcacagaggcaatggatgcaacttgactacagatcctcacaactctgagataagctgcttttctactcgctgcctgtttttcctctcccgagctggaagtaaggtgcaccagtgttacccatgcagataaggactatacctcagggaatggcagagcaatagtatggaaggacattagggaggagaggtgctctgccaactggagctgactggactgttagtg

SEQ ID NO: 97545 - DNA, 226 bp, Homo sapiens
aatcaagcaaaaagaagtaatagcttccaccttttgtctaatcacaccaatccgttttatgtccatcctggtatttatcactaacctgtatatcctttctacatatttattttagcgtcgttattatatgcccccacatcagagagtaaactccatgaaaggagagtctattttcttcaataccgtcctgtattctgcctctcatgtacctctaacagtgcctaca

SEQ ID NO: 97546 - DNA, 115 bp, Homo sapiens
gtgtatatatatatacatatatatatatacacacacacatatgtaattccaaaatgttgtggtacagatacttctcaaaaatttgtattgtgaatatgatcagatctctggtgag

SEQ ID NO: 97547 - DNA, 185 bp, Homo sapiens
cctagggtacacgtggacatgcctatgacttttctgctttgtcttatgtttaaaaatgtccttcagtcattgcaggtcacaagcaggctatcagctcagtaattaaaataattcggttcttcatagtgaatgtaattctaaattagattttaagttgtaactccctgcttcagcaatggtgatgg

SEQ ID NO: 97548 - DNA, 606 bp, Homo sapiens
acaggtgaaaaggttgaatgtaggaattcgactacagacagacactagttaagtattgtagggatatatagcatactagagactgagctcataagtactttgctacactgaatggttatgaatcatttatttctgaatttgccattgtatcatctagacaaatatttaataatctctctagcaaatgctaaaagccattgtgataatgaaaatgtagcaagattcaggcaactggtaaattgtagtagagttcattggtttcttgttttatgaccagtcaaatacaaatgtcacaatttctgggttgccaattttggaagccttcttcaaacgcctttataattattataattatacacttcccactggcccccccaccacccacatttattccaggcaatgtctgtttcccactcatggtacacaagcacagcttaaaaagcaatggactttggaaggctccatcagctttgcaggcccaaaatagtacatgaaacctttgcttgccctaaggattccctctttaaaagtctttcttcacatagtgacagtgaaagctccagctcatctttgatcttgctgtattctattaatttgaagtaagga

SEQ ID NO: 97549 - DNA, 425 bp, Homo sapiens
cattctgaaatctttgccctatgttgaagaaatgtataaaggctccacatggaacccagaatgtatgtaattgcacactcaggattactatgaaatctggcactaatcaaactgatacggtgctcctttcaagtcagctgtctcttcaatcaagtccttcactgaagaaatttcaaatcacaagtataaatctctgtagttgtacttctttacaaagtcgtacaactgaatctctttataaaaaaaaaaggaaggctttttatttctagacctctacttcaagtgaaaattaaacaattcaattcattaggctgctttttggcagtctacctataggtttcacaaacgacttttcagagaggtatctcaggagttcatcgactggcagacctagttagcaggacaaccgaactacagggcactca

SEQ ID NO: 97550 - DNA, 478 bp, Homo sapiens
atgccatcaggacgcacttgtgtgcatgtgtgtgtgtatgccatcaggacgcatgtatgtgcgtgtctgcatgccatcaggacacgtgtgtgtgcatgtgtatgtgcatgccatcaggacgcgtgtgcacgtgcgtgccatcaggacgcatgggcgtgggcatgtgtgtgcgtgccatcaggacacgtgcatgcgtgtgtatgcgtgtgcatgccatcaggtttgaggagcactggcctctgtcctcccttgggctccctgtacaacagccctgccccaatgcgagtccccaaatcgccacgggctcttctgctctagaacccaccctgtgtaaggatgcagcacccctgcccctcgagtgctttacatcttgcaggaacgctcatcatcttaggccgcctcggcatccactctgaatctaggctggactttctctgaccagaagcggggctgccacccgcaacaattttcagttcac

SEQ ID NO: 97551 - DNA, 694 bp, Homo sapiens
tacaggcaagtcatctttgcactcataaccacatcttttatggaacatcaagcctactctgaggtacaggctttcagaagcctgaatttggaggaccatgcctgaaccaaatggagtctccagaatcaaaactgctcaaaataatcattcatggttctcagaccaaataagatctacttagaaacatttctcgacagcacgctgccatgccgacgcagaccccactctgcacgccagcccccctgcacccaccatggccacagttcagcagctagaaggaagatggcgcctggtggacaacaaaggctttgatgaatacatgaaggagctaggagtgggaatagctttgtgaaaaatgggcgcaatggccaagccagattgtatcatcacttgtgatagcaaaaacctcaccataaaaactgagagcactttgaaaacaacacagttttctggtaccctgggagagaagtttgaagaaaacacagctgatggcagaagaactcagactgtttgcaactttacagatggtgcattggttcagcatcaggagtgggatgggaaggaaagcacaataacaagaaaactgaaagatgggaaattagtggtggagcgtgtcatgaaccatgtcgcctgtactcggatctatgaaaaagcacaataaagattccatcatcactttggacaggagttaacc

SEQ ID NO: 97552 - DNA, 368 bp, Homo sapiens
aatagagttactagattgttagagctgccaaaaagaaatgtaataggtggtgtcctggggctacaactaggcttgctgggcctggatcaaacactttatatttggcaggcactttagtattatgcttggtaaattctcatggttgccttgtttatttaagttcttagaagttttaaataataaaaactttgagtgggctggtcacagtggctcacacctgtaatcccagcactttgggaggccaaggcaagctgatcaacttgaggccaggagtttgagaccagcctggccaacatggtgaatccgcatctctactaaaaatacaaaaaattagctgggcatagtggcacacgcctgtgatcccagct

SEQ ID NO: 97553 - DNA, 473 bp, Homo sapiens
cccaggccagactaattcacaattgctgggtaatcaagaaatgcccctccatagtacaagtgagttgaagcaggcagacacaattgcagctagacctggcaagccagaaatgcacttccaaagtgcaggtggactgaaactggtaggcagggaactagagctggaactacagctgaaactaacaagaaggatatccccctccaaggtgcaggtgggccacagctatggagctgactgctgtagtgcttacaagactctctaggaatgcattcatggcggtatgaatggaacttgacaggaagccatccacagaattaccacttaaactcgaaggggatgagtactactagatgcctctcacgtgtgtcactggcaaacaagcatgaggagcaagaagcagcatcaagaaacacattggaatagcagagaaaagccccttcttcctcactgttcctccagtgccctctattgac

SEQ ID NO: 97554 - DNA, 355 bp, Homo sapiens
tccatcttcaaagccagcaacattgcatcattgaatctctctcactctgatcctaaccctctggtttccttcttataaggacatttgtggccacattgggttcaccaagtaataatacaggatgatagtcacatccccaaattcttaacgtaattatatttacaaaatcccttttggttaacatattcagattctggagattagagcatggaaatctctagcagggaagaggtgttattctacctaccacacagtcaatcaacatgctcaatagctttatagttaggagctttgattttatatttatactgacctttgtttaattccagtcctgtaaaaaataaaaaatataaaa

SEQ ID NO: 97555 - DNA, 287 bp, Homo sapiens
tcttgcaaataaacagcttagttaaataaactcaagacaccatcattaaacaattcaataattaaggtctaatactccttttattattaatcataatcacttttttatttgaattgagctttacttagtttattgcctctattattgtctgagaggagcactcttatattgtctgctttatgcaggcaagtgtggttttaagatgagcttgggtcaaacatcaaagcaaaaaagatttgactataaatcctagcttcctcattaaccagcttggtcacctatcacaa

SEQ ID NO: 97556 - DNA, 319 bp, Homo sapiens
aacattctcaaagatagagcatatattaggccataaaacaagtctcaaaatcatatgaagtatgttctcagactgcattgtaatgaaactagaaatcaatccgaaagacttttgaagctacacaaatacatgaaaattaaacaacatcctcctgaatgatctttgagacagtgatgaaattaagatgaaaattgaaaaagttctgaactaagtaaaaatggaaacacaacatgcccaaacttctgagatatagcagatacattcctaagcaggaaatttatagcattaaatgcctacatcaaaaaatttgaaaagatca

SEQ ID NO: 97557 - DNA, 398 bp, Homo sapiens
tctgaggaatgagatctaaaggatgaaagatagctgggtgaagatgggatggtgaggggcaagggaagagttctggtcagaagaaacctgtagagaggcccttgagctgctagtaactggctcatgagaaagcagtgaatcgtccagcttgcagagagggagcacacaacagagcgaggtgggcctaggaaggacctgcagaagctagagagctgcccagagtagtatttgcaggtgtaatccaggcagatttctccaggttccaaagactaatgttttgaaagaggcttacctgtgtgttgctctttctgagcccaaccccacactgtagccccctttaacttctagtgtctgatggttgcaattggcccaactttgtccctgctgaagacatcccc

SEQ ID NO: 97558 - DNA, 584 bp, Homo sapiens
aatgcaaggaaacttgttccttagtgggcacaatgagaacaccagcagccaagggaggaagcgaggagtccttgaattctctaagaacctactgcagactgccttttggcaagtgttcatggagctgtgctctaggaggagttcctggtcgagcagtctggcctgggaatggtggtgaagcaccagccctgtcttcttgcatcctgacttataactgggagtctccagtcttccttctgccacagcccagtgtgccttgtttcgagccaggcaaaatggctcaccatccctgaagaaacagcccacttacactgtcccaggttcactgtcacaccctttctttctctacatatctgcgcatccttcaaaggcctgatcaaatgtcacttctttggggaagcctgccatcatggatacctactttttgctgagctcatattacttttacctgcataccttcacacctaacttatcatcatacgttttataggtgcccagtaaatatatgttggtaaaatgaatagtcctgatgtactttaatgttattttggataaaagtcatacattaaataaacaaataggat

SEQ ID NO: 97559 - DNA, 404 bp, Homo sapiens
cctcctgaaacctttttgaacatgatataaaaaagaattttaaaaagcaaaaaggcataaacccgtaagtacagaaaaaaaatgggagaataaacaatagtgacaagaatatcaacgaaacttatttttttgaacaggacatacatgtagttcacaaaacaaaatattaaaatatggagtaaaaaggctgattctcatttctctccccgtcttccctcattatcctttgtccttgtgtccccatttagagtcttctagattttctttaggcatacacaaatttttttccacacaaaaggtgcatgctatagacttctggaccttgtttttttgtttgtttgtttgtttaaaaaatgtattttggattgcttgagcccaagagttcaagactgtggtgtgctatg

SEQ ID NO: 97560 - DNA, 309 bp, Homo sapiens
tcctgcattattacccatgaggagaagccaggaagctctgtatcaggatcaaagcagatgacttataagagttagacaattcagtcaatccttaccctgggagaggaagaagggatggatgaaaggattacaatggagatggcatttgccagtgttcagggagggaatatcgtagttacttaagtcagatccagttataccttcttatcctgattatcataatcagcctgtctcactagaatttgcaagctcatgttaattgtgtagaactttccatggcacctcggtttctttgattgaaagctatta

SEQ ID NO: 97561 - DNA, 797 bp, Homo sapiens
agacacattctaagcaaagcttaaaccaaatggatgaatcaggctcctcttctgtttctgtggttaagaatacctacttctatgtcatggtaatgcccacactacaagatggattgccagaagacagaagaagccatttcagtgttttgtttctttttaaacttttctcctcggcacaagacaatctcactagagaactgcgtctataaatgtgcacattccccgacacaaccagagttgcctcatcctcaaggtctatttttcagtttggccttggagcagggttccagaatttgttcaactcctgctaatttagcaactgtttcttgatgatttctgctttggtgacaggcacacttgatgactgtcccatagagatacacaagcataaattctgtactggaaggctccagtctggaaagtgtgagtactgcacagaaaacatagcaatggaacaaaagcaccatggctctgggctgttgcatggcctgttctcatgtgtggataatttatatgacagggcagatggagaccctgttttcagaatgtgtgtaactccactcttggtttgctaagagaatgcttatctagtcccagcatgcaagtgggttaagatattttacttagatttatttatgcatttacacatccatacatgcagtcaaaaatatttattgaacacctgcaatgtgtgaggctctatgtgccaaagatagagcagtaaataaaacagaaaaatccccatcctcatgaattacacattgatggaagacgtggggacaatacgcaaaataaat

SEQ ID NO: 97562 - DNA, 423 bp, Homo sapiens
caccataacgtctcagtacctcagttctctgactgtaaaatggagatgatgataataatattaatatctcatagagttgttgtgagggttaaattaataaatgtaaagctcttagaatgatgcctggaacatattaatcctcaataaatgttagctacacataaaagccttctttggaccgtctcggactagttagctttgctagcaccaacatggtaccttgtaattgccttcattacagcacttatcacacctgatcatattcacctgattgtcttctcgtccccctttgatactgagtacaggagcaatgtctgatatttcttaccactataaccctagactccagtatccagcacagagctgacaccaataagggaagtgaacattttttttaaagaactcttcgttggccagtcgcag

SEQ ID NO: 97563 - DNA, 375 bp, Homo sapiens
tatttttagtagagacggggtttcaccatgttggccaggctattcttgaattcctgaacccgtgatccgtccaccttggcctcccaaagtgctgggattacagatgtgagccaccacaccgtccatatttgtatatctttgaaccatcaccacattgtcttaattactgtagctttataaataaatcttaaaattaggtagtgttagtcctccaactttgttcttcatttacaaaattggttaggctatgttaagtctttgcagcttatcagtcgctacaaaaatgtaatttcgattgggattatttttacacaatacatcaattggggacaattgagatctgagcaatattgttcaatccatccatctttgtat

SEQ ID NO: 97564 - DNA, 348 bp, Homo sapiens
atcagtgagttcaaagacaggcaatgtgaaaatatgcaaaggaaaagaaagaattaaagaaagaaaaggaatgaagaatgcctacaagatatagagaataacctctaaagagcaaatctaagagtggttggcattcaaagggagttgagaaagagcaatggttagaaagattatttaaagaaataataacagaaaacttttgaaacctagagaaagatataaatatctgagtcaggaaggtcagagatcaccaaatagattcaacacaattaagactaccccaagacatgtaataaactcttaaaggtcagggtcaaagaggattctaaaagcagcaagaaaaaagaa

SEQ ID NO: 97565 - DNA, 466 bp, Homo sapiens
tagcaaatacagtaaacactgaagaagaaaagatcactgaacaacactcttactaacttgatctagttgacaattataggatacaacaaccacgagaagcagaatacacagttttcagttacacagttgtgtgtaagcaacactcaccaagatagaccatattctgtgccataaaagaaatgttaacgaatttaaaagaatagaaactatacaatgtatatttttggatcacaatacaattaaattagaaatcagtgacaaatatatttgggtaatacttacatatttggtgactaaacaatacactttaggctggtcatggtggctcatacctgtaatccctgcactttgggaggccgaggcaggcggatcacctgaggtcaggagttcaagaccagcctggccaacatgatgaaaccccatctctactaaaaatacaaaaaattggactgggtgcagtggctca

SEQ ID NO: 97566 - DNA, 275 bp, Homo sapiens
ttttttttctctcgcgatacattttatttattatgtggtgtggtggcctagctgctgactgtgggtaacagcttcagcaaagaatttgacctcaagcaagatgaactccaaataacgcataaagtaacatcaacatgatgcagtgtgtgtgaaacagatctcggtcccgtaagagcaaaagagaaggacaaatcagatcatcacacgggatgtcttttttgtgcgattttgcattttcccattcaaaacaaaaaataaataataaatttgaagct

SEQ ID NO: 97567 - DNA, 153 bp, Homo sapiens
tggaatgagttagccaagtcaccgtgccaatgagtggggaggcagggcaaactcagctccggaggctctgccagctctgggtggtgctgagtgaaccctacccccacatatcctgcaaaggcactgggaacaaggggttgggtacccctggac

SEQ ID NO: 97568 - DNA, 181 bp, Homo sapiens
cgcaccgtcagccaagaccacagccccacctcctcaacagctgggcccacgccatcgggggggcgttccaagagacttaaaaaaaccataacccaaccccgaggaggtgccctctgaggtggggtgtcccatactagagtcagggtgacctgaggacaggccaggcacacagggccaccct

SEQ ID NO: 97569 - DNA, 125 bp, Homo sapiens
gcagaacatgacttctttcccgttccagctcttggaagtcgctcaggaaatggagctgctgtgtcagtgccttcctgatccagtctccgagcagccagcatggccattgttcatgagtctgggtg

SEQ ID NO: 97570 - DNA, 491 bp, Homo sapiens
cgggacccacatcccgggtcgcataatgatagacttaggatgtgaagcaaagaaactgagttgccatcattaaatcttatttgggtggaaagaacttatggagtaatgcaacccaacaggacttcccaagatgatgaacacattctatatctacgtggtccactatgatagctactggttacaagtggttactgaatgcttgaaatgttgccagtgcaaatgaagaactgagttttaaattgtatttcattttaaccaatttttttatttaaaaattttatgcaaaaggactgaggccaatccaaaatatcttacttaacccataccttgttgaaatactgcaatagagaatagtggaaaacatcttttttttttttttttttttttttttttgggaaacggggccccccttttttcccccaggggggggggggttggggccattcccggcccggggaccccttgggacccggggggggggggggaccccc

SEQ ID NO: 97571 - DNA, 389 bp, Homo sapiens
tcttagccacaccgtccccaacccattccaaatttcaccccagttgaatttttcctctacggaaacttcctcttcctgaactcctgaattaataatctgcaccacacactcacgtttaatcctttatgacttttcagggtttcctgcagctgactgatctttagccagtttgtaccagtttggccgtgagtctgagtggttcagtgcccacgccacactggtggttaaatattttgaaaatcacttccctggtttcctgtgtcttcagtgaaatggaacacactcgtgtgttagtgctcaaacacagagcctggctctctgcaggcacaacacaaatggtagcagtagcagtagcagtggttgttactgtttattctgagtcagatggt

SEQ ID NO: 97572 - DNA, 442 bp, Homo sapiens
agcttctccggtgggcagcttttcatatgggttctttggggaatgtgtgtgtgtcctgtgtaatgccatttggagatgacacttggaaacttacacccgattttctctggactttgttctgtgagactttttcctttgctgattttactttgtatctttttgctggaataaaccatagccatgagtacaactatataacgagtcctccgaatcttcctagtgaatcatccaatcaggagtggtcttggggacctgaaaaatagtgacaatagccaatgttggcctaagtgtgggaaaacaggaccaccaaaactatttatggaaaggcaaattggtaccaccattttggggatgaattcagaaatgttaagataaatcaaagatatctatgtccattttcaggtttagataatctagagggaaaaaccccacacatttgcta

SEQ ID NO: 97573 - DNA, 258 bp, Homo sapiens
ctgttggcagtgtgttggattttggccattttcataggtggtatcttgtgtttgttttaattcacagttccctagtgattcataatgtggagcatctttttatgtgcttacttgccatctctatgtctaatttggtaaggtgtctggtcaggtcttttgtccattttaaaaactgggttgtttgttttctaatagtgaagttttctacagctctgttgtgtggttacttcttttttacatcaagatgagtcttactac

SEQ ID NO: 97574 - DNA, 685 bp, Homo sapiens
tgcattgggtcttaagacttccccttaaaggtgacacatatcccctccactcacatttcatctggaaaaacaagtcacgtggtcacaatgggcaaagaagtgcccatggacccagagggaggagatttggaatactagtgaccatgtcaagtgactaccataccatataaagaaactttgcaggattttttcactttaatttaaaggttaaaacatgcagctgtgaaaagtcctgggcctgattgcttcactggtgagttctaccaaacatttaaagaacaaataccaatccttctcaaacttttctaaataactgaagaagaggaaacatttactaacttatttatacaagatcagcattatcctgatacggaagccagacaaagacactacagaaaagaaaattatagatcaatatttcttatgaacattgatgcaaaaatcctcaacaaaatacaagcaaactgaattcagcatagtaaaaagattatacaccatgaccaagtgggatttattcctagaatgccaagatggttcaacatataaaaatcaatcaatgtaatataccacatttacagaataaagggaaaaaaacataaccatcttaattgatggtgaaagagcatttgacaaaactcaacaccctttcatgataaacactcaacaaactagtagtagaaggaaa

SEQ ID NO: 97575 - DNA, 583 bp, Homo sapiens
ctcaccgcggaagtctgcagcttcactcctgaagtcagtgagaccatgaacccaccagaaggaagaaactctggacacatctgaacatctgaaggaacaaactctggacacaccatctttaagaactgtaacactcaccgcgagggtacacggcttcattcttgaagtcagcgagactaagaacccaacaattccggacacagcatgatcttggttcactacaacctggatctcccagagtcaagcaatcctctcgtctcagtctcccaagtagctggaactacaggtgtgtgccaccatgccccactaatttttgtatttattgtagagacggtttcagcatgttgcccaggctggtctccaactcctggactcaagtgatcctctccacctaggcctcccacagtgctgggattacaggaatgagccaccacgcccggcctaattggaagttttagagtgcagtggggatcacgtgcgtagaggttactgctgccttaattaaaggagacaacatgtttcataaaacttggaaattgtagagggtgtggggaaccactcaaattcagaatatcaaaacaga

SEQ ID NO: 97576 - DNA, 508 bp, Homo sapiens
tatggaggcccactcaaaccctgcgagtgtatggagccccgcttgcatgtttggagccctggcagcccccacctgatgtgcctgccccaggcagcatggagcacttcctggaggaagtaggtctcagccagccttttctagatgggcacgggcaggcactggatggctatttaggcatgagggtgccacgagcagagacctggaagctcaagtaaggtgcagccattagggtgccaggagaaggaggcctagtggcccagccagcccctggggttgccctgtccagagcctacacccaccaggtcctcactctgaactggcagtggcagaaccacgacttgagaaaaaaagtcctttctctgagctctgttcctctttccattgctcccgctcttagagtcttcctttttttaatatccaatttggtcgccttccttggggacagccacagaaggggtccagccctgttggcagcctcttgcccccgcctccactaactcgcctccag

SEQ ID NO: 97577 - DNA, 260 bp, Homo sapiens
agaggtcacaaggtccggccaggtcataggagcagggagaaccgaggtggaaagccagccacctcccaagctgggctcgaagctgctgcggcccccagacccagacccaatgccgcttccggggcggtctcccctggagaagcagccgtggtcctgacgaaggcccgtgccgcgccacaggaatccgggagtcacggctgaccacctgcgcctgtgccccaagatggcgggaacgggtgggctctaaggtagcaaaacgc

SEQ ID NO: 97578 - DNA, 349 bp, Homo sapiens
aagagtgctcatactctacccaataaacttgcctgggggcatgctctggtgctctggatgtttgggagcataatgtagactcatataccaacggttcttgggtactccactgctcttctgagactgtgaagaacctgacctccttgtcaccaagtgtgctggccttgcctcccattccttccttccacctcccattgttgcctccactggaacagaccttcctcccctgcagctgagctccctcctgcccagcatacacagacctccatcatgcccacactttgccccaaatgggcctctctgtgctgttctagtcctgcttttatctttccagctgactcatctgtat

SEQ ID NO: 97579 - DNA, 686 bp, Homo sapiens
aaaaattctacagtaaaaatcagtcctaaatgtagaagggaagatcatttaataacaaatcacaaaccactcttcatctctatttgctctgcattttcagaaaccatagaactttatattacaagttaatcaatccacatcacatctctggagagaggatcagcataaaaaaacaaacaaaatggaaaacaggagccatgtgtcagaattaggctagtgtcacaggatcttctatggaggtgacgaagcctcttcattattttctagaggcaattaagcacattttccataaatctacatggcacaaaactttctaacatgaaagtaaagtttagttgctgttgacagggttaggtctctatacattgtatctcatttttatattaaatttgtttttatcaacatcattaaataattgatattctcgcagctcttttccatttcctgatgcgtttttaaattgcagcctcttgtctgtgacaccttcccacctagtttctgcacaattcctgcacaaggaccctctgcgttaacatcggtcctggggaaacccactgtgcctgcttccaaatggaaatcagggcggcgaactggggctgttttgctagaggtgctcctggtcataccatgcaaaacgccttgtctgtgtcatagtcatttacctaatggcaaagttcttggaccat

SEQ ID NO: 97580 - DNA, 360 bp, Homo sapiens
  misc_feature (349)..(349): n is a, c, g, or t
gtggatatatagatgtaaatatatatgagtaaatgtatatatatatgagtgtgtatatatatatgtgtttatacatatatcggcatagatatatgagtgaagacaatttctgaaataaagatgaatacaaagtattatttctatgactcagatatttttcaataccgttttaatatattatgtttagtctttttgtctatgtatttctgtttctgtttgtgtgtctggtggtatgggtatgtaattgaaatttacatagtatttatatagtttcatatttttgtttaatttctatttcatgctatatcctaagcatatttatatcattaaaactgcttcaaaacagganaaaaaaaactt

SEQ ID NO: 97581 - DNA, 420 bp, Homo sapiens
cctgtaatcccagcagtcggacgctgaggcaggaagaatcgcttgaacccagtaggtggaggttgtggtgagccgagatggtgccactgcactccagcctgggagacagagtgagaccctgtctcaaataaacagataaattaaataaataaataagctcactctcaataaaaaggaaacagaaaataagaattaagtattctaacactgcaggctgggcacagtgactcacgcctgtaatcccagcactctgggaggccaagacgggtggatcacgaggtcgggagttcaagaccagcctggccaagatggtgaaaccccgtctctactaaaaatacaaaaaattagccggacgtggtggcaggtgcctgtaatcccagctactcaggaggcgacaaagcgagactgtctcaaaaaaaa

SEQ ID NO: 97582 - DNA, 708 bp, Homo sapiens
tcgagtaaatttactctatattttttagagatgtcgcatgggtgggaatttactcccactaaatgttttgatggaaacattacatttttggagtgaacatgtgtcaacatcactgtggagaaaaggttccaggattctctgccagccaaagtcatcaccataagacactggttgggggcctggcaggcggaggtgatgcgaccaggctggtagtggggcagaggtagccagatgggtaggagtctgcctggctggtctggagggagaaggggatctgagctgggggaactgaataggtggtgaggaggaagggagtagggaggctgtgggctgatgacatacattaaccacccacacagctcaaaactaggtgagtggggagcttgaggggcaggaacagcgagcagaggctctgaagtgttgaacactggcagctcagacccgagggacaggctggggccagattgttgagggtcctagaatcccagctcccaccagtaactagcgatgtgagcttgggcaacttttccaacctttctgtgcttctgcttcatttttagtaaaatgtagcatggatagccacagcttatggctctttggagaattaaaggagataatgtctgtaaaatacctagcgctgggcctggcacatagcaggtgccaggacacatttgctgtttgttggtgatgataaagccacacaagtat

SEQ ID NO: 97583 - DNA, 636 bp, Homo sapiens
tgagactttcagttgtaatttggtgctgttttgaagtggcatcaccttttaaaatttattatttatttatttatttatttattatttatttatttagagacagactcttgctctgttgcccaggctggagtgcagtgacatgatctcagctcactgcaacctccacctctcgggttcaagcgattctcctgtctcagccttccgagtagctgggattacaggtgtctgccaccatgcccagccaatttttgtatttttagtagagatggcgtttcaccatgttggtcaggctgatcttgaactcctgacctcaagcagtccgcctgccttggcctcccaaagtgctgggattacaggtgtgagccaccatggctggccaaagattttatttttaataaaagcaaaacttttttaaaaactaaaaatgtagaaaaaaatcttagacacttagttttacatctccaagaaagcttctgttaaagagtttggtatgttttctccattaaaaaaaaaaaaaataagcagctaggctggcttatgcctgtagtcccaggactttggaagtctgaggaagatggattgtttgagctcaggaatttgagaccagcctgggcaacatggcaaaactctgtcact

SEQ ID NO: 97584 - DNA, 611 bp, Homo sapiens
gggtgcagcatctaattttattgagtaacacagaacagctctcaacaaagagaggatgcagaggtagtccccacccccacagttgggtggtttctctctcagtggctgagtccagggcttttatgagctcagataggggaatacatgctaattggtttgtgagaaaggctaaagcaaaggtgccactcaaaggtgagcatagcagtgtagaaaatcaattaggaaacagtagttatgtgtagggtggggagacatcagaggaaagtgtgtcacaaaggaagacagattctcaatctggtctgtgtatttgactcgttgcttggctttcaggctttgtcttcagcttgaaggtggggtttcactggagaactgcccctatttgcctaggcatttgtctgcctcctgctaatatcaaattccccctctgaagaggtacatctaattgccattaggataaggacagtgacagatcttaactgcttcctgctgacaggggtcaccattttgggaagatgggaagtaatttctcctcagaggcctatctaacggtccccagtaaaagggagccatcatccaaggctccagttgcatgactgtttggagttcgatgg

SEQ ID NO: 97585 - DNA, 424 bp, Homo sapiens
ttcttagagtttctggtagcactaatctttcttaaattcaacaggggatttaatgcttttgttttcagttaagttagatgtacgtgccttccacaaaataacaaggtaatgtaatttaaatacattgtcagtgcattcttggcgtagttttgtctcttccaaagtatcctatttcacaattttgattaatgtgaaaaagatttaattgcaaacctggattgtcatctacatcataaattcctctatgctgtgaaagtgagtgtattgctgtaaatttaaaggatcttccagagttcctaagtcacagaatctaagatttttatttcaaggtttcttgattggtagcttcccaatgactgaggtaatttctaaagagagcatcaaattaattttgggttccttttgcaataccgataagtgttcc

SEQ ID NO: 97586 - DNA, 504 bp, Homo sapiens
atccccccgccgcctttccagagagggttctgcccatactcagaaggagggaatgctgctcagagacaccaagaagaatctagacagacaggccttgctcagtttccccactcagtctattagcattaagtcattcccgttttgtcaaatcatatttatatatagctgtccatacttttatgtccataagcataaaaatggacaatctcccctgtatctttgggtcttcattctgaaggctcctgtgtacatgttaaatgggtttggatgccttttattctattaatcaatctgccttatgtcagtgattttcagggaacatttaaggttcgaagggccttagcccctacaatagcatccagcaaacctatacttcaaaggatgaatgaaagcagttaaattcttctgacatcctcccacaaagcagattcctaagacacatgagttcacatcgcctctcagctgaagatcctacaagcttttgcagtcaatcaattgagctgg

SEQ ID NO: 97587 - DNA, 281 bp, Homo sapiens
cttcctgctccctttccatctgcagctttacttcctcaggtcaccacccccactgccttgtagtccatccccaacaacctaaaccaaggaccactaaatctgcaagtcaacagttcatgctttccttggaaagtggggagcaaagtagtcaaaatagttctcatgcaagtgcctttctaatagagcttcgatgagatgaaacagtttcttgacatcgcctctatgtcctgctgcattcccaaacaacaagcaatagaatctggggaaagggcggggcacgg

SEQ ID NO: 97588 - DNA, 739 bp, Homo sapiens
  misc_feature (17)..(17): n is a, c, g, or t
  misc_feature (22)..(22): n is a, c, g, or t
ccagtggccctgaatgnttttnacttggatcttatccttaaaggaattatgtgtgactaagcatttcaatggcaagaatgccattgactaggaagacagatttcgtcttattatgagaaagaacttttaaagaaaacgatccgtctcaaaaaaaaaaaaaaattaattactaataatattaccaaataataacaatgaactgtttattacataccagaagactaaaaaatgttatctcattttctcctcacaataaccctctggggtaggtggtattcttaccttctaggtgggaaaccgaggttgcagagaggggacttgcccaaggccacatggctagtaggtccccaaagcagtctggcccagagtctctgctctctgttgacttctctggctgactttacagtttccagagtgcttttttaacacactttccagaaagtctggaaaggactttacactttccagaatgctttcgcccagtgtgatctcagcccagagatgaagagaattcaagtctactccatggtggatagatagagctgaacccttagttctctttgaacaaggttcccttctaacccctaaagtgtgcttgttttaagagaaaggagccggctgggcatggtggctcacacttgtaatcctagcactttggtgggccgaggtgggcggataatttgaggtcaggagttcgaaactaccctagccaacattggtgaaaccccatctctactaa

SEQ ID NO: 97589 - DNA, 369 bp, Homo sapiens
tgagacagggtctccattacccatactggagtgcagtggcaccatgatagtagcctcaaacttctgggctcaagtaatccactcccccgccactcccccacgcctcagcttcctgagtagctgggagtacaggtgcacaccaccatgcctgactaatattttatattttttatagagacagggtcttgtttttttgcccaggctggtctcaaactcctggcttcaagccatcctcctgccttgcctcctaaagtggtgggattacaggcgtgagccactgagcctggtggatgttttttgttgttgttgttattgttgttttgagatggactttcgctctgtcacacaggctagagtgcaatggcacga

SEQ ID NO: 97590 - DNA, 180 bp, Homo sapiens
cgcggtgccccctcaccccattgtagatggatttggggcgcatctacttttatttgatccatttgctagctctttgaggattcatttaccttgatgtcgcaccaatcaagttatatgttggagccagcaatgttcaccataagattccatacaaacagctacacttctcacttctttgta

SEQ ID NO: 97591 - DNA, 262 bp, Homo sapiens
ctttaggtaacagaacattcaatgggactacagtgaaatttgggagtcattgacatagccagcaatggatacaatgactgttggaactatatacatctccttactgttgggaaaagtgagaattcctcaccagcaagaaggatagttgtatcttataagggtggaaatacagagttatttacttgttgtatgaaagttgaaatgtgtgtaaaagggtgtatggaatctgagttgtcaaaagaataaacaatgacattaattt

SEQ ID NO: 97592 - DNA, 214 bp, Homo sapiens
tcacgcccacaagactggaccacctgctctgctatatcataactgaatcttgggcatattttctaagaatttttttcttttagagacagtgtctcgctctgtcacccaggttggagttcagtggtgccatcatagctcactgcagcctcgaatttctggactcaagtgatcctcccacctcagcctcctgagtagttgagactataggtacatg

SEQ ID NO: 97593 - DNA, 408 bp, Homo sapiens
agcctgtagcagggagggaatgaaggcatgcagggttggcgtgtgagtgaggaagagggcttgtccccctttcccctctgtccctgcccccgcctctcctggggacctccttgcagaccctctgcagctgtgctcacatcccactactcagcctcactgctgttctaaaaaggcagcattactgcctgctgatcaggtgatgaggaacctgcaacccttcccaaatttataaagaaaacagaggaattcagtaaattctctttctgctcttggagtaggacagaccagtggtcagttctggggacagtgctcctggtgtggagacagtgttggctggacacacccagcttgggtgcactggggtcaggtggtcaggtctaactgcatccccctcctgtcactccatct

SEQ ID NO: 97594 - DNA, 353 bp, Homo sapiens
ctctgcccccgttaacaataactctatgaatttgactattttaggtacttcagataggtggaatcatacaatatttgctcttctgtattatttttaaataaaaactcttttgatgagataggtcagagaaaatccattttattgccctagtttttagtacattttattcaaacaagaacccagcaatagttaacttgctgcaatgtctactgagacgtctaaaccaaaacatgtcttgctgatgccagcttttgccctcttcacaaatcctgcttaggaaaggttcatgacactgccacagtaggcctgaccctgccagggaaaggcatcaccgcggttctgggtagctctgg

SEQ ID NO: 97595 - DNA, 805 bp, Homo sapiens
tggagctgctcgtgtggaggccagggccgtgaggcagttgagttggaagcattttctcaggctttttggactgggggctcacctatgaggaggcctggtgtcgatggggtggggtgcaccaggcatgtctctgggatgagcagaggctgagggagccccctgcctttcccccacaatacggccttctccatccacactgggaccccttccaaggccactttctgacctgaactttgtgctccagaagatttcacctctttggaaagagccagagacacttatgggcaggctcagccttcaggctgcctgagagcagcagagatggggacttgaggacagaccacttctcccaccaggacaggttctggctttggaagccctcgctttatggaagggccgaggcagccaaggggatctagtggggccctgagtagaccctgcccccagtcccctctctcagctccaccgtagcagcaggatcaggaccagccacccccgacaccccctgctgccctgcctccgtcttccttcttctgctggttcctgtgggggtctcccgaggaggagctccttgggctttgtgaggccagccgatgggcttggagtgaaagtgaaggcagtccgattcagtgaggctgcaccttttctcctggatcaagagccaaccccaggctgggtggtggtgcacacctgtaatcccagcactttgggaggccaaggtgggaggatcacttgaggctagaagtttgagacagctgatcaacaggaactctataactaatgtgctttttctgttttcttgttt

SEQ ID NO: 97596 - DNA, 459 bp, Homo sapiens
gttgggacgtcagctgggtcagctgaaggacttgtgagtgcagctccctgagctgcagctgaccacacaagtgggcaactgaatacagtccccataaagcatgtttatcttatctggggctggagattagctgtgttgtgcagaagggaagaggcattccaggtctttccagctgtcttgcctgtgaacatttatcgtcccctagttccgacgtttattatccccccgggtggatagcactaattcataccagtctgtccgatggcagcaacccccatagatgtatgggtcatggcggaagagggagaaaccccagactcttgctatttggagggaatgagattctgatagtcacagccctcagcaaactgttctctttggaaccaatacagttgttttcctgtaagaacacagagaagacccaggcaactctgggttccagaaatgaaggcctccttg

SEQ ID NO: 97597 - DNA, 845 bp, Homo sapiens
tgaaaagttttccttttattggttttgcataatggttgcaacaattctcaagtaatgaaaaaagaatgaagaatgcatgtcctttccagtacatagccacaatgttaatgctaaggagaagcaaaacaaaacaaaacaaaaacccaccctaaaagtggtcttggacacccagccctcctctcagctcccttatttggattcatgatgtttcctatcttttctcctcttttttcaaaataaactatttatgctcaaagaaaatctgtcatctaggacatctgtgataatgttcttgtggcctgggttggacccttgctccactaccaactagtataaaattaatgggggacatgacttaacctttctgggcttatatttgtctcattcgtaaactaggaataatggagtttacttcactatattgttttgaagattaagtaagagaaggcatataacagtgcctcacacactgtgaattgaacctacatatattaatatatctattgtctaatataagaataaaaacaccattctctgcccccattgcatagttaataggcaatgtatatgaataaaactgagtcttaactcattttggtatctactgtggcacataagagacactaattattgtctgcagaattttttactgtcaacacatgtaacattgtacatagcagcagcctattgtataagtcagtaaactacagcctgtgggccaaatttggactactgtctatttttataagtaaagttttattatgacagagccacgcccttttgtttaagcattgtttatgctgtctttgtgctacaatgaagagttcagtattttcaacagagac

SEQ ID NO: 97598 - DNA, 175 bp, Homo sapiens
gaacagacattccgcagaagaacggccagcggatagaacatgaaaagaatgctcgctctcagaagtacacaaagaaaggcaagctgaaacaagagacaagtgttgcctctcaacttctgccaaagtcagactgactgtgtggcctggccctgacctcgctgggcagaggccggca

SEQ ID NO: 97599 - DNA, 370 bp, Homo sapiens
tggtacagacagcaaagaaaactgtaacaaagtaaaccaggcccaacttgcaacagccctcaaccgagcccaaaaaggagatcaataatgttcatccctttctatgatctaactctgtgaagtagatacttattttatggctagggttactgaggcttaaagaggcagagtaccttttccatggtcatataacaaataaatggcagagctgggcttcaaaccctgactgtttcaccacaggcctgcacccccatcatcaggacacaccaatggcattctctgcaaacagcacaacttacgactgtgggcaggcagggtgatgcaattggtgtaggtactagggcaatctaatttaatgatcttttctatc

SEQ ID NO: 97600 - DNA, 392 bp, Homo sapiens
cctaaaattatacccattcaggacattttccttttattactttagagctatttcatttccatactttttcagtttctacttcatcaatatctacaaaagattataaaataagaatagcaatggctaaagtttattgagcatacattatattccaggcacaattctaagagctttatgctcattgatttatttcctgatctcagaactcttagaggtaagaactattattatctctatgttgaagaagagaatactgagacttagggaggttaaacgacttttcaaggttgttcagctgctcagcatcatacccaggacctgaagctaagcagtcttcacctccgttaactccaggtttaaatataaatatgtacagtccaatctgacagtca

SEQ ID NO: 97601 - DNA, 379 bp, Homo sapiens
  misc_feature (357)..(357): n is a, c, g, or t
tagtaagactgtatctcaaaaaaaaaagagggtaaaagataattgaactgaaattgttacctgaacattcagaataagcttaggggcaagataaatttggttacacacatgtcaaatttaaaatgcctattagtttctaaatggaaaagatgtgtcaacatttggatatacaaagacctggaatccagaagcatgagcatcttagcccagctggcattggggcatgactttggctcttgttttgacaacttaccctcccttttatcctatttcccatgccaggctctccaatgtgagctacaaaatacactttaataactcctttctcaaactcctggcctcaagtgatccaagcgnatcaccggttcgggtaccgagc

SEQ ID NO: 97602 - DNA, 264 bp, Homo sapiens
ttttggggtgatttgttgcacagaaataaataactttaaaaaggctctaaaactctagctcttcagatatttcatggcatttcctaaagaacctaaaatctcaaaatctcataatttttattatttaggtatgtgtttcttcattattacctattattgcataatttttcttagcctttttaaaagatacatattgctttacaaacccattaaaaagtgaggtagtttggctcagcacagtggctcacacctgtaatcccagca

SEQ ID NO: 97603 - DNA, 255 bp, Homo sapiens
tccaggagatgaggttggagctcatgctgcccatgaagggtgcccagcccaagagtcaccatcagcccccaggcccctgctcctcaaaagagcaaaagctcacccactggtcctgcacatggcactgcctctcccttctgtctaaggagctgggctgggtaactccacctccccttcccagcacccaggaagagctgctgatcaattatctcctgggctggcaactggccaggtaccatggcttccaagcatcat

SEQ ID NO: 97604 - DNA, 300 bp, Homo sapiens
aaacctgaggcaacagaacccctctagcttaaaaaaagttaagcttctcatttacttgcatgtgaggcctctaatttttttccttctcaccctgtcttacggtgctgactctatctaatcttatccccataaagaatgacagtgtgttagtccctgaacaatgtgcgtgaacattatttttgttagagatggggtgtcactctgtcacccaggctggagtacagtggtatgaccatagctcgctgcagccacgacctcctgggctcaagtcgactgagcagctgagactacaggtacgtg

SEQ ID NO: 97605 - DNA, 1099 bp, Homo sapiens
gtaaaggtaacgggaaagagctatactctgacaacggccacgcgtaggaattagacacagacttctttaaggagaagagctgctcatcatctgtctgtgtgcctcttaccacacagaattaattccatggctacttgccattaccattgcctaaaagttcgccagatttgggagacagtgggagcaactgcaggaggctgcatcctgtacaggtagccttgggccatggtggctgtaggaaacacttggtcatgaggtggcttccccaagtggcagatgcagaaaccagtgagaagtaattttagattacggaattttttttaaagacaggaccctgctggcgatgtcatattcacatacagaaacaactgctctagtgaatctgaagatggagaaagtaaccaacctccttcctcagtgattgataagagcaatgtacgatgttgcccctgtggaagaagccttttcttgctgatggctgagttttctatttgtcccttttatttttactatggcaaaacagttttaattaaaatgagacaaggccacgtggagtggatccagcactttgggagggatcacctgaggtcaggagttcaagaccagcctgaccacaatatggtgaaaccccatctctactaaaaatacaaaaattagccaggagtggtggtgcatgcctgtagtcccagctactcaggaggctgagacaggagaatcgcttgaacccaggacacggaggttgcagtgagctgagattgcgccattatactccagcctggcgaccgcgagaccgcatttcaaaaaaaaaagagaaagatctcatctagatacatgtctcctgttaatttaaatccacagacccttgttgactcaatctaaagacacttgaagccactgtaccccagaatttaactcaggaatccacttcactccatggtttataaaaatgtgactttcttttgtaagcctgattgattgtttaaaatgcagtgtcctcatgaatggtaatatttgttttcttgacagcctgagttctccaaacctccaaacattaataatatagctaccctgatatccagtaaagtcatcctcttcctta

SEQ ID NO: 97606 - DNA, 745 bp, Homo sapiens
agcaaccagaggcagaccctcgaccttggacttcccagcatccagaactcataagatttacctttattttttaatattggagaacttgccatgtaaatcctaacatgtggatgaactaaatacctggggagttcatcatctctcacaaactaaatccagagaaaaaacttcctgacacaagaaaaaactgcagttaaatggaaaacaaataaagcaaatgaaaattggaatgtggagcattttgcatgccagataagaaagggcatgtgacaaaggagagccatttcttccatttgagattggagggggaagagtccaaggctagaatcatgtggctgaccaggctcctgggacttccacatctgcacaatggatcatgcaaaggtccgcagcttcactcctgagccagcaagaccacgaacctaccagaaggaagaaactccgaacacatcccaacatcagaaggaacaaactccggacgcgccaccttaagagctgtaacactcaccgcgagggtccgcggcttcattcttgaagtcagtgagaccaaaaacccaccaattccagacacactatcctgggggagcagcctggccctaaaagagacttgtgcgtgaccccaggagacccactgacatggatcaggaaactgctttagaatcccaggaacagggctacgaccaaactccgtactctcccatttgcctatcgtgtcagtatctctgtattgtcactggtgtattaa

SEQ ID NO: 97607 - DNA, 264 bp, Homo sapiens
cggagatggagcacattcccgaggcttcgtgagtaccctgtgcacactcggcatgaccatcacccctggggggaaacagagactcccagacaccgcatgaccatgccaaggtttcaggatttattttacaattgtgttggaaaccttgcttggggcctcagctcttgctggaattcattgagggtatatgtggacagggctatgtggtgataaattgtggtgggttgaaattttactggtggtgtctagggttggaatagcttt

SEQ ID NO: 97608 - DNA, 143 bp, Homo sapiens
ttttgaagtaaatattatcctatccccgtaattcaagagaaaaaatggaggagagagtttaagtgttttgtccatggttactcagccagtaaattctggaattgagattggaatccaagctttttgaactattctacctatct

SEQ ID NO: 97609 - DNA, 279 bp, Homo sapiens
aacagcagccactgaaccagtaacctgaatgcgaccggagtaattggctccagggtggcgggggccccgtggctgtagtactaccaaaggcaaggtggacgtgctgaccctattggacagtggagtcaaagcagaaatcagtctgactgctgcagacctgtggtgttggctggttgatcatgatgttcctcgaagtgaaatagacaggaagcctactaagttcgtacttaatctgtataagcagaaaacttctaggtcaagcaaacaaaagtctatccc

SEQ ID NO: 97610 - DNA, 853 bp, Homo sapiens
agctaactggtgaaattctaaggaggaacaagtttctggacagacgttggtaatttgtgatcattattaacaacagccctatttcttgtaggcctcgtgaaagcttgtttgattcggtcagtaaactccctgttgttttctctgtcaagagcttccagtcaaagctctcggtgtggtccattaagaggtgtccctttcagctggctaatcaggaaaaatataattaaatctaactgatgagtaaggttgtcatctaacagggcaggggttaggtgagaataacatgaatttccaagatctcactctataaagaggaaatgaggagccagaaacacagtggctggaaatttaaagtatccatgcatttaaaggagcaaataatagtgtgctaaaggaagtgcacagagcagattccagtggaacagagtcaggtaggaaagcttagcactgaagaaaagcactgtccaaactgacttgaagggcgggcagccgttgtgtaagtcaacaccctggagtagggagggactggatgcatgccactgaggcccaaactaagaatggtcaaaatcttttgaccattttaaaagagttctttatgtgttctggatctaagtcttttgtgagacatgtatttcaagtattgctctctccatctataacttcccttttaattatttaacagtatcttttgttaaataattttaattcaatgaaatccgatttattgatgttttcctttatggtttatgccttcagtgttctacggaatctgcttaacccaaggttatgaagatgtctttttaggtttatctctagaaattttatagttttagttttgtaaatattttggtca

SEQ ID NO: 97611 - DNA, 428 bp, Homo sapiens
tgcccttgcaaagagcaggccttgtcctggcccttagcatgggtgtgcccaccagcccctcacccagaccatggtcactagagaggccccaacacccttgttttgggtgaccccagcactcagtggaaagaccgctggaatgggagtcagaaggcctggatctaaccctttccctgacttttgataactgatcttaggtgagtaatttcttttcgctgagcctcaagtttccttatctataaaatggagatttgctgggttattgctgaaaataacgagagacaacagatgtcaagatgaaggggtatgacaatagcataaatttattgagcatttattgggtgccaaacacttggctaaacactgtccatgcattggtcttcaaatagccggctgaagtgggtactgtcatttattatgatcatttt

SEQ ID NO: 97612 - DNA, 136 bp, Homo sapiens
tgaccacttctccttcctggagatcttcatatctccttaccttgctttgctttgatttttgtttgtttgtttgttgtttgtttgttttgttttgagacagagtcttgctctgtttcccaggctggagtgcagtcgc

SEQ ID NO: 97613 - DNA, 138 bp, Homo sapiens
atagcgtgggatttctctaagattgttgatattaattccattagactcttatgtgagtgaagacgaagacttcccctgagtaagttcagacagcttctgataacatttctacatcgattcctcaggatttaactatat

SEQ ID NO: 97614 - DNA, 357 bp, Homo sapiens
gagcttataaagccccattttccatttttacagtttgggcactcagaatatttgggctgtctcccaggtcctacaggagctatttgcttcctttaaagggactgtgaattatcctgcctttcctggtatattcctagagtagttctatgtagttttagcaatgcaacaagatttaacaggttttcttttgtttgagataacacttagagttttttgttttatttttatgaaaattaaaaagtacgaacacaaaagtgaggttggagtgaaagtttaataagcaaaagaagaaagctttttgctagcagagaggggtttctgagtaggagttccccctgtgaggctggggttcagggt

SEQ ID NO: 97615 - DNA, 397 bp, Homo sapiens
gcatacctttaataattgggacaaacacacacacacacacaattgggccaccatttgttctaagtatagttgcataacaaagctgactgctttaaaagctggactaaatcatgctgattgcttgaaagtccagactacaagaacattggggctaagaactgtattttcttcataacctttggctaaatttgtcaaactgaactccaaaattctcctaaagattctagttctgtctcctattcatttattgtagatgttaaagtgtgactagatgcacgtcatatcagatacagattgtttaaacaacatgtgacggcaattctattatgtgtcaaatagagatttttggtaagcaggcaatcatttaccttagagcaaacaagttagaaatcaagaa

SEQ ID NO: 97616 - DNA, 208 bp, Homo sapiens
atacatacaagtatgtatatgtttatacacataatatatgttaatcgtctacctccccattggaattaagctctacaagggcagattttgttttgatcactgttttgatctagggggccatagcacctagaacagtgtctagaagataaatgctcaacacacatttattgaaggaatgactgcatacaccaactctgttcttaaatct

SEQ ID NO: 97617 - DNA, 495 bp, Homo sapiens
cttgcagggacatggatgaagctggaaaccatcattcacagcaaactatcgcaaggacagaaaaccaaacactgcatgttctcactcataggtgtaaattgaacagtgagaacacatggacacaggaagaggaacatcacacaccggggactgttttggcgtgtggggaggggggagggatagcattaggagatatacctaatgctaaatgaggagttaatgggtacagcacaccaacatggcatatgtatacatatgtaacaaacctgcacgttgtgcacatgtaccctaaaacttaaagtataataataaaataataagtaataaataataaaataaaattaaatttttaaaaaaagaagttaagagctgggattctcacaatatggcttgcagactacaagtgtgaactgaggaggtccccaaagtcacttcttactaaggtaatattttctttgtttttttttagagagagggtcttgctctgtcacccag

SEQ ID NO: 97618 - DNA, 493 bp, Homo sapiens
tctaggtctctcctgatgccatgtaagatgtggcttgcttccccttcaccttccaccatgactgacaagaattcaaatgctctttctttgtggatgacattatctgatacctagaaaacctgaaagactgccaaaaggcttctggaaccaataaacctcagtgaagtttcaggatataaaatgaatgtacgaaatctagtagcatttctatacaccaataacactcaagctgagagcaaaatcaataatgcagtcacatttacaacacaaacacacacacacacacacacacacacaaaacctaggaatacatctaatcaaggtgatgaacgatctctacaaggagaactacaaaaaatgctgaaagaaattacagatgacaatccatgtcacggattggaagattcaatgtcattaaaatggcatactgcccagagcactttacagattcactggtatttctatcaaataacaaatatcatttttcagggaa

SEQ ID NO: 97619 - DNA, 952 bp, Homo sapiens
agaagactcttccagctgccagaagtttaggggcaggggcagggaagaagactgggagttcacagctttcaggacacatgcttccactcaacacccctgttttcagtacaggaccccagccctcaactaagtctgcgaactccccatccagagaccctctgctttaccctctccagggaataacactccaggcttctgtcagagcagggaagggccagcccctcactggcattgacagcaggaggggatttggcaatgaatctacttcttaaaagagttttcaaacagccttcattattttgatacccaccccccttcacttccagaggtaactccacttccagagttaccttggtccagcctttgaagattcctgggggtgaggagtaaatcaagttagctttttgcttttcccactaaggtctcagaattcctagtttgtggccttcttggatctgctaagtcagttgccactcatccatctgttcttcagcatccaaaatttagttgttgcctcctttcctgttcttcaaccctttttatttcatcttcactcctatccttctaatcctttcaaaaatcacatttgtagcagttccagtggggttttgggagatggtgaagttagatgtggaagtatgtgctccaccttaactatgcatcatcacgagcatgggtgtctgcctgcctgtctcattgattctacacaccttcattaccacaccactctccctaaaactctccagactcagcttttctcatctggctctctgacctgttccctgaccattctgttctttcagctctcagccttcggactgccaaaaccccaagccaacttcctatccaggaaccctccggcctagaagttcagatgtcttgccaatatatctgtgcttcacaacttgcctactctctctgacccctaacattttcacatacttttccaatt

SEQ ID NO: 97620 - DNA, 346 bp, Homo sapiens
ccaggtaacagcgtgccttgctggtgagaaggcctcatgcaggaaagaaccggctctttgagagactgaaaggaggccatgacggcagggcctagtgggccacaaaagagagaaaatatttaggcagcatgttttcttttagatgaagacatggaggcacagagaggttaaatggctcgttcaaggtcaccagcaggttagcaagaagaagaacccaagtgctctgagtctgggctagggcgcttcctgcagcccttgctacctatgggctggatttagggtaacagaaggtgacctgggaggctgctgggtgtggaagcagagctggaagccttgttctcacaac

SEQ ID NO: 97621 - DNA, 367 bp, Homo sapiens
agctattacacattttctgatctatttgtctacaggttaatttatgtttaaatatgttttaaactgccactgaactgacttagtcacatatttaaactttgcagtaggtctgtgaaatgtgctttgtttctggtcagcatggacacccgctttaatagtggcttcagatgaggcaccttgtgacagaggagctcttcccctgcagcaaccttgaagatgttgtggaagacaatagccattcttacttcactctgaggatcacgatggcgtgcaagggtgtgccaagcacattgctatctttggccattctctctcacattagtacacctggatgtgaatggcacgttatctatgtaagcagtgatgg

SEQ ID NO: 97622 - DNA, 817 bp, Homo sapiens
agtccgtagtttacattaaggaagactcctgatgttgtacactctatggattctacaaatgtataatgagacaatcaaacttcagataatcatgcaacaaggtttccagccagttccaggtgtagacaccactcccagccatcaagaaactactgtcaaggcaagggttctgtgatcctcaatagggtaaatgctggaggggctccaatttggaagtgttacattatcaagttaaatcataagagcaatttataaaagagatagcttggaattaaactacaaaagctgcttaaggtaaaatatgcgagggaactctcttgttgccattgtgagaccctggagaacagatggaaccaactctcaagcttctgctcgggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaacctagcagaaggcaagaaataactaaaatcagagcagaactgaaggaaatagagacacaaaaaacccttcaaaaaattaatgaatccaggagctgcttttttgaaaggatcaacaaaattgatagaccgctagcaagactaataaagaagaaaagagagaagaatcaaatagatgcaataaaaaatgataaaggggatatcaccaccgatcccacagaaatacaaactaccatcagagaatac

SEQ ID NO: 97623 - DNA, 269 bp, Homo sapiens
gaggagccagagatacaggaaagaaggccagagatacaggaatgaagacggaaccaaaattggagttttgctgccacaaacaaaggaataccaggaggcactagatgctggaagagaaaagaaaccattgtcaccctggagtgtgagcctgctcataccttaattttagacatctggtatctagagctatgagaaggaatttctgttattttaagccattgactttgaggccatttcttgtggcagctataggaaactaacacaccagg

SEQ ID NO: 97624 - DNA, 375 bp, Homo sapiens
gaggggtggggttggggaacctgtgcaggcaaaggcatgtgagggggaatcaggcagcacagcatggcaggagcttggggctgaaacaagcagaggctgaggctccaggcaagctgcactgtccactgtcctcagaggcttgaagctgcagcaaagagacaggaccgcttagggggtatgtgaggtgaggggtaccactgaggctccccactctccagcactggggaggtgtcctctccccagagagggagaggatgggttgaatagaaattagatgagccagagaagaatcacgcttccccatctcagtacccgttcatcaccaccaccaccaccgccatagtcaccatgagcagcatcagcagcatcactgtt

SEQ ID NO: 97625 - DNA, 1322 bp, Homo sapiens
agaaaatagaatttcaacaatatacgaaattgtgtatgtgtacgtttataaagtatatatacatcatggccacatggggtttattccagggatgcaaggcttgctctgtattcaaaaacaaatcagtgtactccaccatttaatagggtaaagaagagaaaccacgtgattatagcagttgatgcagaaaaaccatttgacagaattcaacacccatacatatttaaaaactctcagaaaaataggaattgaggaggacttcctcaacttgttaaagagcacgtgaacacacaccaaaaaaaaacccacaactaatgttatacttaagggcaaaaggtcgaaggccttgttccttagattaggaacaaagcagtaatgtctcttctcaacattaatcaacatattgatggaagttctagccagtgcagtaaagcaaaaaaaaaaaaaaaaaaaaaaaaaaaaagaaaaggcatacaactaagaaaggaagaaataaaaagtgttctatttgtggatgatgtaattgtctcagtaggaaatctcaagggatttgcaacaaaaaaaagtgagttcagcaaggttgcaggatacaaggtagacataaaaatcaatcgtatttctatgttttagccatgaaaacatgaacaccaaaactcaaaatatatcatttttaagcacacaaaaaataaaatgaaatacttaggggtgaatctaaaaacagcatgtgcaggccatgtattctgaaaactacaaaactacttacagtggtgaaagaagtaaaagaaaatctaaataaatagagaggcatactatgcctactgtttggaatattcaaccttgtaaaatgtcacttattcacaaattgatataaatgtttaacacaattcatatcaaacttccagtacaatgttttgtagatatagacaatattattataaaatatatatggaaaggcagaagaactaaagtagctgacacagcttagcaaaggagaatacaatgggatgaatccacccattgatttcaagttttgcttagccagtcatcaggactgcgtgatactggtaaagggatagacacatagatcaatggaacagaataagtaacctggaaacacgcgtacaaatatgcacaactaatttttaacaaaggtgcaaaagtagttaaatggaagaagatagccttttcaacaaatggaactctagcagttagaaatccaaaataaatgaacttcctcctaagtctcacaccttaaaaaaactaacacaaaatcctggagttaaatgtaaaatatgaacatatttatcttttaggggaaaaaa

SEQ ID NO: 97626 - DNA, 1190 bp, Homo sapiens
ttcggcacgagctcgtgccgaattcggcacgaggtgattatagcagttgatgcagaaaaaccatttgacagaattcaacacccatacatatttaaaaactctcagaaaaataggaattgaggaggacttcctcaacttgttaaagagcacgtgaacacacaccaaaaaaaaacccacaactaatgttatacttaagggcaaaaggtcgaaggccttgttccttagattaggaacaaagcagtaatgtctcttctcaacattaatcaacatattgatggaagttctagccagtgcagtaaagcaaaaaaaaaaaaaaaaaaaaaaaaaaaaagaaaaggcatacaactaagaaaggaagaaataaaaagtgttctatttgtggatgatgtaattgtctcagtaggaaatctcaagggatttgcaacaaaaaaaagtgagttcagcaaggttgcaggatacaaggtagacataaaaatcaatcgtatttctatgttttagccatgaaaacatgaacaccaaaactcaaaatatatcatttttaagcacacaaaaaataaaatgaaatacttaggggtgaatctaaaaacagcatgtgcaggccatgtattctgaaaactacaaaactacttacagtggtgaaagaagtaaaagaaaatctaaataaatagagaggcatactatgcctactgtttggaatattcaaccttgtaaaatgtcacttattcacaaattgatataaatgtttaacacaattcatatcaaacttccagtacaatgttttgtagatatagacaatattattataaaatatatatggaaaggcagaagaactaaagtagctgacacagcttagcaaaggagaatacaatgggatgaatccacccattgatttcaagttttgcttagccagtcatcaggactgcgtgatactggtaaagggatagacacatagatcaatggaacagaataagtaacctggaaacacgcgtacaaatatgcacaactaatttttaacaaaggtgcaaaagtagttaaatggaagaagatagccttttcaacaaatggaactctagcagttagaaatccaaaataaatgaacttcctcctaagtctcacaccttaaaaaaactaacacaaaatcctggagttaaatgtaaaatatgaacatatttatcttttaggggaaaaaa

SEQ ID NO: 97627 - DNA, 1113 bp, Homo sapiens
gcatctcagccatggctaataaggttaaaatgtttgtatgagtattatatcataatttaagaaaaaacacgcactaagtgacacaccccgaaaacctcagaactaatgttatacttaagggcaaaaggtcgaaggccttgttccttagattaggaacaaagcagtaatgtctcttctcaacattaatcaacatattgatggaagttctagccagtgcagtaaagcaaaaaaaaaaaaaaaaaaaaaaaaaaaaagaaaaggcatacaactaagaaaggaagaaataaaaagtgttctatttgtggatgatgtaattgtctcagtaggaaatctcaagggatttgcaacaaaaaaaagtgagttcagcaaggttgcaggatacaaggtagacataaaaatcaatcgtatttctatgttttagccatgaaaacatgaacaccaaaactcaaaatatatcatttttaagcacacaaaaaataaaatgaaatacttaggggtgaatctaaaaacagcatgtgcaggccatgtattctgaaaactacaaaactacttacagtggtgaaagaagtaaaagaaaatctaaataaatagagaggcatactatgcctactgtttggaatattcaaccttgtaaaatgtcacttattcacaaattgatataaatgtttaacacaattcatatcaaacttccagtacaatgttttgtagatatagacaatattattataaaatatatatggaaaggcagaagaactaaagtagctgacacagcttagcaaaggagaatacaatgggatgaatccacccattgatttcaagttttgcttagccagtcatcaggactgcgtgatactggtaaagggatagacacatagatcaatggaacagaataagtaacctggaaacacgcgtacaaatatgcacaactaatttttaacaaaggtgcaaaagtagttaaatggaagaagatagccttttcaacaaatggaactctagcagttagaaatccaaaataaatgaacttcctcctaagtctcacaccttaaaaaaactaacacaaaatcctggagttaaatgtaaaatatgaacatatttatcttttaggggaaaaaa

SEQ ID NO: 97628 - DNA, 490 bp, Homo sapiens
gagaggcaggagaatcgcctgaaccaggaggcagaggttgtagttagccaacatatcaccactgcattccagcttgggtgaaagagtgagacttggtctcaaacaaaacaaaacaaaaaaacaagcagcatatttgctggggctccagtagtgaggaaatgcagaggggagtgagcggaagaaatccttgtcctcagagtttttagtgacagcagacatctcgatatgttctattgaagacaatggatgatggtattaaaataaacagggtagaggtaagtcaaacagagaggcattgattggctagacttatgctggtcatttaagtcctcttttggaaagtgatatgaggaaagaaactgaaggatggtagatcatgaaccagcatgctaactgggggagggaatcttgtaaataaaatactgagctagtgagaaagtagaatgatttatggctcataacttacacgaggatcccccataaggccctg

SEQ ID NO: 97629 - DNA, 779 bp, Homo sapiens
attaaatgtcagctgaaggttgaatcgggcaaaaactgaaagaagacaacagtttgaaggcttccctttccatttccaaacataataccaaatgacttaaaatgaatgaagatgctttagagctctgggtgtcacgataaaacataaacttacacattcactttgacccacatattgtcctttctaagatgtttcaaaatgggaaaatcctctgtgtcattttatttgaaaaaaaaaatcaggaagcaccattgcatgcatgtgagccgagcagatgtgcatacaaacatgcgtgtgtgtacatgaagcacaaccagcatttggaatatcctccctcaggcaaagcaaggacctagaggctgactcctgcgtattgaatcaccctggctacctggccaactggcttcaaattgggcttgaccactgggaggtcctgaaagaagactggaggacaacaagaggcagatactgggggttttcctttcttcctactgagggccagattgctggccctggctgtgtccttccaggacacagcttccaaaaagagggccctcctcttggccccatttttattgtatttgctaacaaacttaaattcgtccctctagggcttggaatgggaacaccttgccatttttgctgcctctgagtgcctaatttcccgtttttttgcttttgctcattccaaatcgagaaatatttttctataaagcgccctgaccaactgggcttgattcaatttttatttttcagtaataatagttgattgcgcgaac

SEQ ID NO: 97630 - DNA, 363 bp, Homo sapiens
tttctttttttttttttttttttaagaaataaggtgtcgctctgtcacccaggctggcgtgcagcagcacaatcacagttccctgcagcctcaaacacctgagcacaagcaatctttccacctcagtctccagagtagctggaactataggtgtgtgtcaccaggcccagctaatttttgtattttttgtagagacgtggttttgttatgttgcctgggctggtctcgaactcctggactcaagtgatccttctgcctcggcatcccaaagtgctgggattacaggcatgagtcactgtgcccagccaaaattttttttatctattggttcctactataaatatgatataactctcttaaact

SEQ ID NO: 97631 - DNA, 452 bp, Homo sapiens
tccacacaaaaaccagacgtctacagcaggtttattcataactgccaaaacttggaagcaaccaaaatgtccttcagtaagtgaataaatattcatacaatggaatcttattcagcagtaacaagaaatgagaatgacatggaggaaccttgaatgcatattacttagtgaaaaaaaaaacagtctgaaaaggctacatgctgtctaatcccaactatatgacactctgttaaacgcaaaactatagaaacagtaaaaagatcagtgactgccagggattaggagaacaaagcatagaggttttttgttgttgttgttttgttttttccagggggagtgggggcgggggcagtgaaactattctgtatgatataataatggtagatacctgtcattatccatttgtccaaacccatagaaggtacaacacaaagagtgaatcctaatgtaaa

SEQ ID NO: 97632 - DNA, 321 bp, Homo sapiens
ttagtagagatggggttttgccatgttggtcaggctggtctcgaactcctggtctcaagtgatccacctgcctcggcctcccaaagtgctgggattacaggcatgagccaccacatacccagccaaaaagatattaaagaagaaattagcactcataaaagcaatccaacgggccagaaaagccaaggattttagaataaaaactagataaatatttgtacctaaaataaatctctcttttataaaattagcaccacacaaatttgtgaacttttctactcttaaggattatcccctatgaaaccagagggtatcctacaa

SEQ ID NO: 97633 - DNA, 528 bp, Homo sapiens
attacaggcatgtgccaccgtgcccggcccgatatacttttcttctagcagttttaggtttacagaaaattaaacaaatagtatagagtttccacataccctttctctctcccccagtcgttttctcctgttattgatatcctgcattagtatggtacattattacaactgatgaaccaatattgatatataattattaactaaagttcaatatttacattagggttcactctttgtattgtacagttctgtgggttttgacaaatttataatgtcatgtgtccagtattatcatgcagaatagtttcattgccctaaaaatcccctgtgctccatctgtcctccactcccccaactcccttgcaactgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacc

SEQ ID NO: 97634 - DNA, 710 bp, Homo sapiens
ctagatactaggtccaagtatgggcgtctgacccagttctggaaaatgagacgctcagggaagtctacttggtgcttctgggaaagctatttctccctagtaagagagagacaccctcttccttactgctggatcattgtggtgaggatctgatgactcacttagaagacatcacctagcgtgctgagaatgatggagcagacagatcaagatctgggtctaggacaacatcactgagtggttgaaacagatctggaagtatctgctttcctgttcactaacaatcaacctccttactctttaagccactgctagcaggttctctgttacttgcagccaagcatatctgtattagttatctactgctgcataaaatgaccacaaatatttcagccaagaaaaggaaaaaaatgaatagaataaacatggtaattatttaatatgagtgatggatctataaatgcattatactatctcaactgttaattatattcacattttttatgatttttttaaaaaaaaaaacacagaataaatcacccgcaaccctaaaaaaacaaaaaatgggcccgttggccctaaggggggggacctctgcgggccgctctcctttaaggggggggaaattcaatggacctcccttcattactcgctggcctcggccgttcggttgggggaggcgggtttcacttacctcaaggggggattcc

SEQ ID NO: 97635 - DNA, 397 bp, Homo sapiens
agaatagaaggaggtgccttccactagataaccaaaaggtcagacagattataaggccttttaggcaattgtaaggatttgggactttttttctgggtagcttctgggggcttctgagcagaggaatgatatgattcgatttctatgttctcaaatcactctgacaggcaaggtaaaaacaggctatatgggagtcaggctggcagcagggagactgaaagcaattgcaggcttctgtgtaatactgctgtaaatcatttcaaggttccaggtgcagcgaaattacaccatagggcatcaaatgaataaataaatgagactgaagaagctatgattgtcatctttaagaaactgcaaaaatgaaagtgatatgcccagtatacatgtttctaacctg

SEQ ID NO: 97636 - DNA, 470 bp, Homo sapiens
accaaagaacaggggagaaaggaatgtttaaattaaaacatcacaaagcatgttgttcttaatgagatccagccacttttcttgaataaacactctttggatttttccaaaattttagataattcctagggttcacaaaaacttaattttgacatttttggcaagtgcacttgttggttttatggaagactgattttcttttaagttcttattctgctgttttagaagtgcatccctcctattcaattttttagtaatatattttttctccacgaaaatttccaatacttttaaactatatgcaaatagtagttatagctgttttagagcttggatttgaaactattatctcgagtgcctatgatctgttttgtttgttacttcctcattggcccattttgttgtgttttgttttgctgccagtgttgtctttgctgaatcatttctacaaataagatatgttgagctgt

SEQ ID NO: 97637 - DNA, 373 bp, Homo sapiens
ccaggcaccagctaatgcagtacatctgtgagcagtcgcttgctcctcacagcaggaccatgggattgatgccgtcattaccatcctccccatgttatagatgaggatattgaagagaggtgacatctaaatgcaagctggtatcctggattagatcccagaacagaaaaaggacattggtggaaaaactggagacatctggataaagtctggagtggagttaatagcagtgtaccaatgttaatttcttagttttgatgaatgcactaggtaatgtcagatgctaacattaggtgacactgggcaaacagtatatgggaactcttgctgcaactcttttgtagatctaaaattctctcaaaataaaatgttt

SEQ ID NO: 97638 - DNA, 410 bp, Homo sapiens
taggcttcctatgctatcatggcctcagcaagagtcataatgcctacctagggcagctaaaggcattaagaatgaatgttcaagctagcaaggtggaagctgaattccctaggctctgaagacaccatcactttccctgcattccactggtgaccagtgagtcacaagctatccaaattcaaagggagagaagttagactttactttctccccctcagttttagtaaggtatacttgacaagtaaaaattacatatatttaaggagcagaaggtaatattttgatatatgtatacattgtgaagtcaataccacaatcaagctaattatcatatcatatctatcaccgcacatagttaccattttgtgtgtgtgtgtgtgttgagaacacttaagatcagctctcttagc

SEQ ID NO: 97639 - DNA, 653 bp, Homo sapiens
gtaggggagcagggtgataataaggggaaggtcaacaaaaacaacacaaaacaaacacgtgagcaaaagaatccatatcattattaagttcaagggaaggtactatgcctggacgtgcacgtaggccagatttatgtttctctccacacaaatatctcagcggagtaaagaataacaaggcagcattactgccaacatgtctcgcctcccgccacagggcagcttttctccgagctcagagttgaacaaatgtacgatcgggctttacaccgagacattcagttcccaggggcaagcaggagacagtggccttcctccatctgaactgcaagaggcgttcctctttgactaatccacctcagcacagacccattgcgggtgtcaggctgggggacattcaggactttcccatcccacgaggccatatttcagactgtcacatggggagaaaccttggacaataccctgctatcaagggcagaggtccctgtggctttccacggtgcattgcgcccctggtttattgagactagagaatggcaatgacttctaccaagtatactgctcgtaaacatttggttaacaaggcgcgtcctgcacagccccagatcccttaaacctcgattttatacaacacaggtttttgtgagctc

SEQ ID NO: 97640 - DNA, 609 bp, Homo sapiens
cactttagtaaacagtctggcagtttttaaaaaagttaaagttaccatttgactcagaaatctcacttctacatatacacccaagagaactgaaagtgttcacatgcaaacttgtacacagattgttcacagtagtattgttcatagtagccaaaaaaacacccaaatgttgaataaattgctgaataaacaaatcatggcatacccatgcaatggaatatttggccattaaaaggaatgaagcactgacgcatgctacagcatggatgtgtcttgaaaacatcatgctaggtgagagaagtcgaacatgatacagcaactccatttatatcaaatgtccaggacaggcaaatctacagaaacagaaaagctcctacggctggggaaaatggatacactgggagtgagagctaaagatatgacatttattttcagggtgatgaaatggtctaaaattgattgtggtgatcgctgcacaactctgaatatacaaaaaaaagaaaaacccattgaattgtacgctttaaacgggtgacttgcatggtgcgtgaaatatatctcaataaagctgctacaaaataacaattatcggggatgacagggaaggtt

SEQ ID NO: 97641 - DNA, 725 bp, Homo sapiens
ctgatatgatcagattgctttgaggactgaagttgacttttgtggagccgataaaatgtcccttggagagactggccttgtaccttgtctacatgattcccttacaagcttcctgattttgtgatcgcttgccactggattactaatctgatttctctctccatagctaccaatcctactttaatatgtgaaaccttttgaaaataaagcttcaaacaggagactaaaaaatcaatatttcaccccaaaatattgctgatctaaagaagcagctcaagttctaactccttcccccatctcccagtcctctgtcctccccaaagcataggataaagctgttctctaaaattccctcatctatctagaaactggacctaccaaagaggaacacaattgcctgcctcgaaattttattaaccagagaagactaaaattcatatcacagaggaagaatcccaaaccatttcttctttctgccccattccaatttccaaatggttagtaaatttccaatttactaaccattgtcggaccattaggcccatttatttccacctaaaaatcatttattatccctcagattgccacacttcccccattttcccttcccctgtgaagaaggggctataagtatctgtaccccattgggttattgggcaatcattctcctgcaactcccctgtgctatgcacattaaaataaagtattggcctcgttggcctcaa

SEQ ID NO: 97642 - DNA, 593 bp, Homo sapiens
gagccaggcaatgtcatccaagacagataaggaaaggacacaaggccaagggctggaaggtatcaaatcgcaacacaatgtccaagattccactagttatttatgccccacttttgctaaaacttcagatgaacctcgaaggggcagacatcctttcttcctcacttatcttggctttataaccacagcttgatatttctttgggaaaagtaagaatctttctactatccaaagttcaatgaactatcgagcagttcattataagtgaacttgccttcttaaagctaacgttctctctaaaatcattgagttccaagaaggtggtacaaaaggattgtattttgtgagcttgctgcatcaaaagtccccaaatttcatgtgccctttcccaaattatgctgttcacttaaatgcattttaactctccagatatttattgagctgagcactgtgttagaaaaagacctggatgctgccctcaggaaattcacagaccaaaagatgagatagatgaataaacagatcatgtcagtccagcatggtaaatgagatgttagaattacatacaaggtggaacttttcttttttgagac

SEQ ID NO: 97643 - DNA, 667 bp, Homo sapiens
agcggagttaaggagaggcgggcgggactgaagcagagcccgagaacggggctggaggtcccagggtcccgggttggtgggggtggagcagcacttcatcgccgcgggggtgctgggactccggccgcagtgccgccgccatcatggacttcctgtgggacaagcgcacgggcctggccgccagaaagatgcctcatcctcgaaggtaccattcctcagagcgaggcagccgggggagttactgtgaacactatcggagccgaaaacaagcaacgaagaagccgttcctggtcaagtagtagtgaccggacacgacggcgccggcgagaggacagctaccatgtccggaggaggtgcagccggacatttagccgctcgtcttcgcagcacagcagccggaaagccaagagtgtagaggacgacactgagggccacctcatctaccatgtcggggactggctacaagagcgatatgaaatcgtcagcaccttaggaaaggggaccttcggccgagttgtacaatgtgttgaccatcgcaggcgtggggctcgagttgccctgaagatcattaagaatgtggagaagtataaggaagcagctcgacttgagatcaaagtgctggagaaaatcaacgagaaagaccctggcaagaacctctgtgtccaga

SEQ ID NO: 97644 - DNA, 148 bp, Homo sapiens
ctgtaaaatggacttaatcatagctgttgtatcacagggctgctgtgagaagtcattgagatgatgtatataaaatccttagcacagtgagctcttataaaatggtagggacaacaccttagccccggggttgctgattcctccattt

SEQ ID NO: 97645 - DNA, 756 bp, Homo sapiens
tggggagatctgactctgcagccatccctcaccactcctgcttggacatcgccaggctcagctagagaaggcagaaaaagttcctccaactccttccccaggcacctatgcaggctccacactcctgcctgaacagctatgattttaaaagccatcgagtcatgaagagaagtgtgccagtgtgtgctggactcagtttcccctgtgcaccattttccccagtcagccctgcaccttccaagaactatgacccgaaggcacaccctagtcagctcaggccccacattcctgcaaaaataaggctccagggctccctcatcgcagcatgggttctgcaggaagccccagtgccaagtggctttcaaaactagcctcagctagcaacgtggcggctatttcagcgaccgacaaaagcagctcccccagcctcccttggtgtttgtggtcccttttgttccagccaggcaccatgaggaaaatgcagcaaccgtttggaaacaaaggctcgggcaggctctctccagtctgaaaagcccactttcacttgagtttcaggtaatttgctgtgcagcctgaattcgttagacaaattaggctcacttggacttcaggtggctcaattacctgggtgatttgcatgtttatgagtgaaggggactgcacagtagcagaaagcaaatttgaaatcctgactttgggggccctggagcccctttgctgcacctttactttccctaccagaaaggaggaaggaca

SEQ ID NO: 97646 - DNA, 138 bp, Homo sapiens
gaagtctcgagagaactgcaaatgtctcctggcattgacaaattagaccattttgttttcagtggatcaactaaggttaaacttaaacaaatatgagcagctgggagattttggaagaagcaagatgtgcacattctc

SEQ ID NO: 97647 - DNA, 491 bp, Homo sapiens
cacacatgctcttgctctacacactgcagccacactggcctttttgcagtatgatgtgtgtgctacatgcccacccacaggcagctgtgtacaagctctcctgctgcctgagatgttctcctctcttctctcttcactgaggccacccttactcaaccttctttagctcccagatcagggaagctttgctcacatagtttctatgagacaataacccctcagtaattcagcccatactgattgattgcctactacgtgcaaggcattgtcctagacaccagtgattcagcaaggaatcaggcaaagtcgctgctctcctagaggtcatgggccagtgagggagaaagaatctcgaaagaaacagttacatgtattgttaggtggtaatgggcactaagaaaagcaaaccagggcagggagatagagaatgaaagggcagagctgctattttagacaggtggtcagggaaggttctggaggagaggacatag

SEQ ID NO: 97648 - DNA, 260 bp, Homo sapiens
ttaaaagaaagtgcatacttatttgcaaggaaaacaaatggaatagacaaaaattttagaatataaagactttttttcatttatgtatgtgtttacaattcaaaataataaagctagttaaaagtcaatacatattagatatattcaaatattttaccaaataaatttcgatcttatcagttaacacccatagcaaaagactaaggagtatttgtataacattagggtatttgaactcatattctattcatttgggttta

SEQ ID NO: 97649 - DNA, 533 bp, Homo sapiens
tatctaaggatccccaagttacagcgttcagggggggggcatctgctctcctctctgccctaggccaggaggaacagtgttctgtggccctgggggagggccaggaggtggctctgagcatgaaggtggaaatgagctccggggacctagacctacgccttggctttgacctctctgacggggagcaggagtttctggacaggaggaagcaggtcgtgtccaaggccctgcagcaagtgctgggattgagtgaggctctggacagtggccaggtgcctgtagtggctgtgttgggttccgggggtggaacccgagccatgtcttctctgtacggcagcctggcagggttgcaggagctcggccttctagacactgtgacctacctgagtggggtctctgggtctacctggtgcatctccacactctacagggacccagcctggtcccaggtggccttgcagggccccattgagcgtgcccaggttcacgtctgcagcagtaagatgggagctttgtccacggagcggctacag

SEQ ID NO: 97650 - DNA, 690 bp, Homo sapiens
aaagggtagagggcagcaaccgacttgtgcgaaaggagggaacgtgtgggtctgccagggtcctgcaggggggatgagaccctcgctccgctccggcgatcccttcgctctccaccctcggccagcccctcctgtcctccatcaggcctcgctgaggatacctcctgggttccaaagcgcgagttgaacctgagcttgacattcattccgtctcgtacaaaagccatgcctgcggggagagggagaaaatttcctacaggagcctcaagactgcgtttcaggaagccctaggacccactgatcctgcagctgcgcctctcactcgcctcaggctttggtatcaggatgatgctggcctcataaaatgagatagagaggattccctgtttttctgttgattggaatagtttcagaaggaaaggtatcagctgttccttgtatctctggtataattcggctgtgaatccatctggtcctggactctttttggttggtaagctattgattattgccacaatttcagctcctgttattggtctattcagagattcaacttcttcctggtttagtcttgggaagtgtatgtgtcgaggaatttatccatttcttctagattttctagtttatttgcatagaggtgtttatagtattctctgatggtagtttgtatttctgtgggatcggtggtga

SEQ ID NO: 97651 - DNA, 325 bp, Homo sapiens
cccaggaacctcaagatattttggggaccttgatgattggactccggtgaagactccaagatggcgatcgccacctcacataccctgactcagcatttccgggttcacctttcctgttcccgccaccccgactaacgcgcatgcccactagggcgtgtcacactcagaagcgcgaaactcaaccgaccccacccctaccccgcccactcctcacccagcatccataaaagcgcgctgcacctttggcacagcgcgacttccctggccctccccctgcgggccagtgaacctcgcccaagagctcaataaagatttttgccctctt

SEQ ID NO: 97652 - DNA, 326 bp, Homo sapiens
tattccattatcttaactttacagagaaaaaatcaaaattcaaattgttggttgtaacgttgtataattgacaatgtttttaaaagttcccctttaaacatctgaggaaattatgaacaatgagataaatgacaaggccttctagacacagaaagtcagcttaaaatggagcaaaatatatcccaatgcatttgagattcttgtttttgattaaaatagcatttcaaatcagtggtaaaacactggattactcaataaatacagtggactaaagactagacatttgaaaaaaatttaagctagatgtttatctataccttatagca

SEQ ID NO: 97653 - DNA, 135 bp, Homo sapiens
gacctgaaggttctcccaggcttctcctgctcccgtgccaataagtctcctacatatctaatccaatctttgtattgtcctggcagacctgaacatcatagatgaatggatggatgaataaattgagatctatat

SEQ ID NO: 97654 - DNA, 310 bp, Homo sapiens
gtaactgggaaccctctcacaattacctagccatctttgaaacatttgagaatatccagagcagaattttatcaggctgacaagagtggttaatgctacttctttctcagtgtaaaagaaatgagtcattctgtgtttgttcctccctcatacaagagataattttggttggtactcagatgatagtttccccagttttcttgtacttgggtgaaaaacaaggaagaggtctagaaactaaaacagataaactgattgctttcatttcatattatcattagaaaaataggtagagcagttatggttctta

SEQ ID NO: 97655 - DNA, 445 bp, Homo sapiens
  misc_feature (75)..(75): n is a, c, g, or t
acattcggaacgaggaagatttcttgactttataacaaaatactaaaagtgttgttgctgttggcctggggctgntagttggcccaggggacagagcagcttcccagcctcctgtaccttccagccgtgtgtgcacagacagtcattctcctcctcctgtccccaggtgtcctaaccaccccctctccaagagctgactgccaagtccagtccttcttctgctgggcacacagaggccacactatctttctgagggcctgcggaggacttttcatgggggatgagcctctagggggtgaaataaagcacatggcccacgctgggagacagagatcccaggatgttggatgtgtggctgcctctcttggggaaagggtgggtaccctccaacaactggacgctcacctgagaagccttgccaaagccaggggctcccaacccagtg

SEQ ID NO: 97656 - DNA, 146 bp, Homo sapiens
gatcaggcatgagctgatattcactggaactaagtgacaggtagataggaattcatcagactctctgtctagtttttgtttgtttgtttgtttgtttttgagacagtctttctgtctcccaggctaaagtgcagtggcacgatctc

SEQ ID NO: 97657 - DNA, 533 bp, Homo sapiens
ctgcaccatccatgtgaatactggcttccaatgtctctttccaagattgctactgtgcttggttcatggatgatgacaacaaatgtaaatcttacccagagtatgtatgcaaatgtagacaacaatttgttttctggtcatgttaaatttactgttcagaaccttatagggtaaatgtagaacaacacatcttccagccatatcttctgcattctttaggctgtaatccctgcattcctgcaatgtgatctctttcagtgccggctgtatggatgctttccacacatgacaccaacagggaggttaggagggtcctatggtcagagtgataagagtggtcccactcacgcacggatcatccttccctcaccctcggcagcttaaaactgacctgagagagcctgatgtcactacatcgggtggaccctacaagagagggcatggattgatagggtcacttgtaatttaggagtgattgtcttgaaagcccttgagggagacaggcacagccttgctcaggtctaagaatggta

SEQ ID NO: 97658 - DNA, 503 bp, Homo sapiens
  misc_feature (12)..(12): n is a, c, g, or t
  misc_feature (32)..(32): n is a, c, g, or t
  misc_feature (37)..(37): n is a, c, g, or t
tttcgagcaagntactcactctgtcacccagnctggnatgcagtggctctatcttggctcactgcaacctcatccaaccgggttcaagctattctcctgccttagcctcctgagtagctaggactaaaggcattcaccaccacgcccaggttatatgcagtacagaagagcaacttcagctattgagttacacctcaatgcaacatcctggcagaccagccttaagcccagccgtcccaccatgcatctaagctgcgttctcatcagacccaacttcaatgataaacaattgagatgatgccagaggccagaatccctgagaacccaattggctgtcatcaccatggctgaaacaaggcgcttggcatctagaaaagctgatctgtaggaaatttccaatagagttcattttttctaagtttaaagtgtacaatatcatcaaggtcagacactcgagataaaactaggcttgtgtttaaatataataaaaatatttgaagaat

SEQ ID NO: 97659 - DNA, 406 bp, Homo sapiens
ctagagagcgtccctgtcagaggggagcccagcctggcttccgtgtgaccccagagatggtgaggacggcatggggtgggctggctaggagggggcacctggaggaagatgaagccttggaggacggagtagggacaccctgagcaccttgcaagcttggccagcctcggagctgtcactcctcatacagagccttgtttcctcctcaccaggatcctgccagagataggagatcctcactttacaaaagaggtatctgggcccagggagctggtccaatgccgtacagctgggcaggggcacaagtgggtcccacacacctgcagggaaagctggcgcctttgacaaccctgctcccagctcatccccacagccgcccccgggaaggaggcatgactgtcatcag

SEQ ID NO: 97660 - DNA, 572 bp, Homo sapiens
tgggattataggcgtgagccactgcgaccacagctcattctcatcttaactaattacatctcaaagacagtatttccaaataagttcacattctgagactccaggaggacatggattttgggaggacagtgttcaacccagtacaggagtggagcccacattcattctttcctcattttatgaatccagtgataacctccatcagcaattgtccatacactgtgttgcctcggggtctaattgctgtatgtgtgtatctttttttattttttatttttggacaggatctcactctgtggcccaggctggagtgcagtggtgcgatcttggctcaaccttccaggcacaagtcattctcccacctcagcctcccaagtagctaggattacaaacatgtgccaccatgcccacctaatttttatattttttgtagagacgaggtttcgccatgttgcccaggctggtctcgaactcctgagctcaagcgatccacccacatcgacctcccaaagtgtgggattacaggcgtgagccaccaagccctgcctgtgtgtgtgtatcttaagtcccaa

SEQ ID NO: 97661 - DNA, 472 bp, Homo sapiens
ctcgcgtgcccctcctaaccgaaggagttttgaaaacagaaacccctactctcaaaagcaggaaggcctccctggagtccccgtgaaccaccgagcagcctggtggtctgggggccagcaccccactttcactttctgggtcccatgtcttctgaatgtcagtatccatcctcttctccttgcccactactaagaggtggctgtgcatgtgtgctgaggaagccttggaaccgaggacaattccagagttctccgcggaggtcaacatgccttctagctaatctgatttcagaggttgtcactcattgtcacagtgtggcctgacatactggggggaggggtggggacagccctggtgccaccaaataacatcataagcagcaaatccacacttgaatggttcagagtgcagagctttcttgggcgtcatacataaggatgagcctcccgtaactcaattctcaaacacaag

SEQ ID NO: 97662 - DNA, 389 bp, Homo sapiens
ataattctgagcagataccaaatatctggctgttaaagtcttctggatgactttcaagagaagttatttaacttctagtgaaatgtaatataattagtaaaaaaattttaattaaataggaaatggaaacctcgccaaagtaattcctggacatggctcagaacgacactatcaatcctaaaagtgttaaagatcaggaagagcagcatttgctacagtgcctatggcccaaaggaattcagaataatccttagaaaaattctcctcctcccccaagaaaagtgttttatttttccaaaaagagacattaaaaagttgttatgaaatcaaagaatgtgccttacaattgatgagcttttagaatcgagaaaatatagtaatatgcatga

SEQ ID NO: 97663 - DNA, 549 bp, Homo sapiens
gcatgcctatagtcccagctacttgggaggctgaggtgggaggattgcctgagctggggaggtcgaggctgcagtgagttgtgacagcacccctgcactccagcctgggtgacaaagagagacctctgtctctaaaagaaaaaaaaagacatcaaccagttgggatgtgtggacatcataagacaattaaggaaatgtgaacaatgtctctgtgtttgattattgttaaaattataaaatgtgatattaatggtatagtggttgtttaaaaaggtagtcctggccaggcgcagtggctcacgcctgtaatcccagaactttgggaggccgaggtgggcgggaattcgagaccagcctggccaatgtggtgaaaccctgtctctactgaaaatacaaaaaattagctgggcgtggtgctaggcggctgtaatcccagctactcgagaggctgaggcaggagaattgcttgaacccaggaagcagaggttgtagtcagccgagttcgtgccactgcactccagccctggcgacagagtgagactccatttc

SEQ ID NO: 97664 - DNA, 469 bp, Homo sapiens
cagatgagaaaacaggcccagaaaagggcaatgccatgctggtctccatctacagtcttgcttaagcctggtggttttattcctgtagtaccaatattcaccacacatctcagcttatgcttctggtcagctgttgattccagttatcagaaggatggaccttctctgccctcaaaacgatctgagtgttggaaagaagagcaggccaagagtctagttctttttcctttatctattgcctggcaaattcctgcttatccttcaaggcaactcaaatgtcacctcatctctgaacctctgtaaaaagtgaagtagaagttcctcttcaaagagactttcctccgcatctaattaagaacaaatgtaacttctcttagaagcaaaatttattcaaagacctgtgctaacattctaaaatatctgctagccgtaataaagaaatcaatatactttgtgttcttaactccca

SEQ ID NO: 97665 - DNA, 441 bp, Homo sapiens
aatagtttgtgtccctgttgtaggctcaggtatttcacaaaatccttctcatcttccccactgaaatttagtctcgtgtgaaatgaaacacagaatttactactttactcctaggtaattcccaagatcacctgcctcacttcctccccagggcacaaaatcagagatgtgccaacagaaggcatccactgcagaccctgtaatcttgccaccaccattcttcatgagccatggagaagcttatagaagctggactcctctccccagaaaaataaacacacacacaacacacaaggatctgtatgtaatctcaaggtctcaccccaggaaattcaccccagggtccatgaattcaaagtaagcccccctcagtaaggatgcttcagcggacccctctgattcacaggggtctccattctcacgggcttgctggtttcgctg

SEQ ID NO: 97666 - DNA, 165 bp, Homo sapiens
tcctagagtatccccctggagcggttttcctcctacagattctgcctgtgcacttattccttcagagaagccctatattcacagccccagctatcaacattctttttattttttagttagggggaacagagtctcattctgtcacccaggctggagtgcaatggc

SEQ ID NO: 97667 - DNA, 1063 bp, Homo sapiens
gtgctctgccttctgggagcgtttggtgctggcacctcctgaacttgcctgttgtcacctgccccagtgtgtcagggcaagaccatagacagaagtcctctgacaaatgctgaccgtgacaacagtcttggcaaacttcagtaggcagagatgggctgtccccattgggaaaaagaaccacaggcctgccacttctctgtgaggccgcctggactagatgcaaatttaatactcccctgtcatgttgctaaaaccctctgagactcaggtgacagctacttgcttcatttgactgtatggcctacctggagtgggaggctgggaagatgggcttcttctgagcagcccctcccgcagcctgtgcagctgcctgctaatagctaaagcatgtaagtgtgcgggctgtggagactcctgataactgcggttccatcgtgtccctccaaagtcctggaatgacatgcagctcttgaaagccagcaactcgcagcagacactgaagtcctgcctttccccacaggggtttgtttctgtgcatgtttctcactttggccttaattatgatgagtacgcgttataatctgtccaggtgtggggtatgatggccagtgcttgagtaatgagatgggaagaaactcagcacacaccatcatgaagaggctgaggctcaaggagtgaacaaatgagcctaggctcatgcggtgctgggtggagagctcagggccctgagggctgtatgttctttggcctaagagtggatgaagaaacagtttgctagaagtgcttgcaccaggccaggcatggtggctcatgcctgtgagcccagcactttgggaggtcaaggcgggtagatcacttgaggtcaggagttcaagaccagcctgaccaacgtggtgaaaccccatctcaactaaaaatacaaaattagctggacgtggtggcacacgcctgtaatcccagctactcaggaggctgaggcaggagaatcgcttgaacctgggaggtggagtttgcagtgagctgagatcaccccattgcactctagcctgggcaacaagagtga

SEQ ID NO: 97668 - DNA, 392 bp, Homo sapiens
gaggttagaatctcagcttgaggtttaacttggtagaaaccaccaaatttgaaaagcaaggagaaaaaagactgaaaaaacaaaagaaaacaaaacccagaacagagtatccaagaactgtgggataactacaaagggtgtaacatatgtgtaatggaaattccagaaggataggaaaaagagtaatacatgaaatttctgaaacaataatgacaaaagaatttccccaaactaatgtcagacaccaaaccacagatctaggaagctcagagaacgtcaaccaacatcaatgtcaaaagcaaaacaaaacaaacaaaaaaactatacttaggcatataattctcaaaactacagaaaatcaaagatagagaaaaaatcttgaaagaagctag

SEQ ID NO: 97669 - DNA, 450 bp, Homo sapiens
ttgctgaggtctccaaactttctttgtagagctacttccattatatcccagtgctctaaaaagaattttatgtgccattgcaaatattgaagtacttaactggctgactgaggttggatttattttacagcattttgaaaaatctctggtaagttagtaagactctaaaactcggccacagtctgacacattactggctgaaagagtaaaagggaacagacggacagtgttgtgtgcagcaaaacagtaactgtcctagtccaaaaattgtaatagtttgtggcctagtaaagaatgcaatatgtcactttttctttttactcatgacaattttcatgtatatattttgagactaatttctgagaatatacatattaagcgatatgcttataaaatgtggagtatcagtattggagatagcatgaacctctcaatctgtgaattgagatt

SEQ ID NO: 97670 - DNA, 441 bp, Homo sapiens
gttcacagttatttgtgaaaaataattatatatgacagaagtataaaaatttctaaaagaaaaactatgcagctaacagtagttaagagaccagctggctatcttctaaaaagcttccaacattggtattaccttagtaattcacatgaactccttaccgctaatgatgaaagagtaggtttttagttgactaaagacaatggtatgaagatgttcagcctctgtggctaactataaactatatatctaaagaaggttactactgttagtatagattatgatgaaagaaaacaaacctaactattttcccaaagctgtaactcagataacaacaaaacaggtcaacaaacaaaaacagttaactcttgtttcagaaagaaaaggccacagcaggagcaggagtttttaaaaaagaagaggccgggcatggtggctcacgcc

SEQ ID NO: 97671 - DNA, 825 bp, Homo sapiens
caaactcctaagagtggaatccagctccactcttcaccagttgtgtgaccttgggcaagtgacataactgcttagtgcttctgaacagaatcttaatctataaaatggagcccatacatagttgtgacctcacaatgttgttacgaggataaatgagttaatattttaaaagagcttagaacagttcctggtacatagtaagtgctaccggtttgttaagttaataaaatacacagtttgtatggttggcttgttttgctgttcccctcctccatgtacccctgcaatccttttgtcatttccttttgtacccagtgaacttcctagtgcccatgttcacctttaggcttcagttgtgttttagtctgcttgggttgttccaacaaagtaccatagactatgtggcttataaagagcagaaatatctttcccacagcctggagaaacctgagttagggtataagcatggccaggttttggtaagggcccacttcccaggtgcaaagagctcacttctcactgtgcctcctcacatggcagaagaaacaaaggaactctcgcaggtctcttttaaaagagcagtggtctgggtgtggtggtgcacctgcagtccctgctactcaggaggccgaggcaggagaattgcttgaaccctggaggctgaggtttaagtgagccaagatcacaccactgccctccaggctgggtgacagaataagacttcgtctcagaaaaaaaaagaaagaaagaaagaaaaagagcactggtcccaaaggccccacctctggatatcatcacattgtgggttaggaattgaacatatga

SEQ ID NO: 97672 - DNA, 355 bp, Homo sapiens
ttctaggtgcttggaatatatgatgaattaaagagaaaaatatccctgccctcatggagcttatgttcttgcagagagagacaaactacaaacaatacacataatacatataagttatttggtcttttgcaaggtgataaatgctacggagaataagaacagagagagggctctgtacacggagaggggcagagcagtccatggttgaacaggggtctctgaaggtgtgtgtgtagcagtgagggaaggggtggaaatgccaatggaaaggaagtcatatgtaagaagggcacagcaaaagggcttggtgtgacgtatggcatcctttcatgacaggaaagagtgggccgatgca

SEQ ID NO: 97673 - DNA, 470 bp, Homo sapiens
tgcttatgcaattagttaaaactttttttagtcggaaaggacaggctgtgttaggtcattgctgtgtgtagtgcctttttgagtaacttgtatttacttagagtggacttttcaaggaatagaaaggttaaaatgaattttgtgtgctaggatgtatatggggatctgtacacctgtttaaaaaaatttcaaaactaaaatattaaaatatgtagccatttgtctttgacttaactttggtattttgctgttaatcagtagttactctatccctaagttagtagtctttgttactctttaatttgtgttcaaagggtagacagttccctaaatcttttaactagttctagtgtcaattggggaacctgtggtttgcctctttatttccagtggactctgttttagtgagatgatgagatgaaagttggcacagctttatggtcttcaagctaaaagttaaagatttggca

SEQ ID NO: 97674 - DNA, 605 bp, Homo sapiens
tccagaacccttggctgcagggcctctcccaagactggctgctcatggtcacctctagaatgtggcctttccatgacagggtgaggaggctggagcccagggttacctcacatgctgagtcccagggcaagagagtttgagacatgtcacagagaaagggaagggccggtcaccaaacaatgctgggcatggcgggggcagaagggtggcactaaggagaatgtgatgcagttgctggtggcgtctgcacgtcggggcttcttgggactctggctcccgccgacatgtgctcagtggctctggggcatgctctgagatttgtgacttgtcctggagagtcaacactgtcttcctgacattgggaccaggggcctggggagtgcaggtgagagcccgcccctagcacctaggagctctgggtggctttcgcctgccacctgttggctccctgggctggcctgtctcaaaggagcacttcctccacctgatcttgagtcccctcctcccccagcgtcctgtgagtgggcgagcaggtctctgcttccctgcatggcttggagcttcgactttgtctcgggcaggcaggggagtgtggggaggggctg

SEQ ID NO: 97675 - DNA, 435 bp, Homo sapiens
gctatgtaaatatttaccattgtgtttcaactgtctacattattcactacattaacatgctgtacaggttgtagcctaggagcaataggctagaccatctaggtttgtctcagtacaccctgtgatgtctgcactgtgaaatcacgtaacactcagaacatacctccttcattaagcatagcatgactgtgtattagcaaaaatcagtggctaaggttctgtctgagtccccatgctctttctgacctgggtgagcaaggtgcaggtaatgtacatatacagtacatattcaatagagcattttttttgctcatggtctgagtggaagttaggagtagcctcagggtttttccttcatctgttcaaaacccgtctccctacccatacaatctggcactgaaagtgttggtataaagaatacttgaaagaagaaga

SEQ ID NO: 97676 - DNA, 306 bp, Homo sapiens
gctatgtaaatatttaccattgtgtttcaactgtctacattattcactacattaacatgctgtacaggttgtagcctaggagcaataggctagaccatctaggtttgtctcagtacaccctgtgatgtctgcactgtgaaatcacgtaacactcagaacatacctccttcattaagcatagcatgactgtgtattagcaaaaatcagtggctaaggttctgtctgagtccccatgctctattgaatatgtactgtatatgtacattacctgcaccttgctcacccaggtcagaaagagcgtcgacg

SEQ ID NO: 97677 - DNA, 258 bp, Homo sapiens
ggtcgacgcacatgggcatttaatttgtgcatcgtcatctagacacacactgcaaaaagtaaaaaggagaaatgtaatgtaaatagcagggactattttctcatcatatctgttggggatgtacatttcaaacatcaatgatggtgtatattttcactgactttcactgggacataaacagagcaacttagatgtcagcgattatccaatcccagtctcaccattttatagatgagaagatggtgagccagagaggag

SEQ ID NO: 97678 - DNA, 745 bp, Homo sapiens
ctgggctactatatctatatagagatatttggcttttagaactcacttctaactagctcatttttgtccctgtttctttatggcttttatacgttcaatgtccagttttggagatgggatctcactatgttgtccaggctggactccaactcctgggctcaagcaatcctcctgcctcagcttccttagtagctgggactacagccatgtaccacggcacttagctctgtgtccaatgttttaattaccacctccaggtgtttaagtaaaacgttcgctggttttgtttgtgttttgttctgctagaaaagaatttggaatcaagtaatttctgagctatcagtttcatcactaaaaatctcttgataatctaccattgatgggagcagaaaaaccacctttgaggaaatgtgcaggcttagacctccctgctgcgactgttacaagtagacgcttgcaggggtttccctgaaagggtcacagcaaggccactgatgccttgtgacaccaggcagcaggccaaattgtggtttgcactcctgcatatacttggggtgtgattttctgtttgagacatttttctttgatttataaatccttccccactcgtcaacactggctacatctccttctcttccctgaacaaaacaacccctcacccatcagggtgcaggatgagaaaaccaggatatttcttaaatgggaagtaaacagcccaacagaatcaagggaaagacagtaaaac

SEQ ID NO: 97679 - DNA, 552 bp, Homo sapiens
  misc_feature (498)..(498): n is a, c, g, or t
  misc_feature (522)..(522): n is a, c, g, or t
  misc_feature (530)..(530): n is a, c, g, or t
tttgtacgctcatctgtacaaatgggatttaaggctgtgtaaacacattatgaattattttttaatcattcgttgataaaatctccaagagaagatttggcctctcaatttgatgtgtcattatgtaacaacccatggtagaaaaatgtgcacttaggtattgtgaaggcagcttaggctgggttcaggcttctctgtgatcacagtgcatttagtctgttggcaacagatctttgatttcttccctctgatcaccttatcccaggaactgggcattgggtaagaacttgggatcctcagaaattgaaagcagtcttgggtgattcatctacggttggaatcaagacctgggcagtaccttgttttgcagactgacctaagccaatttgggtatgctttaattagtgggtttagtttggtagcaacaggtaattgccaaagcttagaagtaacctttctgccaagatttactcatcgagccaagatttactcatcggncaagatttactcatcgggccaatnaccatcgncaagatttactggggatcctct

SEQ ID NO: 97680 - DNA, 1090 bp, Homo sapiens
tggaaccagagacatcagcactgtccaggctctctcatgatcttcaaccttcgccagtggcatttcatgaaataaatacagtgtctccatggtgcattgttgctgtgatatttgccttcctttatttaatcgctctggtaatagttgcagctatggtagctaagattcattgtcttaaagagatcctgaataaggcaaccattgagactgcacattgcaacataatatcacaaaacaaaggtaattggtcttcctttgaagaaaactgacattttatatctactgaaaataaaatcttggcatcaaggaaatttgttctgaagcattgagctccagtcccatcaagaccaataatgaagaattggaagtgtataatgtggtattcattcttacattttcttacacatcagataattatcaatagagaatttttaacatattgtgttcacttaagcatgctaaactcaacattttataaattggagacatctcaatcaaactcaaaagattaaaatatgaccttaaaatgattttagattttaaatatatttgcatacagaagtaaatgcaaatataagaaatttcaaatgttggctaacaatgggggaaaacatcacatagacacagaaactaaagggaatctggtcacaagtggcaactaaaaaagagctaatattctgttgattgcttcaaatattcctggtactacatcaatgattgtgggcattaactcacgtgttttcccattaatcttatgatacaagtattaccactgccattgttgtattaataagaaaaccaagacccagagagaatgatactttttttctgggtatcagaaatagtaagaattagaagcttaaactatgatttaagctaaaagagtctaactctaaagatcaggaacatagtcattatgctttgctgatcccagaacaaaaaatcataatgaatcaaattgtaagaatattgcttctttgtaaatagtcagagctgcttatacaagcagatttacgtttttctaccctgcatgtatcttctaaagaggaacagtgagaaaaagaataatagctcttcataaggactattt

SEQ ID NO: 97681 - DNA, 157 bp, Homo sapiens
gtcaaattcctaaaccagtacttttggcttttctggggggctgggggagagacagagggagagacggagagagtataagtgggtgtatgtgagttgcagagaagaggagagttatgatagaacgagatgtgtatattagaagctaaggaaaatttaa

SEQ ID NO: 97682 - DNA, 523 bp, Homo sapiens
tcactttatataaacttttattaataaaaaattttaaataaacatttcaattccaaatatacacattatgtaattccttgtctatggagtggcttttaccttgcccaatattacattttacaaaattcgtatagatgaaatcagaataaagaagatatgtgaagttagattttcccattagcatataattcataaactcttaattaccatgagataatctaaaacaagatattcttaagagaatcaactaaggaaaatttagcataaataaattttatttatttaataatgagtcagcattgctgagggacaaacctgagatttgtagtactgaaattattcatatcacttacataatccagaatcatgaagagggttgagtctgagatttgagatcctcatattgattctagggaaccttaaggcacccaggcctctctttagaaactgattacgctatagggagaagacactcagaccttaaccaagtctcctatctgaatttaaacaagaatgtctaaag

SEQ ID NO: 97683 - DNA, 347 bp, Homo sapiens
agccagagacactagctagaggaattgatgtgtatttataattcaccatatgaattttgggggacagatgtcaatctggaacatgtgtgtaatgatttacttgctcttctcctggcatcaaatgttctttccatagttgtttccagttttcttttattatgaatgctgtttctttgtaagcatgaaatctatgttcatttgatatgcaaaagtagaatcatgttttaatatgccttttaaaaatgaagttgaacattatagaaaaatgttgactttccctgttccccttttttgggagatggaggaatttgttgactgtttccttggcctatctttgttgttagagg

SEQ ID NO: 97684 - DNA, 618 bp, Homo sapiens
  misc_feature (37)..(37): n is a, c, g, or t
tactgagacatgtattatacagggtttatagtattanatattaaccagctggaatgcaatggtgtgatcttggctcatgacaacctccacctcccggattcaagtgattctcctgcctcagcctcctgaatagctgggaatacaggcatgcaccaccacacccggctaattttgtatttttagtagagatgaggtttctccatggtcaggctggtctcgaactcccgacctcaggtgatccgtctgcctcggcctcccaaagtgctgggattacaggcatgagccactgcgccagcctattttattattattttttgagacagagtttcgctcttgttgcccaggcacaatctcggctcactccaacttctgcctcccaggttcaagcgattctcctgattctcctgcctcagcctcccgagtagctgggattacaggcgcccaccaccatgcccggctaatttttttgtattttcagtagagacggggtttcaccatcttggccaggctggtctcgaactcctgaccttatgatccatccacctcagcctcccaaagtgctgggattacaggcgtgagccaccgtgcctggccctaattttgtatttttagtagaga

SEQ ID NO: 97685 - DNA, 3679 bp, Homo sapiens
cccacacgcctggagccgagggtctgtgtcaagagcggcaggggctgcaggagataagagaaacgggctgccgtggggtgtgtgtaggcttcagagacatgggatcacggaagactgaagcagaaacagtggattaagacttcctgagcgatagctggcactgccttccccacaatggcagaggtggtggctgaggtggccgagatgccaacacagatgtcaccaggggcagtggagatgtcaacacctatgtcggcagagatgatggagatgtcaacagaagtgactgagatgacacctggggaggcccttgcctcatccctcttcttccagcatcaccagttcatgtgctctgagtgtggcagcctctataacacactggaggaagtcctctcacaccaggagcagcacatgcttgctgtctcagaggaggaggcactgaccacacagaatgttggcctggagccggagctggtgccgggtgctgaggggcccttccagtgtggtgaatgcagccagctcatcctctcccctggggagctcctggcccaccaggatgcccacctccgagagtctgcaaaccagatccaataccagtgctgggactgccaggagctgttcccctcgcccgagctgtgggtggctcatcgaaaggcccagcacctttctgctacggtagctgagccaccagtgccacctcctttgcctcccccaacaccactgcctccaccttctcccccatccgaagtcaagatggagccctatgagtgtcctgagtgctctaccctctgcgccacccctgaggagttcttggagcatcagggcacccactttgactccctagagaaagaggagcgcaatgggttggaggaggaggaagaggacgatgaggaggatgaagaagatgatgaagagatggaggatgaggaggccatggcagaggtcggtgatgatgctgtgggaggtgacgagtccacagctggctgggctcagggctgcggggactgtccccagcaccagccctcagcaggggctcgccggcaacaccggcggacggctcacagcccggcatctgccacccaccccttccactgcagccagtgtcagcgcagtttcagctccgccaaccggctgcaggctcatgggcgggcccatgttggtggcacacatgagtgtacaacctgctccaaggtcttcaagaaagcagcatcgcttgagcagcacttgcggctgcatcgcggggaagcccgctacctctgtgtagactgtggccgcggctttggcacagaactcacgttggtggctcaccggcgggcccacactgccaacccattgcatcgctgtcgttgcggcaagacgttcagcaacatgaccaagttcctctaccaccggcgcactcacgccggcaaaagcggggcacctcccacaggagcaacagctcccccagctccagcggagcccacccctccaccaccaccccctgccccacctgcccagctgccctgcccacagtgctccaagtcctttgcctcagcttcccggctgtcccggcaccggcgtgcagtacacgggccccctgaacggcgtcaccgctgtggggtttgtggcaagggcttcaagaagctgatccacgtgcgcaaccacctgcggacacacacgggtgagaggcccttccagtgccactcatgtggcaagacctttgcttctttggccaacctcagccgccaccagctgacccatacgggtgcacgtccctaccaatgcctggactgtggcaagcgcttcacacagagctccaacctgcagcagcaccggcggttgcacttgcggccagtcgcctttgcccgcgccccccgcctccccatcactggtctctacaacaagagtccctactactgcgggacttgtggccgctggttccgcgccatggcgggcttgcgactgcatcagcgggtccatgcccgagctcggactttgacgctacagcctcccagatcaccatctcctgccccacccccacctccagagcctcaacagactatcatgtgcacagagctgggggagaccatcgccatcattgagacatcccagccactggcgcttgaggacaccctgcagctgtgccaggctgcactgggggccagtgaagcaggcgggctcttgcagttggacacggccttcgtgtgacgcagctgaaaagcaacaacaaaagggtttggttgcaacagccagtgtgggtacctctggggagagaggacctcctctgacaaactggtctggtacccaccatgtgccaggatccaccctggcctctttttacccactgactccccagaacaacccttccaggcttctcttgtcatctttctctgcctgaggggaaactgaagctctgaaatgcgatgtgatctgtaccaggtcacccagctatgctgcaaagtgggttggccaaggccctttgcactgcatcaccctggtgcccagcaacatcaggtaaccttcactgagcaccaagcttatgccaggtctgtgctggccactctcatatacctcttcagatcctctgcttgtacccccagcccttgccttccctggattttgggcacccaggactttgctctgcctggtggagggtacttgatttctctgggcttccttcatctcaattctgacagtgtggaaggaaatctgtaggtacccaggtcctcagctccagactgggtgatgctggagacccaggagcaagtcagcacaggctctgcccacaggaggcatgcacaatctggtaggagaaacgcacaagtacagatagcttgctctctgagtgtgtctcattgattcattcagcctgtgtgtcctaaagcctcccttctcccatactgggtgatgctgggggcagagatgagtcaggcctaaggcttctctgggctgtgatggggatgtgcagggacagtgggatcccaggaaacagacctccatggtgggagatcaggagttaaggacttcctagagaaggtagtccctgaaggaaaagtaggaatctggcagtgaaagaggaaaagaacattccaggcagacagcactgcaagagggtgagctcttggtgtatttggagaccatccagttattcatctgactgcctacctgaggcaagcaccacacttaccactgtatgtgtactatgatcccaacaggcttgtgacatagatttcatattatccctgtgtatagatttttaaaactggtggctgggcgtggtggctcacgcctgtaatcccagcactttgggaggccgaggcgggcagatcacgaggtcaggagatcgagaccatcctggctaacacggtgaaaccccgtctctactaaaaatacaaaaaattagccaggagtggtggcgggcgcctgtggtggccagctactcaggaggctgaggcaggagaatggcgtgaacccgggaggcggagcttgcagtgagccgagatcgcgccactgcactccagcctgggcgacagagtgagactccctctcaaaagaaaataaaaataaaaataaactggccaggtgcggtggctcacgcttgcaatcccagtgctttgggagactgaggcaggaggatcacttaaggccaggagttcgagaccagcctgggcaacagcaagacctcatctctacaaaactt

SEQ ID NO: 97686 - DNA, 577 bp, Homo sapiens
tttcttcctagttttaacccttttctagaaaaataggctcagtctgcctactgagaggtgaagccatctggacttccggggtcgagtggggacttggagaacttttctttcttacaagaggattataaaatgcaccaatcaggcgctctgtagctagcaagaggattgtaaaatgcaccactgcactccagcctgggtgacagagcaagactccatctcaaaaaaaaggaacagagtcaccaagacatacacatactggaccaatttgggaaagtacggaagtttgctttgaatatatagcaaaggatatgtgagggatagctgtggaagatccaactgtcaaggaaggttaggaccagactctgaaagtagagtgctggtgggagatgtggaacaggggacaagagatggaaggttttgagttggggaaaagtattctggcagcaggattgaaacattaaagaaaagtaaccctgttaagtggttatcacaatcaaacatttaccaagtaatcactgcaagtggattcaatttgtaaagtcacataaaagttgcttatctctccactttttttttt

SEQ ID NO: 97687 - DNA, 405 bp, Homo sapiens
aagaacctatgtggttttgtatgtatgtatgcatgccctgggtgagaacatgtacatacaagcttgcctttggggcaatgaaaatacccaccattatatcactgaaataacaccacacccatttgttggaaccctgatcttttcacagtcatgtgtcaaaccataaaaatattatcgctacccatcactattgactcttctaactcaattttttttatatttcatggaacaaaacctattattctatgataattattctactaaaagaccaaattatataatgttctttgctcctctgaaaattaaaggccaacacagaattgatacctgatgatattgcattgtgaagttcacaaatggaaacatgaattgaagttcacaaattgaaacacttaattgttgatg

SEQ ID NO: 97688 - DNA, 956 bp, Homo sapiens
cggcgttactatcaagcaaccaaactgcaagctttgggagttgttcgctgtccctgccctgctctgctagggagagaacgccagagggaggcggctggcccggcggcaggctctcagaaccgctaccggcgatgctactgctgtgggtgtcggtggtcgcagccttggcgctggcggtactggcccccggagcaggggagcagaggcggagagcagccaaagcgcccaatgtggtgctggtcgtgagcgactccttcgatggaaggttaacatttcatccaggaagtcaggtagtgaaacttccttttatcaactttatgaagacacgtgggacttcctttctgaatgcctacacaaactctccaatttgttgcccatcacgcgcagcaatgtggagtggcctcttcactcacttaacagaatcttggaataattttaagggtctagatccaaattatacaacatggatggatgtcatggagaggcatggctaccgaacacagaaatttgggaaactggactatacttcaggacatcactccattagtaatcgtgtggaagcgtggacaagagatgttgctttcttactcagacaagaaggcaggcccatggttaatcttatccgtaacaggactaaagtcagagtgatggaaagggattggcagaatacagacaaagcagtaaactggttaagaaaggaagcaattaattacactgaaccatttgttatttacttgggattaaatttaccacacccttacccttcaccatcttctggagaaaattttggatcttcaacatttcacacatctctttattggcttgaaaaagtgtctcatgatgccatcaaaatcccaaagtggtcacctttgtcagaaatgcaccctgtagattattactcttcttatacaaaaaactgcactggaagatttacaaaaagaaattaagaatattag

SEQ ID NO: 97689 - DNA, 1061 bp, Homo sapiens
cggcgttactatcaagcaaccaaactgcaagctttgggagttgttcgctgtccctgccctgctctgctagggagagaacgccagagggaggcggctggcccggcggcaggctctcagaaccgctaccggcgatgctactgctgtgggtgtcggtggtcgcagccttggcgctggcggtactggcccccggagcaggggagcagaggcggagagcagccaaagcgcccaatgtggtgctggtcgtgagcgactccttcattcctgatgattaaaattacatagtctggatgtgcccatgggattttttgaaaatattacttaaagttatctttgtgatttaaacttagagaatgggcagtactggaaattgactagatggcattttattacagagtgctcttgtaatcaaaggcaaatgaaggaagcaggattgtgcagaggagaagctgaattttgttgccatcttatgaatgacagttctcaaactagtatggtgcttcagagctgctttccaataggagtgaggagaacagacctttccacctgcatgttggatggccactggttgtgggctgctcctagaatggggcatggtgttgggcaaagcagctgtcttcagcagaggcaattgttcattcctaaaagggaatccgaatgtggatcacaacatcccagaaacttccaaagatgactgagatatataggtttgttattttttttagtgtagtatgaatgcatagatttttctatatttgtgcttaaattttttgcattcacggccgggcgcggtggctcacgcctgtaatcccagcactttgggaggccgaggtgggcggatcacgaggtcaagagatcaagaccatcctggctaacacagtgaaaccccgtctctactaaaaatacaaaaaaattagccgggcgtggtttcgggcgcctgtagtcccagctactcgggaggctgaagcaggagaatggcgtgaacctgggaggcggagcttgcagtgacctgatatcgcaccactgcactccagcctgggcgacggagcgagagtccgtctcga

SEQ ID NO: 97690 - DNA, 838 bp, Homo sapiens
gttctctgtagaataatccagttaataaatgcagaagcaatggtagaattagaaaattgccagaaaatcatcagcagatcctaaaaatattagattaaaaagttttggttgagaaactgctcactttaaaaaaaaattttgagaggtattttaaatggatgaattagagagacagccctgaatccactgatcagttgtaacatcactaaaagtgggccagccaaacattatttacctcttcatgtggtatagaaggaagtacacagcattacttatgatatactcttaccgaaatttgaatctattcaagcctctaaccctagctactagtttatgggaaatataagaagaaacaaaaacaaattacctgatacctgataccagtgggacattttacttgacaaattggccctgttacttgaatagatggcattttgaaataggagcttggtctgttatacattaaaagagactcaagaggtataatatcagatataatgtatggatcttatttggatattgaatgatcaaaagacattttttaaggccaggcgcagtggctcatgcctgtaatcccagcactttgggaagctaaggcagacctggaacgcaggagttcgagaccagcctgggtaacatggtgaaaccctgtctctataaaaaatacaaaaaattattcggccatggcagtgtgcacctgtagtcccagccactcaggaggctgaggcaagattgctttatcccaggagttcaaggctgcagtgagctatgatcatgccactgcgctgccccctagcaacagagggagaccccaactctttgaaaaaaaaaaaaaaac

SEQ ID NO: 97691 - DNA, 335 bp, Homo sapiens
tgcgcggaggctcggggagtcggcgccatgaccccatcgaggcttccctggttgcttagctgggtctcggccacggcgtggagagcggcaagaatccgcgctcctggtccaggctccagcagaaaaggatttgtggcagtttacagtttatcttttaaaaatgggaaaagtgcagaagtgagccaaaggcaaataagtataacgtaaattagatgaagccaggaattgtcagtacagaaaaagcattcatgctttcagtaaaaccaacatttttaaacccattgttgttggaaatttttctcaagataatacagttagcagcccagactatgcaa

SEQ ID NO: 97692 - DNA, 706 bp, Homo sapiens
tgcgcggaggctcggggagtcggcgccatgaccccatcgaggcttccctggttgcttagctgggtctcggccacggcgtggagagcggcaagatcaccccttctgtgtcattctctgaggaaaacaagttcttctcaaggaggaaagtctgaacttgtcaaacagtcccttaagaagccgaagttaccagaaggtcgttttgatgcaccagaggattcccatttagagaaagaaccactggaaaaatttccagatgatgttaatccagtgaccaaagaaaaaggtggacccaggggcccagaacctacccgatatggagattgggaacgaaaaggacgctgtattgatttttaagtcgcatattctttaacttcaatattgttttctgaatatgtacatctgaattaacttatttctgattattttctttctttatatcctttatgtcgtgtagtttgtataatgtgtttaaatatatatatatatgatggctttggaagaaaatatgctgctggtctcgaactcctgacctcagttgatccacctgcctcagcctcccaaagtgctgggattgcaggtgtgagccaccacgcccagcctagaaatgattcttagagctgtaggcctttacttcatcatttttcagtttaaattaatcagttgcttataaaatgcatacataaataaaataatttttaaaaaaaaa

SEQ ID NO: 97693 - DNA, 904 bp, Homo sapiens
tgcgcggaggctcggggagtcggcgccatgaccccatcgaggcttccctggttgcttagctgggtctcggccacggcgtggagagcggcaagatcaccccttctgtgtcattctctgaggaaaacaagttcttctcaaggaggaaagtctgaacttgtcaaacagtcccttaagaagccgaagttaccagaaggtcgttttgatgcaccagaggattcccatttagagaaagaaccactggaaaaatttccagatgatgttaatccagtgaccaaagaaaaaggtggacccaggggcccagaacctacccgatatggagattgggaacgaaaaggacgctgtattgatttttaagtcgcatattctttaacttcaatattgttttctgaatatgtacatctgaattaacttatttctgattattttctttctttatatcctttatgtcgtgtagtttgtataatgtgtttaaatatatatatatatgatggctttggaagaaaatatgctgctgtaaattaggaaagggagaccagcctgaccaatatggagaaatctcgcctttgctaaaaatacaaaattagccaggcgtggtggcatgcacctgtaatcccaactcctgagtagctgggattacagacacccaccattgcgcctggcctaatttttgtatttttagtaaagacaaggtttcaccatgttagccaggctggtctcgaactcctgacctcagttgatccacctgcctcagcctcccaaagtgctgggattgcaggtgtgagccaccacgcccagcctagaaatgattcttagagctgtaggcctttacttcatcatttttcagtttaaattaatcagttgcttataaaatgcatacataaataaaataatttttaaaaaaaaa

SEQ ID NO: 97694 - DNA, 778 bp, Homo sapiens
tgcgcggaggctcggggagtcggcgccatgaccccatcgaggcttccctggttgcttagctgggtctcggccacggcgtggagagcggcaaggaaggaaacaaaaagggtaacttgaccaacatccaacacctagatcaccccttctgtgtcattctctgaggaaaacaagttcttctcaaggaggaaagtctgaacttgtcaaacagtcccttaagaagccgaagttaccagaaggtcgttttgatgcaccagaggattcccatttagagaaagaaccactggaaaaatttccagatgatgttaatccagtgaccaaagaaaaaggtggacccaggggcccagaacctacccgatatggagattgggaacgaaaaggacgctgtattgatttttaagtcgcatattctttaacttcaatattgttttctgaatatgtacatctgaattaacttatttctgattattttctttctttatatcctttatgtcgtgtagtttgtataatgtgtttaaatatatatatatatgatggctaatttttgtatttttagtaaagacaaggtttcaccatgttagccaggctggtctcgaactcctgacctcagttgatccacctgcctcagcctcccaaagtgctgggattgcaggtgtgagccaccacgcccagcctagaaatgattcttagagctgtaggcctttacttcatcatttttcagtttaaattaatcagttgcttataaaatgcatacataaataaaataatttttaaaaaaaaa

SEQ ID NO: 97695 - DNA, 385 bp, Homo sapiens
tttgagacagagtctctctctctcacccaggctggagtggagtggcactatcccaactcactgcaacttccgccccgccaggttcaagcaattctcctgcctcagcctcctgagtagctgggattacagacacccaccattgcgcctggcctaatttttgtatttttagtaaagacaaggtttcaccatgttagccaggctggtctcgaactcctgacctcagttgatccacctgcctcagcctcccaaagtgctgggattgcaggtgtgagccaccacgcccagcctagaaatgattcttagagctgtaggcctttacttcatcatttttcagtttaaattaatcagttgcttataaaatgcatacataaataaaataattttt

SEQ ID NO: 97696 - DNA, 735 bp, Homo sapiens
tgcgcggaggctcggggagtcggcgccatgaccccatcgaggcttccctggttgcttagctgggtctcggccacggcgtggagagcggcaagatcaccccttctgtgtcattctctgaggaaaacaagttcttctcaaggaggaaagtctgaacttgtcaaacagtcccttaagaagccgaagttaccagaaggtcgttttgatgcaccagaggattcccatttagagaaagaaccactggaaaaatttccagatgatgttaatccagtgaccaaagaaaaaggtggacccaggggcccagaacctacccgatatggagattgggaacgaaaaggacgctgtattgatttttaagtcgcatattctttaacttcaatattgttttctgaatatgtacatctgaattaacttatttctgattattttctttctttatatcctttatgtcgtgtagtttgtataatgtgtttaaatatatatatatatgatggctaatttttgtatttttagtaaagacaaggtttcaccatgttagccaggctggtctcgaactcctgacctcagttgatccacctgcctcagcctcccaaagtgctgggattgcaggtgtgagccaccacgcccagcctagaaatgattcttagagctgtaggcctttacttcatcatttttcagtttaaattaatcagttgcttataaaatgcatacataaataaaataatttttaaaaaaaaa

SEQ ID NO: 97697 - DNA, 411 bp, Homo sapiens
cgaggactatgtgtatgttcgcagtgattcgcgcatgagtcgatataagttctgtgacacgttggtagtgggacgatacggtagacaattttcttccccatctccagcagcaccagccccgagtgggctcatgacatggtgagtcacgccaacgtcggcaatggattatgatcgcgcaataacttgttaaagaacaaactcacatgagcttaatttatgaatacaaggaatgagtgcccttcacaggagaggcccatcaatggctgattagatgcaagacccaacctctccgcccactgcgagaccccgtctccttaggtgtgggtgtgtctgcaggtgtgggtgtgtctgcaggtgtgggtgtctctgtaggtgtgggtgtgtctctgcaggtgtgggtgtgtctatagg

SEQ ID NO: 97698 - DNA, 124 bp, Homo sapiens
ccggcgaccctggcgttggtgatgagtgtgtctgagagtgtgtttatgtgtgtaggactgtgggtgtgtgtcatcatttccagaccttgccttgggggaatctagggacaaggacttggaattt

SEQ ID NO: 97699 - DNA, 268 bp, Homo sapiens
ggatgattgaattattaagaatcaattgtaagaacatataatacttccaggatgcacactttgttttctcaccagtataatctgggttaaagatgaaagtgtggcagtgcacagactctatctgaggaggagaacatagggaaactgaaagacaatggcagagaaaaagacaaggacagtaggaaaatctgaagcctctgacataaattttttgaagacaaggtcttggcaaatccattgacctcagattcttttatcatggggcatt

SEQ ID NO: 97700 - DNA, 425 bp, Homo sapiens
gttagccaggatggtcttgatctcctgacctcgtgatccacccaccttggcctcccaaagtgctgggattacaggcatgagcctccgcgcctggcccctctcattctttctcttcccaaagcacaggtttctatgagccacggcctcgaccagcaaatcccacttctgacactagttgtgtgaaaacacatacacacacaaactcaaaatactttctctattctttcactcaacaacaatcaacacagaatatttttgtgaccaaatgtttggggattcctccccaccaacaagcaaacaatcaattctgcagcaaataccagctggctatactccaattcaattctgacaccatctacctggagatagcatcatatcccacagattgagggctgggtccccaagattattgcccttcttcccag

SEQ ID NO: 97701 - DNA, 198 bp, Homo sapiens
accaaaatctgacctttggattgagcgatgtggagattgccgatgcacttgataagagtagtttcattcagtaagcctgtgggagcgggctcaagaaagcctgcctgggagacagaaagattagaaaatagctcttttgaggagcttgaaacagaaagaaccaaagtgttagctggatggcacaatgcggtctagagt

SEQ ID NO: 97702 - DNA, 463 bp, Homo sapiens
cgttaatctgagtttaaacaaaagccacttgtaccattttattttccccttccctttgtcttctctcaatttgtctttcttttatttagtatttgacaggcagttgagaaattggatcccttccaaatcagtaagtctttaggtgaaagtcggatgaaacttatcttaaaaatggaaagaataggccaagcatggtggctcacacctgtaatccaagcactttgggaggccaaggcgggaagatcgcttgaacccaggagttagagaccagcctaggcaacaggttgaaaccctgtctctagtaaagtctgaaaaattagctgagtgtcgtggtatgtgcctgtagtctcagggcaggaaagtagtttcaacccaggagtttatggctgcagcaagccatgatccagccactgcactccagcctgggcgatgaagcgagaccctgactcaaaaaaaaaaaaaa

SEQ ID NO: 97703 - DNA, 311 bp, Homo sapiens
atggcaaactcaagttttgctttttgggagtttgtagaatttttttttcctaaaccttttcattccactgttggttgaatctgcagatatggaactcatggatgcatagggctaactatacttaaattcttttaaatcttggttcttagcactgaaaatgggcatgataaaaacagagttaaaaaggaagagttctcaagctagtccttgggctcatattccagttctactacttaagagatatgtaaccttgggcaagttgcttaacctttctctgcctcagtgtttttactggcaaaataaagataata

SEQ ID NO: 97704 - DNA, 300 bp, Homo sapiens
cgggaggaaagggggcacttacgggcactgccccaggtgtgagcggggcccagggtggtggagaccagggcacttaggcggcaggtagggaagcctgaggcagctgggctttatgtcaaagagagagggtgtggctctgccgggcctcccgttgggcctcaccacagcttgcatgctgactcccctccctggctcctgtccatcctactccctctgaacctgcatcttcccactccagagtggctccccaagaagccgagcatccccagcaggggggattagacaatcaggtgggccttg

SEQ ID NO: 97705 - DNA, 379 bp, Homo sapiens
gcttaaaacctgaggaagcaaatttattgattcattcatttaacaatatttatttaatgtcttattatgtaccaagcattacacaaggtgctcaagctacaatggcaaaccaaggagacaaaatgtttttttaaaataaactggtttaccacaaattaataattttcctctataggttaatttttcagttgtggtacaccttgaattttacaattttttttctttctcttacacaggcaaagcaaattgaagaattggagcactgaatataacatctacagacatttgaattagaaaatgtattaattatttattgctgcataacaaattactccaaaattcaatggtttaaaaaaataaacatttattttctctgaca

SEQ ID NO: 97706 - DNA, 225 bp, Homo sapiens
cagggcaggagagaagtggaggatgctttttgatagcatttcaaagatggtggcaggtgctacctcagggcatagggaatggatgagacaattgaccagtttacaaactgagtcagagcaggggactgggggagaaggatgcctctcttctagctgggaggaaatcaagaaaaacattaagaagctggagcctcctgggaatgcacaggccaaagctcagacaca

SEQ ID NO: 97707 - DNA, 400 bp, Homo sapiens
caaaccgcattattacaacactttgaagttagaccacatgctgatgttctgtgagcacagatgttgtggctgttcttgtgcaatgtgtgtgtgtgtgtatatatatatatacatgtttttgagatggagtctcactctgtcacccatgctggagtgcagtggctcaatctcggctcacggcaacctctgcctcccagttcaagcgattcccttgtctcagcctcccgagtagctaggactacaggcgcgcaccaccacgccggactaatttttgcatttttagtagagacagggtttcatcctgtgcaatatttttatgctcagcatatcacagtgccatcccttgacacactggttaatcggtggttctcaactgcggctgtttaaaatcacttggggg

SEQ ID NO: 97708 - DNA, 148 bp, Homo sapiens
aaggaaaaaaaattccagtgacagatgttcaggtcagttggacaaaacagtctgaggaatgagaccatagatttttcaacttttcaaacaggtctagaaatctgagccataatgtagtaggaaactgtggctactattaactcttctc

SEQ ID NO: 97709 - DNA, 382 bp, Homo sapiens
atattttaatagttaatgaatttgttaccaaattcatcataaatattttcaaccagacatgagacgagtaccatgggtcccatatacccatcctccagacttagtagttaccaagagttttccacagttgttttacctcctctcccttttttctttgctgaatattttgaaggacatgccagacttcatgtcctttcttccctacacctcccagtgtgctgctttaaaaataggaacttttttttttttttacttaactgtaataccatcagcacacctaatgaaactaatgtcctctttttttttttttttttttctgagacggagtctcactctgttgccaagctggagtgcagtggcacgatgttggctcactgcaacc

SEQ ID NO: 97710 - DNA, 216 bp, Homo sapiens
gttgtgcccagtgtcttcttggtgcaaggtggcttcatagtggaggaggccttctgcccacccagcacagggggcaacagggatggtccaacccccaggctctgtggctgggtgacatcagggcctggctataaaagggtagcgaccatggacagtgctgactgcaagtcccagcagagttagggtaataaactaggccagctgcagcagccccta

SEQ ID NO: 97711 - DNA, 426 bp, Homo sapiens
ggtgtgttttcaaatgaaccacgtggttctttcctggaccccacttgggactgtaagggcctttgaggagatcgtaaaggagggttaggtgaatgacagtaatggtgtcaggacattcactagagaatcttcagcagctcgtggctcccagaggcagagtgaaaggacaccacagagatctctgcagataattctatggaaaccaaggtccctggagaggacaggctcatcccacatcacacaccccataagcaccaggagtagatgatcaaggtctcaagactcccaacagggtgttctttgctttccttctttcatgaccaacagagttataaatcgtgcagattttgacactgcaagtgaattattaaatctacctttagagccttttctatacagacatgaagaaaattcattgaaatctgc

SEQ ID NO: 97712 - DNA, 343 bp, Homo sapiens
gagttgatacgcaatcttctctcagtctccatggtaatcgctctgaactcaccgcccagctgtagggcagagcttgcatgtgatcatgataaactgcaatatgcattcaactgaaatagaaaagcagctcaaggatgcacagcgaagctgtggtttttttagtttttttttttttttttttttttttttgagacagttttgctcttgtcgcccaggccggagtgcaatggcgtgatcttggctcactgcaacctctgcctcctgggttcaagcgattctcctgcctcagcctcccaagtagttgggattacaggcgcctgccaccacgcccagctaatttttg

SEQ ID NO: 97713 - DNA, 177 bp, Homo sapiens
gagaggctttaggagacaagagttgacttggatgcaagagttgatggatctagccgactgaccacctccccctactacactgagtgctttggagaggcaagtaggaccaggtagtactcgccagggtctcctccttcctaagagtccagcagaggccccatgcagggactatgtttt

SEQ ID NO: 97714 - DNA, 406 bp, Homo sapiens
aggcatgtaaaatttatttagaatgggagacaaaattataggggggattttcattttgtttctttttttgttattttatctgtgctaatgtattatcaggataatctatgtccatttaaataaaataaaaataattcatacaagctaacaaaaaggtaaacatctttaaaagtttgaatgaaacatatctcgtggaaaacattgtaattccaagttagtcaagcacctgtgttatatgatggctataacgtgggggaggagtaatgagcagaataaaacaaaagactggaactaatagtagttagtgttatcaacaattttctccattttctctaagtagcatccatgtagcaaaatttacttctagaagattcaaagtctttctctacaactctttaattaggtt

SEQ ID NO: 97715 - DNA, 692 bp, Homo sapiens
ggaggcagaggctgcagtaagctgagatcgtgccactgtactccagcctgcgtggcagagcaagactctgtatcaaaaaataaagaaagaaaataaaatatattttctaatattcaagtgagatttcttctacatatttgttgtctctattatgatgcagtatgtactacgaatattttcacgtaattatcaagtatcagcttaagaaaattcatgtgatctggtttgtttgcttaacagagatttaacaacaaatctaagagactagctttactatcattaataagaaataaggtaactgacttccctttcaaagagatttattccatatttaatcacatacttcaaatctgggttcattatatactaatgtcagtgctttgggaaagcaaagatctcccataaaaaagaaaaataggagctttccactttaggatagtaatgtgagcacatatatttaacgctctttccctaagtgccaaggaattgatcagagaaatgcaaatagtgggaaaagtgaaaaagaaatcattagcagtgttggataacaggaaagaaggccatgaagaggccccagcggagaaaattgcccctacaaaatctgcgcggatgggatcaaattggggaccataataactagtctctgattaggcagttatgatggaggaagtttgcctgtggaataagagagc

SEQ ID NO: 97716 - DNA, 1096 bp, Homo sapiens
acaattgagaaaggtaattgaattttagctcactctctttcccttccccaactaatgcgtatcatatccttggaaataggaattgtacacttcttttatatcctcacaatgcttagcataaagtcctccacagagcaaatgctcaataaatatttgatgagttgatgtttcatctgtttcagaagttatctaagataagctgtaacatttgcttttcttttgcagtttgcccagctggtcgctatctataagacactgggaggagaaaagttccctctcattgaacagacatactaccccaaccacaaagagatggtaagtggctcagtggggacattagtctttctgctgttttcattttgcacttagccacctggttattgtggggctctgaaaagggcctcagcatctcaaccccaaagactccactggggttgaactatagagcttatgcggctggaataactagattttagctgacagcctcttgtcaaattctggagatagaatagggaaaaacaggagtaagggcagtttaatcaagctgagagaataacaaacttctggaccaacaatcagatctcactgcttttgagtcccagccctggctctgccacttgtcattgaacaagctgcatttcctcactgtgtgcagtttccaataagacggtcaagtgggcatatttatccctgcacaggatattctaatatggtacagacacaatttaagtgagattcattaagtaatagcttctgggaaagtgtgaagcatctactagatgtaaggcattgctcctactattattaatcccctgactctcccattcccctggcgcttccacaactgtgataaggctgggttaacactgtgccttctctgaggccatcctagtaagtcagaaggagcagagagatgggacggttggttggtaaggaggctattgccaatgtttttcccgtgcagggacctggagctcaaactcccttcttcttccctgtccccacaccctctgccccaggctggtgtgatcaattggtgatcgtgcttaacccaccaatggagactccctgcgaagcattccaagtggaacagaga

SEQ ID NO: 97717 - DNA, 3791 bp, Homo sapiens
  misc_feature (238)..(238): n is a, c, g, or t
ctccctccgcgccaccagaccccgtagccccgcgcgcccccagccctttaagccagatgatgaacttcctgcggcgccggctgtcggacagcagcttcatcgccaacctgcccaacggctacatgaccgacctgcagcggcccgagccccagcagccgccgccgccgccgccccccggtccgggcgccgcctcggcctcggcggcgcccccgaccgcctcgccgggcccggagcggangccgccgcccgcctcggcgcccgccgccgcagcccgcgccgacgccgtcggtgggcagcagcttcttcagctcgctgtcccaagccgtgaagcagacggccgcctcggctggcctggtggacgcgcccgctcccgcgcccgcagccgccaggaaggccaaggtgctgctggtggtcgacgagccgcacgccgactgggccaagtgctttcggggcaaaaaagtccttggagattatgatatcaaggtggaacaggcagaattttcagagctcaacctggtggcccatgcagatggcacctatgctgtggatatgcaggttctccggaatggcacaaaggttgtccggtccttccggccagacttcgtgctcatccggcagcatgcatttggcatggcggagaatgaggacttccgccacctgatcattggtatgcagtatgcaggcctccccagcatcaactcactggaatccatatacaacttctgtgacaagccatgggtgtttgcccagctggtcgctatctataagacactgggaggagaaaagttccctctcattgaacagacatactaccccaaccacaaagagatgctgacactgcccacgttccctgtggtggtgaagattggccacgctcactcaggcatgggcaaggtcaaagtggaaaaccactacgacttccaggacattgccagcgtggtggctctcacccagacctatgccactgcagagcctttcattgactccaagtatgacatccgggtccagaagattggcaacaactacaaggcttacatgaggacatcgatctcagggaactggaagacgaacactggctctgcgatgctggagcagattgccatgtcagacaggtacaaactgtgggtggacacctgctctgagatgtttggcggcctggacatctgtgctgtcaaagctgtacatggcaaagatgggaaagactacatttttgaggtcatggactgtagcatgccactgattggggaacatcaggtggaggacaggcaactcatcaccgaactagtcatcagcaagatgaaccagctgctgtccaggactcctgccctgtctcctcagagacccctaacaacccagcagccacagagcggaacacttaaggatccggactcaagcaagaccccacctcagcggccaccccctcaaggttgtttacagtatattctcgactgtaatggcattgcagtagggccaaaacaagtccaagcttcttaaaatgattggtggttaatttttcaaagcagaaattttaagccaaaaacaaacgaaaggaaagcggggaggggaaaacagaccctcccactggtgccgttgctgcgttctttcaatgctgactggactgtgtttttcctatgcagtgtcagctcctctgtctggttgtttacctgttcctgttcgtgcttgtaatgctcacttatgttttctctgtataacttgtgattccagggctgtttgtcaacagtatacaaaagaattgtgcctctcccaagtccagtgtgactttatcttctgggtggtttgatagtgtttttaaaagtaatatataatgtggggtgaaatgggagtaggggggtggacaggggagaaacgaaaaccacaaaaagaaaacccaactcctctcctccccccaagctcagttaaatcccccacctccaactttccctccaccagtgtgcttgggatcttcaatgaactgtgcttttcgctttctttctgcatgactattgtaactagatagaacattaagagattttcaagatcaaacttccatagcttcatccactgaatttgaaggcatccacctttttctccatttgctaaaatttggtgcagtttgagtttatgtgaataggctggctgtgcctgtagagctcttgtgtttttagtgatgacatgaaatacaaagaacaagctatttccaggaatgtgttctgtattttacatcccagtgtaccctttattttattattaactaattaactatgagatttttaaaaaatggggccgctgatgtgcaatatcaaagtgaacttgtgagtattttgtgtgtgttgatctcagttgtttcttcattgttgctgtttctggatccagccatgtgtgcgcttgtgtggacctgaggctgctttctgttcccaaagcttgacctgtgtacagagataattccttggcaatgttggacatagaatgcagggagctactgaaggtctgtcagggatttgtccattctgctcttggcctctcctgaggcctcataatgggagaccaaatcaaaaatgtcccatgtcacttgagtgggtacactgcctacagaaccttgaggttgactcctgcttcagttctcagctgtttaccacagccctccagggtccaaagattgaggagctttctctttcctgggaggaactgtctcagatttagcttgtgtgtgttttggacagaggctccacagcggtggctcttgaggaatcctcaccagtttgttctcttccctctgacaagcagcacctgagcagatgctgaggcagttcattaaaccaggcctcagcttcagtgcctcatcttgccatctcccggccaggctgggaacgggcaccaagcagccgcctctaacaaacaccatggtccgtggaagttcatgccagcagcttgcctttgagaagaaatgctgctggctctatttttacattcccttccacctctatactgtcatgtcaccgttctgaactcccagatctgagaaggaactagtgttggtggtatgtaacaagagttacgtatccaggggcttgtgccttggtttctcctttgattgctggtaaattctgaggccacagagaaatgcattgagtgtgaatgttgtcatctgtaatccctccctcagctgataatggtagttgatctgttgtaaatatatacatatatgcatatttgcacttccagatgggttgcataagaatcaggtccttaaatacctcccaatctgatgaaacgatagaataaagtaacatttcccagaatggaggaatacattattttatcgtatatttttgtccaagcgatgagctgacggtggtattgcttctctgcatgttatcagtgtgtacatctggtgcttttcatgtgtcatttgtgagccacaaatgcaaagttgccatttgaattcagtcaggctacagggtggtgtcagtcaaggtctttcaggtgggggagaaattggttagggctcccactgccaaatgcaagcagatagcataacctgactgttatgtgccctcaggcagcatgcttagggacaactctgtggcctgggggacatctgtgtcacagtataggattgccattcaggtgttttgtacctatttctttcctgacgttgtcccctttttttgtactgatccaactgggagaacctcagccaatgctggaagtatgattgaagtacctctcttttgtgactcttgtacagcttaatgtgcaataaaggaaaagttatatctgtaaaaaaaaaa

SEQ ID NO: 97718 - DNA, 2591 bp, Homo sapiens
  misc_feature (238)..(238): n is a, c, g, or t
ctccctccgcgccaccagaccccgtagccccgcgcgcccccagccctttaagccagatgatgaacttcctgcggcgccggctgtcggacagcagcttcatcgccaacctgcccaacggctacatgaccgacctgcagcggcccgagccccagcagccgccgccgccgccgccccccggtccgggcgccgcctcggcctcggcggcgcccccgaccgcctcgccgggcccggagcggangccgccgcccgcctcggcgcccgccgccgcagcccgcgccgacgccgtcggtgggcagcagcttcttcagctcgctgtcccaagccgtgaagcagacggccgcctcggctggcctggtggacgcgcccgctcccgcgcccgcagccgccaggaaggccaaggtgctgctggtggtcgacgagccgcacgccgactgggccaagtgctttcggggcaaaaaagtccttggagattatgatatcaaggtggaacaggcagaattttcagagctcaacctggtggcccatgcagatggcacctatgctgtggatatgcaggttctccggaatggcacaaaggttgtccggtccttccggccagacttcgtgctcatccggcagcatgcatttggcatggcggagaatgaggacttccgccacctgatcattggtatgcagtatgcaggcctccccagcatcaactcactggaatccatatacaacttctgtgacaagccatgggtgtttgcccagctggtcgctatctataagacactgggaggagaaaagttccctctcattgaacagacatactaccccaaccacaaagagatgctgacactgcccacgttccctgtggtggtgaagattggccacgctcactcaggcatgggcaaggtcaaagtggaaaaccactacgacttccaggacattgccagcgtggtggctctcacccagacctatgccactgcagagcctttcattgactccaagtatgacatccgggtccagaagattggcaacaactacaaggcttacatgaggacatcgatctcagggaactggaagacgaacactggctctgcgatgctggagcagattgccatgtcagacaggtacaaactgtgggtggacacctgctctgagatgtttggcggcctggacatctgtgctgtcaaagctgtacatggcaaagatgggaaagactacatttttgaggtcatggactgtagcatgccactgattggggaacatcaggtggaggacaggcaactcatcaccgaactagtcatcagcaagatgaaccagctgctgtccaggactcctgccctgtctcctcagagacccctaacaacccagcagccacagagcggaacacttaaggatccggactcaagcaagaccccacctcagcggccaccccctcaagggggccctgggcaaccccaaggaatgcagcccccaggcaaggtgctgcctccacgccggctcccccctggaccatcactgccaccttcctcctcttcctcctcttcttcctcctcctcggctcctcagcggccgggcggccccaccacccacggagatgcaccctccagcagcagctccctggcagaggcccagccacccctggctgctccaccacagaagccccagcctcacccacagctcaacaagtcgcagtccctgacaaatgccttcagcttctctgagtcctccttcttccggtcttcagccaatgaggatgaagccaaagcggagaccatccggagcttgaggaagtcctttgccagcctcttttcagattagctcttcagacacacggggcacccagcccaaccgggaaaggcatctaagacattcaccaacaacagtcagccagcttggtggtgatgtcccatgaccttgacgtgtgtggtcccttcctctgctctgttgtactaagtgatgttgtgcagcccagaaaggaccatttgacagtctcagggcaggtgcctacccagcaaggggtacctggcatcagagaggaaagagctgcttccctgtagtcatgagagcttccttctgaagtcatcgttcgctgtgagtttagtggccttattgtgacagtgccatcatgtcttattcttccctgtgaaaccaggattaatcgtggactcctggcagcttaacctagctcagttgcagtgctaagcatgccccgcccccattcagtgatacctgtttgggaagtatatacttccccaaaagtactcttggccctaagttttaggaactttccccgacctggatcccttgtcatacctgtgttactgtttaaagcacacccacccaacttacaagatcttaggctgctgtggtggtgaagcaccttgagtctgctgatattcgggagaacaaggatctgcagtttccccttttctcccctctgaagagtggttcttatgtgcaatctgcagtaaccttgaactccagagctgcactatagaggagaatgcatgccactatgacagcagtatgccaagctttgtgttcatctcctaataaacgttaagacctttggtgtaataaaagcagcagcattcaccaacatt

SEQ ID NO: 97719 - DNA, 421 bp, Homo sapiens
gaggacatcgatctcagggaactggaagacgaacactggctctgcgatgctggagcagattgccatgtcagacaggtgagttgagagaaggagtccagtttccagcccagtgagagggaggcttccttagatgaagaagtttaggaattaagctctgtccaaagggagtcatggagcaaaccggacagataaaacacaaaaggcccaagtagcccatttagcaagatcaggcaggactgatgatagagaaagatgatagagttaaagactgcacataccataggtaaaagcttcctgaggcctcaccagaagcagatgctggcaccatgctttttgtacagtctgcagaaccatgagccaaaataaaccttttttttttttataattacctagcctcaagtattcctttatagcaacacaa

SEQ ID NO: 97720 - DNA, 1126 bp, Homo sapiens
tctgagtctctgctggctaagccgccgcctcagccgcctcagtcgcctcaatctcaccttcctcttcttcctcctcctcggctcctcagcggccgggcggccccaccacccacggagatgcaccctccagcagcagctccctggcagaggcccagccacccctggctgctccaccacagaagccccagcctcacccacagctcaacaagtcgcagtccctgacaaatgccttcagcttctctgagtcctccttcttccggtcttcagccaatgaggatgaagccaaagcggagaccatccggagcttgaggaagtcctttgccagcctcttttcagattagctcttcagacacacggggcacccagcccaaccgggaaaggcatctaagacattcaccaacaacagtcagccagcttggtggtgatgtcccatgaccttgacgtgtgtggtcccttcctctgctctgttgtactaagtgatgttgtgcagcccagaaaggaccatttgacagtctcagggcaggtgcctacccagcaaggggtacctggcatcagagaggaaagagctgcttccctgtagtcatgagagcttccttctgaagtcatcgttcgctgtgagtttagtggccttattgtgacagtgccatcatgtcttattcttccctgtgaaaccaggattaatcgtggactcctggcagcttaacctagctcagttgcagtgctaagcatgccccgcccccattcagtgatacctgtttgggaagtatatacttccccaaaagtactcttggccctaagttttaggaactttccccgacctggatcccttgtcatacctgtgttactgtttaaagcacacccacccaacttacaagatcttaggctgctgtggtggtgaagcaccttgagtctgctgatattcgggagaacaaggatctgcagtttccccttttctcccctctgaagagtggttcttatgtgcaatctgcagtaaccttgaactccagagctgcactatagaggagaatgcatgccactatgacagcagtatgccaagctttgtgttcatctcctaataaacgttaagacctttggtgtaataaaagcagcagcattcaccaacatt

SEQ ID NO: 97721 - DNA, 416 bp, Homo sapiens
atatgaatgtggcccatacagtaagggaaacatgtccaaagtcagttgtgatacgatggaaacaaggcggcaatgttgctatgctttggtataaaatacaaactacacaattgtctacaaacgtccttaggaaaggttaaaacattgcaccaaaaagaacacttttcacgataaaaatactagttttgtggtcactactcctgctaggtaaactgaagttcataaaaagtatcagactgaaaatatctaaaaagaagccctggttgcttataggtcaagtacaacattagtgtaacttttcctgtctgctgccaccaaactctattggcattatcagaaccctaccggctaaaggtaaaaggctggccgggcgcggtggctcatgcctgtaatcccagcactttgggagtccaagg

SEQ ID NO: 97722 - DNA, 265 bp, Homo sapiens
agtctctcactatcgcccgggctggagtgcaatggcacgatctccgctcactgcaacctccgcttcccaagttcaagtgattctcctgcctcagcctcccgagtgtctgggactacaggcacttagcacttgctagaggcgagcctgaataagtccctatcctcaaggtgttgacaacaagagatcatctcaccaataacatccatgaaggtataagagatgtacacgtttgtgatgactcaagaataaattccgatgctggccg

SEQ ID NO: 97723 - DNA, 244 bp, Homo sapiens
gccttgagatgagtcatcatacctaaccatgacctttaacaaaactttacagaagattggaaggttaaggacaaattaacagatttatttacaacagctaatagaaagaattgaccttggagcccaatggcccaacccaatcctttaatcccaaccaagctctcagcaggctggttcaacctccaccaaagggatgccccctaaatggccatgtatttgtttaggtccaactctgacagcaccc

SEQ ID NO: 97724 - DNA, 479 bp, Homo sapiens
aaggcataaacaagagaaagcagcactgtctgaaaagcaacttgcttaaaatttccactgccaagagaccagatggtttctgggatgtctagttaggctaaaaatacccgtcacccacaatgagtttgatttacaaacaaaggaaagcagggttagccagtataaacatgcagctggaaagctagaagatttaatgcttacaaaacactgcttaaagggtgtcaaatggccatacaagatataaaacgttagacagcttatgcgctcaattgcttgctcattactctctctgtctcttacatacctacgccatacttgtttcttaagggtaccttcaggtctgacagagctgagtcccaccaagaaattaaggttggagaggaccctcctgccagtctctggcctgaaagacccttcccaccctctccatcctgtcacacacacacacacctctctctctctctcactcactcacacac

SEQ ID NO: 97725 - DNA, 863 bp, Homo sapiens
ccgattctcaggctccctctccggaatcgaaccctgattccccgtcacccacaatgagtttgatttacaaacaaaggaaagcagggttagccagtataaacatgcagctggaaagctagaagatttaatgcttacaaaacactgcttaaagggtgtcaaatggccatacaagatataaaacgttagacagcttatgcgctcaattgcttgctcattactctctctgtctcttacatacctacgccatacttgtttcttaagggtaccttcaggtctgacagagctgagtcccaccaagaaattaaggttggagaggaccctcctgccagtctctggcctgaaagacccttcccaccctctccatcctgtcacacacacacacacctctctctctctctcactcactcacacacacacaccctggagtgaaacccagaagcttctttagaccttggtgcagctgctatccacccagaagttggtaatattttgttacactctgggttatctgccttgtctatactagtattctttttatttttttaggtgtacgatgtaatggtttttagtatattcagttatttaaccatcaccacaattaattttagaacatttctgtcacctcaaaaaggaaccctataccctttagctatcacctcaaaccccacttcctccagccctaaggaactactcatgtattttatgtctctacgtatttgcctattctggagtgcagtggcgggatctcggttcactgcaggctccggcttccggggtcacgccattctcctgcctaaccctcccagtaggtgggactacaggcgcccgccaatacgcccggctaattttttgattttaagaac

SEQ ID NO: 97726 - DNA, 563 bp, Homo sapiens
aagtttgtaaaaaacttgagggggtgcaggtggaagacactgtctgtggtgatatatgatcatagcagctatgtttagactctcctgttatagaaaaggactccatgttcatgctagtctcaccactgattttttccatgttttctctgctgagtccattactgcttcttccaaagactttaactcaagaaaaataatctctgttctaagaccacagacttgctgcttgggtgttccaagctggcaactggtatttttaacagtcattttttatagaatcgagagataaaaatctggggacatctatagacagattgaagatctaaaagtcttaaatcccaaattacaaaccataatcctccatttcctcaccctataaagtcaactcccagcattttgatgaacaagttttaccatcctgggtaaagcattttccagactccaccagacatttcagactctcagtagtctcaaacatttacactcttcatatccaatcacatgtcatccatttcatacattcattcaacacacagtaatttgcttagcagatgttatggttg

SEQ ID NO: 97727 - DNA, 758 bp, Homo sapiens
tcgaccccaagggtctcctgctgtcagcctccaagcaggatatgatccggaagcgcatcaaagtctgtgagctgctgttgcatgagtgtgagctgcaaactcagaagctgggcaggaagatcgagatggcgctgatggtgtttgacatggaggggctgagcctgaaacacctgtggaagccagctgtggaggtctaccagcagttttttagcatcctggaagcaaattatcctgagaccctgaagaatttaattgttattcgagccccaaaactgttccccgtggccttcaacttggtcaagtcgttcatgagtgaggagacacgcaggaagattgtgattctgggagacaactggaagcaggagctgacaaaattcatcagccccgaccagctgcctgtggagtttggggggaccatgactgaccccgatggcaaccccaagtgcctgaccaagatcaactatgggggtgaggtgcccaagagctactacctgtgcgagcaggtgaggctgcagtatgagcacacgaggtccgtgggccgcggctcctccctgcaggtggagaacgagatcctgttcccgggctgtgtgctcaggtggcagtttgcttcagatggtggggacatcggctttggggttttcctgaagaccaagatgggggagcagcagagtgctagggagatgacggaggtgctgcccagccagcgctacaatgcccacatggtgcctgaggatgggagcctcacctgcctccaggct

SEQ ID NO: 97728 - DNA, 368 bp, Homo sapiens
aggagaggggtcaggaggagaatcatgagtgtggctttatagaaaccaaggatgtagagtttaaggggaaagtcagctggtcaagtcgagcacagaggtcctgtataagagactgaaaaatgtgtccattggatttggggacaaggaggccacccctgaaacttgataagagcatgttcaggagtgtggggagagccaaactgaggtctgttcagggagagagtgggaggcgacgggttgaagattactatttagagaagtgtggataagaaggggaaatgagtgactggaattcattcaggcaggagcaattacactccgtgaaccagcagtgggcaaggaacagcattacctggagcgggtgtgga

SEQ ID NO: 97729 - DNA, 785 bp, Homo sapiens
aacatccttgaaaagacagccttgaacaaagggcagtcaatagttctactcaaaagacatggagaaatgcaaaagacccatggagatttgtcttctaatcggcagcatcttgcaaggagaacaagaagatttatactagccatgcaaggaatctttggaagtctaacagacctgacttgaagagaaggctttaaacaagaaattcttcattctggaacagtgattcttaaagtgcggttcagagaccctgggagacactgacattctttcagagtgtgagtgaggatttcctctttgcaactacaatctgtgtaaggttggattttctttacatacataaactaaaataagattgcaataagatgaatgcagaagcagataagagaatccagctgtcttaagttagacttcacagagatttgcaaaaatccaaacaagaccactctcgtcattaaagttattttccatttgttatggtgaacttattttgcaggaaatttgttatttatagtaacatacaattttgttttttgatcattttaaataaattaataaatattataagttttctatttttaaaattatacatgtcagaaaagaacagttctttcaggtcctcaacaattttaagactattaacttgttttggatcaaaaagttctagatttgctattctagacatgaatcctttgaaattaattggcttcataagtatatttttcaagtttgtggcttgtcctgtaaccttctactgtgtagaagttttaaattttaatttaaagaaa

SEQ ID NO: 97730 - DNA, 633 bp, Homo sapiens
actgtgggttaggcattttctgtgcattacctcgttcatccttactacaaccttattaaatagatgtcatcacttctgtatttgcattttacaggcgaggacacaggcttaactcctcaaggccacggagctgacctttgttagtagcttgagcaagtggggtctgaagcacacgtgcctgcacctggcctcagaagtgggactgacacgaggtttcggttaccatggacctctgtgacctccatgaccaatctaggttctggaaggggtggttgggaagccagaatagtcacagcaagtggaacagggctaggtggagaccagcgagcctacgacaagaggctttaggtcatagagggaggttttagtagatgagttttatcagtgggcttcgcccacctcttcctaacatctgaccagctgggctattagttttagaaggctgagctgaggcctgggtgggccaagacatacttccacagattgtcttcatcccactagccaaggtggttgaggacatcaatgaccttcaaagggaattaacaagtcaaaggaaatggtgtcctaggtgtcacaaatggatggcttaatcctgataccagggacaggacatatttgctacatacaaaggat

SEQ ID NO: 97731 - DNA, 431 bp, Homo sapiens
ttttactttttaggaccaacagacttgataacagcctgatgctgatctgacaatgggttgacagccttcccccactggcccttaagtctgcttaataataagtcctttgcttctgtcattctcctgggggatggcctactgccctcctttctgtacaatctgggcaaaccgactggtgatggcaagagtggtgtcaatgaagtggtctacacagctggagagacaattttcagtgcaagagtccaggcgattccctggcttctccacacatttatcccaacataactccatgaagtgatgcacctgtgcagtaaactgcgccttctgctgttcggcggccaccaggtgctgcaactccgctccatcggcttcacccagctccgcctttgttcacctcagacttatccaataattcttcaagtgttttgcat

SEQ ID NO: 97732 - DNA, 599 bp, Homo sapiens
atggaaaggctggggaggtgggtccgtgctcacgtggtcgcgggcgctgcgctgcctggaggctcagttctgggctttcagggttgaaaacccctccccaagcttagtttgaggccatctgaggccgctggagagttgaccctgctctcacaggtgatgtgttaggatcgaggtgtggttggttccgtaagctggtcggaggcgcagacgctgggccaaagtgtcagcagcagtaggaaatctactgggtgttgaggctttttgcagttcccttttctccctgccctctccgcctggcctgcgctttaactcttcccgggtttgctgcagggttgggagtgagggcagtttcactggtgaaaaggacgctttcagaagccagactcctaaccttctccccagcaaaatcgaatttagagcaataacctttaagttgagttttaaactgtgacatgtccattacagatcattggataaatacagaaaactataaagaaatgaaaatcacccgtagtcacccttttagactttttcctaacattaaaaatactgcttttatttctgcaaaatgtaattttaagtatagtcttgaatgactg

SEQ ID NO: 97733 - DNA, 728 bp, Homo sapiens
ctcaatgtgtgtggtggggaggccttggaagatatgactagtgtgagattccagttggcctcctgcacattaggcttggggacattgaaggactaagttgacttgaaaattttcttgaacttgcatcaggttccactgtccagaaatctttgaatgccagggcaaatggggaagaatcagaaaagaattcagttacgtgtcataaatggtggtgcttgtatttgtaactcatttgtgccaaaagtctgtctgtggctatctggtaaacagaatcagttgttatgtcagattattttggagaaggttcatttctctaggtaagggtttgaacccttgctctgggccaagagactagacactggagatagtttcttttttcttttttttttttttgagatggagtttcactctgtcgcccaggctggagtgcagtggtgcaatctcagctcactgctgcaacctctgcctcccgggttcgagccattctcctgcctcagcctccgagtagctgagattacaggtgcacaccaccacgcccagataatttttgcatttttagtactgatggggtttcgctttgttagccaggctggtctcgatctcctgacctcaagcgatccacccaccttggcctcccaaagtgctggggttacaggcgtgagctaccgcacccttcctggagatggttttacaggtcagccttaccctggattgatgaaggagtgtgg

SEQ ID NO: 97734 - DNA, 701 bp, Homo sapiens
gaaagcaacatactctgcatataaaactgtattccagaaagatgtactaaaatttccaaaaggtagcataattcattaaggggggagaggtggtggcaaaacaggagatgctctgtatcatgagattaaaaaacaaaatattttagcctgtaaaggaaaagtttgaagaaatagtgactaaaatctataaaatcacagacaccaaggcaagaagtcaccctttgaagtttgaccatagtaaggtgaaggcaaaaaggaaataacgtaaaagtacattttaataatcaaacgtaataaatccatataaatttttatgtcttagggtggtaaaggcagaaaatgtcagtggattagagagcagtttgaccaaacataggtgaagaattagtgcatagtgattgagggaaacatgctatgcctgtctttaaagttgatgccaggcattcagccaagatgtaccttcctgtggtctattcctggatgcttgggcactgatctgctttccgtgcaaggtttctggagtctcaggttttcttccttgagacacagttctgggatttttctctctttaccatagctaaccctcttgtcccagtcctgttctgtgggttggatttcatttcctaatattctccctcaagtataagcagccatttttgctttatttaaaaaaccaaaaggatttttttttaaaggtggta

SEQ ID NO: 97735 - DNA, 716 bp, Homo sapiens
atcatctatggcctttattgttttcttccatacctagtttgttaagaggtatgtttttttccatacctagttttttaagagctatgttttcttccctacctagtttgttaagagtttttattatgaagagatgttgaattttattgaatgcattttcagcatctattaaaattatacagttttgtccttatgtgcatatgttgaaccatcttgtatttatctaactggatcatgatctgttcagtgtgttgttgaattctgtgtgctagtattttgttcagcatttttgcatctatgttcgtaagtgatgatggcctgtagtttcttttcgtgtagttttgtgtctttgtctggttttggtatcagggtaatgctggcctcatagaatgagtatttgaaagtattccttcctcctcaattatttggaacagtttgagtagaattggtattagttctttaaatatttgctggaattcagcagtgaaaccatcaggtcccaggcttttctctcatgggagactttttattactgcttctatctcattacttattactggtcctttcaggttttctgtttcttcttggtaggatgtatgtgtctaggaatgtatccatttcatgtcggttttccagttctttgacatatagttgctcataatctctaatccttggaagtttttggtatcagttgtaatgtctccttttctatttctgat

SEQ ID NO: 97736 - DNA, 579 bp, Homo sapiens
atcattggctgtactgtggagctgtcacatctccatactgaaaaggtacactgcaagtgaatttaaaccgtttttggctttctattgcatattgccaagagctttgagactgatgaaccaagtaaatgctctatttagggctaagtgagatacagattcctccaatctgatagcgtttcagcctccggagtgaggaagcagcagaaacagaagcagcagaagcaacagcagtagcagcggcagcagcaacagcagcagcccctactgaagtccaatagaggagacttgatctctagttcattctggaactccgcctgggattgtgcactgtccagggtcctgaaacatgaaccaaactgccagcgtgtcccatcacatcaagtgtcaaccctcaaggcacaatccaaaggaactggcgaagtcacaggccctaccacagaagcacactgcgacaggagacattgctatatgcgtctgcttgggtgactctcacagcattgatatgcgtcactccatccactagtgtcagtcacatccatctacaagccacagcatgaaactccacaaattcagtcagca

SEQ ID NO: 97737 - DNA, 226 bp, Homo sapiens
ttagatttccttgcagcagagtgagaactctgacatgtctgggatctgggaaggagatttatggcaaatggaaaacctgagtgaaggagagacttacatagaattacagaaaaaacaagtccaggtgcagtggctcacgcctgtaatcctagcactttggtgggttgaggtgggaggatggcttggggccaggagttcgagaccagtctgagcaacatagtgagac

SEQ ID NO: 97738 - DNA, 2693 bp, Homo sapiens
tggtgccagcggtcacgctgcacctgaggcccccacctgaccagtgctcccagctctggtgtcctgagaaacccttcaagccatcccgcatgggcaggatggtgacatatccatgtggtaggattgtcccggccccaaagtatggccctggtcaggggagcccctgctggaaattgcatctccagagctttgatgcaggacccctgggggatcagggaatgagggtctccaccccaggggtctccttgcagtgagtctatatgcaggcctgcgttctgctcctggggctggttctgagtgcccagcttcagtctcctgagaacatgaggatgggagggggcagagtcttgctgagggcacacccagttcccgctggaggaggacagtgccagtcttctgcaaagggaccttgggtgggaacgggcccggagcgggaggaacgtgactccccagagggaagatgggcatcatactgggcccagagctgggaaggagttgctgccagcacagggtgggcctggactcccctcgcccctacccccagtggttgtggctgtagccctaagcctggagagcaggaccggcccggggtgtctgggaggctgccaggtgcctcccagagctcccaagggcccccacctgcaagtgccagcctcagggcagtgcccaaatgaggccctctcagctgcagccagcgatgccttgggatgctcaccgggagggaggcggctttgggctcctaagtccttgggagaggctgggagcagtcactgcgcggcttgcgcaagcccattgtcgggttgggtggcttcctcagccagggctgggagggactccaggatcaggtcctccctgtctcgagtctcagtggggtgatggggaggagacctggccacccatggctcaggggcagctgagaacaaggacctgctggagctggaagtgctgtggtgttgaggggtggggtgggcagcttctcacacctgcctcctgcctccttctgtccacctttccaccaccctgacctgtcccagccccacacatggttctgcctggctggcctgcccttggcacctggcgtagagcacacagaaggcactcagctaatgctgggcaggcccactcatggggagtgcgtggctgtgcagcaccagggaaccggcacagcagcgccggcagaaatcacagcagtaaacttgtccgggttgtatgcatcaaggtggcgatggacgtgggtccccccactgcactgtggccctgagcactgtatagcagcccggcaatgggagccattatcttgcccctttgacagaggaggacacagaggcacagggaggtgaagtagctgccccacactagtgcctcctcgctcactcaccaccccctgcaccacagtgcagccgcttctcccaccagctggggttccttggacccccaagcctgggaagggggaggtgagtttacaaaatggaaagcttaaaaggagaaaagtggaaccagaggtttgagaagccctgagtggtagagtaaggcctccagcgctgcctctgggtgcagggcagagtggcagaggagagggggagaggcactgggcaccatgggggcccagttcccacttcggggatctctctcgcagaaccgagggtccccttcatgggggtagatgcccagggctagctgttgccactgtctgtgtggacctgagtcctggacatgcccgagtgactcaggagtggctgcttgggcgggctctgtcaccctaggatgttatacattctgggaactggacaggagtggctgcttgggcgggctctggcaccctgggatgttatacattctgggaactggacaggagtggctgcttgggtgggctctggcaccctgggatgttatacattctgggaactgcaatcagccactagagaagtcggagctacaggaagtgaccctggggtgggacctggggacatggccaggtcagcatggggacacccggctccagcaggagctctggtctgtcctggggtctttgggggcagggctgcggccctgggcaggcttcctccaggcggaggtcctggggaagtgggggagccaggccagctgccgcctcccccactatgtagcatctgattcgtcatctctcatgaaggcgatttggttcataactctgaaactctgaaaaaggtcaaaagaagcagagaggccctcggtggatatgccagcttttctgccggtgctttctcccactactctgggtggtctgctctcctcttcaaacctcagctcgcagggagggcctgaatctgccagcccctcaggatctccttccctctgggccctccccagccttaaggagcctcccagacagaagggtggacagagccacctgggcagcccgagagacacacgggggtcctccctgtggacagccctgccagcttccgcccagccctgagcttcatttgcatcttgaggagtaaggggtggtgaaatgggaatgctggtctggctcagctggtcgtgggcataagtgcccgctgaatggatggcatctctccctcctgtcttatgttctggggtccaggtgcttcccagggccatgcccctgctgctaatgcttgccctaacccttaccctaaccagcgtccagcgtcgtctcaccgagccgtaaataaatcaacagattcgca

SEQ ID NO: 97739 - DNA, 2784 bp, Homo sapiens
tggtgccagcggtcacgctgcacctgaggcccccacctgaccagtgctcccagctctggtgtcctgagaaacccttcaagccatcccgcatgggcaggatggtgacatatccatgtggtaggattgtcccggccccaaagtatggccctggtcaggggagcccctgctggaaattgcatctccagagctttgatgcaggacccctgggggatcagggaatgagggtctccaccccaggggtctccttgcagtgagtctatatgcaggcctgcgttctgctcctggggctggttctgagtgcccagcttcagtctcctgagaacatgaggatgggagggggcagagtcttgctgagggcacacccagttcccgctggaggaggacagtgccagtcttctgcaaagggaccttgggtgggaacgggcccggagcgggaggaacgtgactccccagagggaagatgggcatcatactgggcccagagctgggaaggagttgctgccagcacagggtgggcctggactcccctcgcccctacccccagtggttgtggctgtagccctaagcctggagagcaggaccggcccggggtgtctgggaggctgccaggtgcctcccagagctcccaagggcccccacctgcaagtgccagcctcagggcagtgcccaaatgaggccctctcagctgcagccagcgatgccttgggatgctcaccgggagggaggcggctttgggctcctaagtccttgggagaggctgggagcagtcactgcgcggcttgcgcaagcccattgtcgggttgggtggcttcctcagccagggctgggagggactccaggatcaggtcctccctgtctcgagtctcagtggggtgatggggaggagacctggccacccatggctcaggggcagctgagaacaaggacctgctggagctggaagtgctgtggtgttgaggggtggggtgggcagcttctcacacctgcctcctgcctccttctgtccacctttccaccaccctgacctgtcccagccccacacatggttctgcctggctggcctgcccttggcacctggcgtagagcacacagaaggcactcagctaatgctgggcaggcccactcatggggagtgcgtggctgtgcagcaccagggaaccggcacagcagcgccggcagaaatcacagcagtaaacttgtccgggttgtatgcatcaaggtggcgatggacgtgggtccccccactgcactgtggccctgagcactgtatagcagcccggcaatgggagccattatcttgcccctttgacagaggaggacacagaggcacagggaggtgaagtagctgccccacactagtgcctcctcgctcactcaccaccccctgcaccacagtgcagccgcttctcccaccagctggggttccttggacccccaagcctgggaagggggaggtgagtttacaaaatggaaagcttaaaaggagaaaagtggaaccagaggtttgagaagccctgagtggtagagtaaggcctccagcgctgcctctgggtgcagggcagagtggcagaggagagggggagaggcactgggcaccatgggggcccagttcccacttcggggatctctctcgcagaaccgagggtccccttcatgggggtagatgcccagggctagctgttgccactgtctgtgtggacctgagtcctggacatgcccgagtgactcaggagtggctgcttgggcgggctctgtcaccctaggatgttatacattctgggaactggacaggagtggctgcttgggcgggctctggcaccctgggatgttatacattctgggaactggacaggagtggctgcttgggtgggctctggcaccctgggatgttatacattctgggaactgcaatcagccactagagaagtcggagctacaggaagtgaccctggggtgggacctggggacatggccaggtcagcatggggacacccggctccagcaggagctctggtctgtcctggggtctttgggggcagggctgcggccctgggcaggcttcctccaggcggaggtcctggggaagtgggggagccaggccagctgccgcctcccccactatgtagcatctgattcgtcatctctcatgaaggcgatttggttcataactctgaaactctgaaaaaggtcaaaagaagcagagaggccctcggtggatatgccagcttttctgccggtgctttctcccactactctgggtggtctgctctcctcttcaaacctcagctcgcagggagggcctgaatctgccagcccctcaggatctccttccctctgggccctccccagccttaaggagcctcccagacagaagggtggacagagccacctgggcagcccgagagacacacgggggtcctccctgtggacagccctgccagcttccgcccagccctgagcttcatttgcatcttgaggagtaaggggtggtgaaatgggaatgctggtctggctcagctggtcgtgggcataagtgcccgctgaatggatggcatctctccctcctgtcttatgttctggggtccaggtgcttcccagggccatgcccctgctgctaatgcttgccctaacccttaccctaaccagcgtccagcgtcgtctcaccgagccgtaaataaatcaacagattcgcaaaaaaaaaaactcgagggggggcccggaccccaattcgccctaagtggagcggattacaattcattggccgcggtatacccgtctgctggg

SEQ ID NO: 97740 - DNA, 1314 bp, Homo sapiens
agttgagacctatctcaccaccctgcacaagtgtacgctctccacagctgggtcttgacccagctaggaggggaggtgagtttacaaaatggaaagcttaaaaggagaaaagtggaaccagaggtttgagaagccctgagtggtagagtaaggcctccagcgctgcctctgggtgcagggcagagtggcagaggagagggggagaggcactgggcaccatgggggcccagttcccacttcggggatctctctcgcagaaccgagggtccccttcatgggggtagatgcccagggctagctgttgccactgtctgtgtggacctgagtcctggacatgcccgagtgactcaggagtggctgcttgggcgggctctgtcaccctaggatgttatacattctgggaactggacaggagtggctgcttgggcgggctctggcaccctgggatgttatacattctgggaactggacaggagtggctgcttgggtgggctctggcaccctgggatgttatacattctgggaactgcaatcagccactagagaagtcggagctacaggaagtgaccctggggtgggacctggggacatggccaggtcagcatggggacacccggctccagcaggagctctggtctgtcctggggtctttgggggcagggctgcggccctgggcaggcttcctccaggcggaggtcctggggaagtgggggagccaggccagctgccgcctcccccactatgtagcatctgattcgtcatctctcatgaaggcgatttggttcataactctgaaactctgaaaaaggtcaaaagaagcagagaggccctcggtggatatgccagcttttctgccggtgctttctcccactactctgggtggtctgctctcctcttcaaacctcagctcgcagggagggcctgaatctgccagcccctcaggatctccttccctctgggccctccccagccttaaggagcctcccagacagaagggtggacagagccacctgggcagcccgagagacacacgggggtcctccctgtggacagccctgccagcttccgcccagccctgagcttcatttgcatcttgaggagtaaggggtggtgaaatgggaatgctggtctggctcagctggtcgtgggcataagtgcccgctgaatggatggcatctctccctcctgtcttatgttctggggtccaggtgcttcccagggccatgcccctgctgctaatgcttgccctaacccttaccctaaccagcgtccagcgtcgtctcaccgagccgtaaataaatcaacagattcgca

SEQ ID NO: 97741 - DNA, 474 bp, Homo sapiens
ttcataactctgaaactctgaggtctcccactactctgggtggtctgctctcctcttcaaacctcagctcgcagggagggcctgaatctgccagcccctcaggatctccttccctctgggccctccccagccttaaggagcctcccagacagaagggtggacagagccacctgggcagcccgagagacacacgggggtcctccctgtggacagccctgccagcttccgcccagccctgagcttcatttgcatcttgaggagtaaggggtggtgaaatgggaatgctggtctggctcagctggtcgtgggcataagtgcccgctgaatggatggcatctctccctcctgtcttatgttctggggtccaggtgcttcccagggccatgcccctgctgctaatgcttgccctaacccttaccctaaccagcgtccagcgtcgtctcaccgagccgtaaataaatcaacagattcgca

SEQ ID NO: 97742 - DNA, 1731 bp, Homo sapiens
gcccctgttcagtctcgctcggcacgcaagggtgtacacagtctctgctgccaggactgtcagctgggcttggcgtgcgcctgccatctgtccatcctgcgcgtcagagccacacacgtagacggcacgtcatgctgatacagctgggcgcacgtgcccactcatggggagtgcgtggctgtgcagcaccagggaaccggcacagcagcgccggcagaaatcacagcagtaaacttgtccgggttgtatgcatcaaggtggcgatggacgtgggtccccccactgcactgtggccctgagcactgtatagcagcccggcaatgggagccattatcttgcccctttgacagaggaggacacagaggcacagggaggtgaagtagctgccccacactagtgcctcctcgctcactcaccaccccctgcaccacagtgcagccgcttctcccaccagctggggttccttggacccccaagcctgggaagggggaggtgagtttacaaaatggaaagcttaaaaggagaaaagtggaaccagaggtttgagaagccctgagtggtagagtaaggcctccagcgctgcctctgggtgcagggcagagtggcagaggagagggggagaggcactgggcaccatgggggcccagttcccacttcggggatctctctcgcagaaccgagggtccccttcatgggggtagatgcccagggctagctgttgccactgtctgtgtggacctgagtcctggacatgcccgagtgactcaggagtggctgcttgggcgggctctgtcaccctaggatgttatacattctgggaactggacaggagtggctgcttgggcgggctctggcaccctgggatgttatacattctgggaactggacaggagtggctgcttgggtgggctctggcaccctgggatgttatacattctgggaactgcaatcagccactagagaagtcggagctacaggaagtgaccctggggtgggacctggggacatggccaggtcagcatggggacacccggctccagcaggagctctggtctgtcctggggtctttgggggcagggctgcggccctgggcaggcttcctccaggcggaggtcctggggaagtgggggagccaggccagctgccgcctcccccactatgtagcatctgattcgtcatctctcatgaaggcgatttggttcataactctgaaactctgaaaaaggtcaaaagaagcagagaggccctcggtggatatgccagcttttctgccggtgctttctcccactactctgggtggtctgctctcctcttcaaacctcagctcgcagggagggcctgaatctgccagcccctcaggatctccttccctctgggccctccccagccttaaggagcctcccagacagaagggtggacagagccacctgggcagcccgagagacacacgggggtcctccctgtggacagccctgccagcttccgcccagccctgagcttcatttgcatcttgaggagtaaggggtggtgaaatgggaatgctggtctggctcagctggtcgtgggcataagtgcccgctgaatggatggcatctctccctcctgtcttatgttctggggtccaggtgcttcccagggccatgcccctgctgctaatgcttgccctaacccttaccctaaccagcgtccagcgtcgtctcaccgagccgtaaataaatcaacagattcgca

SEQ ID NO: 97743 - DNA, 2629 bp, Homo sapiens
tggtgccagcggtcacgctgcacctgaggcccccacctgaccagtgctcccagctctggtgtcctgagaaacccttcaagccatcccgcatgggcaggatggtgacatatccatgtggtaggattgtcccggccccaaagtatggccctggtcaggggagcccctgctggaaattgcatctccagagctttgatgcaggacccctgggggatcagggaatgagggtctccaccccaggggtctccttgcagtgagtctatatgcaggcctgcgttctgctcctggggctggttctgagtgcccagcttcagtctcctgagaacatgaggatgggagggggcagagtcttgctgagggcacacccagttcccgctggaggaggacagtgccagtcttctgcaaagggaccttgggtgggaacgggcccggagcgggaggaacgtgactccccagagggaagatgggcatcatactgggcccagagctgggaaggagttgctgccagcacagggtgggcctggactcccctcgcccctacccccagtggttgtggctgtagccctaagcctggagagcaggaccggcccggggtgtctgggaggctgccaggtgcctcccagagctcccaagggcccccacctgcaagtgccagcctcagggcagtgcccaaatgaggccctctcagctgcagccagcgatgccttgggatgctcaccgggagggaggcggctttgggctcctaagtccttgggagaggctgggagcagtcactgcgcggcttgcgcaagcccattgtcgggttgggtggcttcctcagccagggctgggagggactccaggatcaggtcctccctgtctcgagtctcagtggggtgatggggaggagacctggccacccatggctcaggggcagctgagaacaaggacctgctggagctggaagtgctgtggtgttgaggggtggggtgggcagcttctcacacctgcctcctgcctccttctgtccacctttccaccaccctgacctgtcccagccccacacatggttctgcctggctggcctgcccttggcacctggcgtagagcacacagaaggcactcagctaatgctgggcaggcccactcatggggagtgcgtggctgtgcagcaccagggaaccggcacagcagcgccggcagaaatcacagcagtaaacttgtccgggttgtatgcatcaaggtggcgatggacgtgggtccccccactgcactgtggccctgagcactgtatagcagcccggcaatgggagccattatcttgcccctttgacagaggaggacacagaggcacagggaggtgaagtagctgccccacactagtgcctcctcgctcactcaccaccccctgcaccacagtgcagccgcttctcccaccagctggggttccttggacccccaagcctgggaagggggaggtgagtttacaaaatggaaagcttaaaaggagaaaagtggaaccagaggtttgagaagccctgagtggtagagtaaggcctccagcgctgcctctgggtgcagggcagagtggcagaggagagggggagaggcactgggcaccatgggggcccagttcccacttcggggatctctctcgcagaaccgagggtccccttcatgggggtagatgcccagggctagctgttgccactgtctgtgtggacctgagtcctggacatgcccgagtgactcaggagtggctgcttgggcgggctctgtcaccctaggatgttatacattctgggaactggacaggagtggctgcttgggcgggctctggcaccctgggatgttatacattctgggaactggacaggagtggctgcttgggtgggctctggcaccctgggatgttatacattctgggaactgcaatcagccactagagaagtcggagctacaggaagtgaccctggggtgggacctggggacatggccaggtcagcatggggacacccggctccagcaggagctctggtctgtcctggggtctttgggggcagggctgcggccctgggcaggcttcctccaggcggaggtcctggggaagtgggggagccaggccagctgccgcctcccccactatgtagcatctgattcgtcatctctcatgaaggcgatttggttcataactctgaaactctgaaaaaggtcaaaagaagcagagaggccctcggtggatatgccagcttttctgccggtgctttctcccactactctgggtggtctgctctcctcttcaaacctcaccttaaggagcctcccagacagaagggtggacagagccacctgggcagcccgagagacacacgggggtcctccctgtggacagccctgccagcttccgcccagccctgagcttcatttgcatcttgaggagtaaggggtggtgaaatgggaatgctggtctggctcagctggtcgtgggcataagtgcccgctgaatggatggcatctctccctcctgtcttatgttctggggtccaggtgcttcccagggccatgcccctgctgctaatgcttgccctaacccttaccctaaccagcgtccagcgtcgtctcaccgagccgtaaataaatcaacagattcgca

SEQ ID NO: 97744 - DNA, 316 bp, Homo sapiens
ctgtacgaaaatattttctttgtttatatccttattctatacgtttttccctctttttaatttttaatttaaaaatttttttagagagacacggtctcacttcattgtccaggctggagtgtggtggcatgatcatagctcactgtaatcttgagctcaagtgatcctctctcctcagctcccgagtagctgggactaagggtgtgcaccaccatgcccagctaagttttaaattttttgtagagatggagtttggttgtgttgcccaggctggtcatgaacttctggcctcaggtgatcctcctgccttggcctc

SEQ ID NO: 97745 - DNA, 441 bp, Homo sapiens
cctaaaactcttctgaaagacattaacaagaaatgaattcatgacatgaaataccatgttctagaatgtcgtacagatgtcaattctcaaatttatctacaaatttaaggtaatcctattcaaatcccaagatagtttttggtggtggctgtttttgagacaaggtctcgctctgttgcccaggctagagtgcagtggtatgaccacagctcactgcatcctcgacctcccaggctcaagcaatcctcccacttcagcctctgaagtctctcatatggtgtccaagaaatggggacaaatctcaaaaagggactaggctcaggagggctggaatattcagggaagtttctttctttctttttttttttttttttttttgggaggaaagatgtctcggttgtggtccccaagggggggagtgcgaggaaggcgggagatttt

SEQ ID NO: 97746 - DNA, 527 bp, Homo sapiens
ttgttgaataatgataacaacaacaataatttgttgcatttatttcatgaacctgaaaataaaaagctgagagaagtggcctcagaaatcattactaacttagagtaataaaggagagagtgagcatgaataaaggtacacatttgaattaggaatattttctaaatgccatttgaacaattgtaaagtatacttagaaacttatctaatggagattgtggcttaatcagtgtataaaagacagaagatattggccaggcatggtggctcatgcctataatccaagcactttgcaaggcctagttgggttgatcacttgagcctaggagttcaagaccagcctgggcaacagggcaaaaaccccatctctaccaccaccaccaccaccaccaccaacaacaacaaaaccccaaaccacacagacacaaaaacaaaaaacccccaaaattagccggggcatggtggcacacacctgtagtcccaggtactcgggaggctgagttaggaggatcgcttgagccgggagg

SEQ ID NO: 97747 - DNA, 537 bp, Homo sapiens
gccttgctatgttgcccaggctgcagagcagcacaatctcagctcactacaacctccgcctcccgggttcaagcaattctcctgcctcagcctcccaagtagctgggattacaggtgcccgccaccacacccggctaatttttttgtgtttttagtagagacagggtttcaccatgttggccaggctgatttcaaactccagacttcaagtgatccagccccccaggcctcccaaagtgctaggattacaggcgtgagccaacatgcccggcttccatttgcttttgatattgtttttatctctgagttacaaactatacaagcttaccaggtataaggttagatgctacatctaggagcattcaagatatacattaatttaaacttttattagtctaactttctgttaagtctcttagctttgaaacataaaagagaaatcaagcccaaatttttagaggaaggctaaggtatactattggcagttgtagttttaattgtaattgactgattaaccaagtaatttataaaatgtta

SEQ ID NO: 97748 - DNA, 272 bp, Homo sapiens
atggggaagaagagaagaaggacacatattcttctctcagtcccacatggcactcactgataagagctgggaaatagcacattcatcaggccccaagagccaactttgtgggaacagtggagggtactcccaagattgctgttggtggggcagcctcaacattcagctctaggggagggtcccaggggaaatctcaggtaagaatttcccttcagtaagaacttactttgctgtgaacaacttgcaaattcattcatttctcgctcactctc

SEQ ID NO: 97749 - DNA, 152 bp, Homo sapiens
gccaggcgaagggcacagtggtgggaatggagagaggaacaaggagtctggctgcagtggggaatcccatgaagaggggaccgggccacatgtggcttggcctcagatgccaagagcctcggacacgcttccatgattctctggccagcatt

SEQ ID NO: 97750 - DNA, 505 bp, Homo sapiens
aacactttcatcatcccagaaagttccctaagccagcactggtccaggaaatgaagtataagcaggattagatctaagacttgccaggcattttggttttactgcctgaagccagcaagcaactggtttgggtcttcactcatgaaaacacacacacatacaaatatatacacagagagctctaaattgatttttaaaaaatctatagggtataaagcaagacaattaacaattatacattatatacagtctacaaatatcctagatatcacttttataatgagatataaggaattctggctgggagcagtggctcacgcctgtaatcccagcattttgggaggctgaggcaggcagatcacctgcagtcaggagttcgagaccagccttgccaacatagtgaaaccccatctctactaagagatacaaaaattagccaggtgtggtggggggcacctgtagtcccagctactggggaggctgaggcaggaaaattgcttgaacc

SEQ ID NO: 97751 - DNA, 119 bp, Homo sapiens
ctattatgcagggttaactataaaatttgaccaaaatctgtattttatggacaaaaaaggacaataaacatcaatacccaactggcttttgacataccatataagactatagagttaca

SEQ ID NO: 97752 - DNA, 358 bp, Homo sapiens
cagcctcaaacttttggactcaagtgatcctcccaccttagcctcctgagtagctggggctatagatgtatgccaccatgcctggccgatttttaaaatttttaaaaaagagacaaggtctccccatgttgtccaagtggtcttgaactcctgggctcagaggatatcatgcctgtaatcccagcactttgggcggctgaggcgggcaaaccacctgaggtcgtaagttcaagaccagccttgccaacatggtgagaccccatttctacttaaaaatacaaaaattaggcgggtatagtggcacatgcctgtaatcgcagctactcaggaggctgaggcaggaaagtcgcttgaaccc

SEQ ID NO: 97753 - DNA, 748 bp, Homo sapiens
cttgctgctgttcactctttgggtccacactgcctttatgagctgtaacactcaccatgaaggtctgcagcttcactcctgaagccagcgagaccacaaacccaccgggaggaatgaacagctgcagacgcgcggccttaagagctgtaacactcaccaggaaggtccgcagcttcactcctaagccagcgagaccaggaaccccaccagaaggaaaaaactccgaacacatctgaacatcagaaggaacaaactccggacacgctgcctttgagaactgtgacactcaccgtgagggtccgcggcttcattcctgaagtcagtgagaccaagaacccaccaattccggacatgtttcctcacttcctttatagcttatttaaatgtgactttctcgaggttgtctttgaccatcctttgtgaaacagcactcctatcaatgtcaccttcccctgcttggtttttgttattagcacttattgccatctctggcagagatttatagcacattaaatatccatttgctaccagctcctttcatataacccttgcaattaggtcaggccctataaacaatgggctgtgagcaaaaaggggcatatacacatctaggcaaaagcaccaaatgcaaccctccagctctgtcttcccctgctgcagtgatctagaccacatgttgcagtggtgaagccacagagtggacacagcctaaatcactgagtcactgcctgggtcagctgttctggga

SEQ ID NO: 97754 - DNA, 305 bp, Homo sapiens
gtttccttccagacatttcttctgccttcacgtacatagatgaaatgcatatttctataggaatatatagtgctttgggtcctgttttttctaagtggaattatactgtacatttttttctaggtaataattttttccttaaagattgtttaatgccagttaatataaaccaagctcttttctttcctgttcttacctgctacatgacatctatgttccactgtcagtttaaaatttctcatatgatgtccatgtaagatatttctaatatttcatgatcgtaaataaagctgcattgagctctc

SEQ ID NO: 97755 - DNA, 398 bp, Homo sapiens
cctcaactaaaataggaagaaagagaaaaggggaaaaatgaaacacaatcagaaagataaatctatggaagaagcatacagccaatgccctcaggtgaccaatcttcagtgtttccaaggccagctcatttctttctagactgcagataagtatccctgccaacctatttcattaacttgttgcgaaaagtaaattaaatcaaacatgcaaaagcacttggtcaagatttaaacactaaatgaatgtcaacaagtattgttattaagggctccctactcatctgcaaagctttgagggacaatgaccatatgagtttaatcacccctcacgtctttatagggctttagagttcatgatacacttctaaacacactatcttagtgcctcaagcgctggg

SEQ ID NO: 97756 - DNA, 121 bp, Homo sapiens
accgcgctccgttaacggaagaaacaagatggcggctgaaggcgatccgcagtggggccccagccattcggattgagccttctccctccaaccgcttccgcaggccgggcccctcctgccc

SEQ ID NO: 97757 - DNA, 746 bp, Homo sapiens
  misc_feature (115)..(115): n is a, c, g, or t
  misc_feature (123)..(123): n is a, c, g, or t
tctaccagaaacttaagagttgttatcatcctggcaatctaccttgaagattggcaaaatgttagttaactattgaatatagatgatgagcatatggaattaaatttgaaatttnccaatttncaggttgccaaaaatccaatttcaaattaagaaatgttaaatttaaatcttaaattaagaaattttaatatttaaatcttaaattaagaaatttaaggacacttcttaaaattgtttacttatcctttctagctagagttggccagatttagcaaataaaaaccaaggatgtcgagttaaatgtgaattctcaagataaaccatgaaaaaatgtttagcataagggaatcccatgcaatagttattacttttgttttattttgttttgttttcttgagacagagtctccttctgtcacccaggctgaagtgcagtggtgcaatcatggctcactgtggccactacctctcaggctcaatcagtcctcccacttcagcttcctgatggctaatttatgtattttttttttctttagggacaggggttttgccatgtttcccaggctggtctggaactcctgggcttaagcaatcctcccgtcttggcctcccaaagtgctgggactacatgcatgagccattgtgcctggccaatattccttacttatgctgaaaaatttcattgcttttacaattaaattttaattaggctggagattatctggtaaccccattcccagctca

SEQ ID NO: 97758 - DNA, 932 bp, Homo sapiens
cagcttcttgggctctacaatatagataataatgcccagttcatgaggttgtcttgaaggcaaaataggtatgcaatgtgataaggtgtcacaaaaaaaggtgagaggtttactgatttattttgtctccaatgtacccaagtcatcctccaaactgaaaccttgtcactgacccaccaacaaaccctgccatgtgccacagcctcatgattctctcctctcactagaggagtgcatggagtgaattttttccacttggtgatctttttgtattagtcattcattaattctgcagtttgatgagggtctgcttgtgccagcctcttactattcacctccctctctccttaattcacatgaatgaattttttcattcagctacaatgtgcattcaaggagcattcacaaacagcactcattagctgtggaatgatgccaagtggctcacgtggactgaagcccatgtgcttggtccatgaacaaccttccaatctgccaggttcagcctagtttccaggttctacacacagcctcctcaccacagcaaggccacttgatccctatctacagaaagtgtcagcccttctagcagaggtcctgtagtacttcaacaactatggccacactcagggacttgatattaagaatacttattaccagcccaactctgacctagtgcccagaatccagtagtatggtttctgagcccaagccctactctgggctttaatccttaggactatatttctaccctgggtcctgttttagcggatgccttagtactccaagtctctcctgagtccaaagcactgcctaggtattaccagcctttcctgagaataagccctcaattctaggctgactggggttctgctccatgtgaagagacttctgtggggctcagctgcctagactcccaaattccacccact

SEQ ID NO: 97759 - DNA, 257 bp, Homo sapiens
acagcagcccaaacactcagccaaggctaactaactgtagtttccagtctttgttcaagacactctctcctgcttagaagtgccatcctgccattcaccaccccaggtaagaccccttttgaagagctccaagtggtagcctcttttggatggtttcctcaagcagatcactaacggcaccacctacctcctcaactctctcagcactcaatccccatccccagccaatggagccctaatcctctgcttattgctgt

SEQ ID NO: 97760 - DNA, 231 bp, Homo sapiens
tcacagttctgcaggttgtacaagaagcatgccactagcatctgcttctggtgaggcctcaggctgcttccactcactgtggaaggtgaaggggggccagggtgtgcagagatcacatgacaagaggggaagcaagagagagtgagatgggagggccaggccctttttttgtttttttctgagacagagtctccctctgtcacccaggctggagtacagtagcgtgatctt

SEQ ID NO: 97761 - DNA, 519 bp, Homo sapiens
tgggggagatgaggaagtggggaggagaggggatagggaccctggcttctcacctcttctaaagaggccttcatctgtttgaccccagacccatccacggctgggcagtgggtccctctcctttttatagctgaaccccatcacctggaaggctattaaaaagcaaggttctggagttggcatgcaggttctacccgcaggcttggtgaaggggggtaggggtcagggagcactgcaaagacgaacagtctggggttcttctgttgcccccagtggtaagcagggcaccctctctgggccagcacagccctggctgggggcatgactagaggaggggatcccggctgatctcagtcccactggcctccactgggtgctcctgcgtagggccctccctgctcagccattctgggaagctttgcttgaaggggatcaggaaggaggaaaccccctgcctccactttgaaacccgcacactgtttccccattacgtcttgcagggaggtggaggcgttaaat

SEQ ID NO: 97762 - DNA, 353 bp, Homo sapiens
ttgcattgggatataaccttcaaccttgacgtagaacagggcttacctggatgggtctttacttgagacaggaacttgggtaaagctacagagttttttataagccatgtagatattgtggggatgaggggccttatccttccgcatgccatcctcattggggttttgatcacagatctgtatttcctgggatacctgagtgccctcggctttaacccaagttcagcttagcactcctgagtggtgagattctcaacttaagagggacggttgggccggaatccttgggtctgatttgctgtgggaaggggaggaggctaactgtcccatggacctggtcacagctgttccac

SEQ ID NO: 97763 - DNA, 705 bp, Homo sapiens
ctcaaaaatcccaaaaaacctacaggaaagccacagccagcatgtgttgacttgtatgtcgtttctctctcttctcaaagctggaatgctggggctactttttacctaccttttctattcccaatcccctgctcctttccatccctagtgggagtaatttaattctgcaacaaattctcatagttaaggtattcagcaatatatccctgtatcctagaattctctgtaaggaaaaaagttgtggttgaggggaagagttctacattcagttattttagtttaatattactaagaacttcattggaacccagaacaatcttccctgccgaaagagctttgtgcccattctctgtgaatgctctttaggagagatgcttaaggattctctccacacctccccatgtgtccttactcaagaccagaaactctcaaggtgagaaggtagatgagaatgaccttcagtaataccctctttcccggtcccccagttccctcgagcaggggcagcagaccccactgtgacccacggaccaaagccagcccactgccttgtttttgtatgtagtcaaaatgtacaaaaacaagccctgctcatttggttaggtggcatccatggctgtttcacacaacaacagcaaagtcgagtagttgcgacagaaaccatatgccctgaaaagctgaaaatatttactatctggcctttac

SEQ ID NO: 97764 - DNA, 448 bp, Homo sapiens
aatagctggggcactacaggggactgggctatatatctgagacagaacaaaaggcaccaaaggctcttctatctttaaatcttgtggggggtgtgatacatgacactgtgttagcgacccaggcacgaggtaaagggtgagaggcagctgcactcctcaatcacacaccacgagagcttcctgccagggctctgcacttgctgctggttctgccgggaactctcatccctgtgatgtgcccagctgtcctttcctctccctttgtgcacatctccacgcttaagcaatgcaccccccactctgtccagccttatttttctcctcatagcactaatctctagctggcacgatagcatatgttatgtgttcatcaaccgtctccctccattaagatgtaagcttccagctgggcatggaagctcacgcctgtaatcccagcactttggga

SEQ ID NO: 97765 - DNA, 97 bp, Homo sapiens
acgtttgccaccggcagccaaccagttgggcccgagtccgcgggcaagaagcgattgggggcgcgtgagctcggctccccggtcccccgtccgggtg

SEQ ID NO: 97766 - DNA, 649 bp, Homo sapiens
gatacgaagtcgagctggtacccccgagctagccgacagcagccgtgacatgtgcgtgtcggctggctgtgccatttctttccggccaccagggacgccaagcagctcggggtcagacctcccaaagttctgggattacaggcttgagccactgcacctggcctaaacacacttttttgattctcctttcattccatcaacattctctgttccttttcactccctacagcaaatccttttgactacacagtgctgtattcataacactgaattatagacttcacttttctcaccagcctctccaaacttgctttatttatctatgtttatcattatttatgtgtgtgaaaatatttcatttgcataactccactgaagatgaaagtcttcactttcactttcgtgagttccaccttttgattcgcatttctcttctatctccatttcctctcacatcctacttacttagcttctgctgtgtaagtctgttctagacactccttttgctttgtctcacttttgtcctttttctaatgtaaccctataaaatgaaatacattaattcctgttttataattttctattttaatttgctcccaagtacacatattccattccaccctgtcgggctagtcgaggggggatcctc

SEQ ID NO: 97767 - DNA, 257 bp, Homo sapiens
gacaatgatgacaaccattttattaaaaaaaaatagtgtctactatgtgttagctgctgtgctactaacaggcactggtttttgccagtgatctataagacaaggcatggccatcctctcctgggcttccagcctagtggggagggctagctggtcaacagacagtgtggtgagagcaggtgcagagtgatatcacagcacagagaagcaacccatccaggcatggggaccagagaggaacattactgatggaagtc

SEQ ID NO: 97768 - DNA, 156 bp, Homo sapiens
ttgtgtgtaaaatgatactcagaatctgacccacctctttatgttgtgaaaacaagtgttgtacagagtttgaggatacatatgtcacttatttacattggaagattcttgcctagggggcaatgctgaagttagctttatgtattgagttgagac

SEQ ID NO: 97769 - DNA, 272 bp, Homo sapiens
ttatatatttttatttggaaaatgtgtgattatgtctaactatgcttttatccctctttatattggtttcttcttgactcttagcttgaatctctgatttctctcctttatttctcacatgttatgtcttattttaatatgattgcccctttcttctgaatctcattaaacactgtcttccatatatttctggcatttactgcagctcgtgtgaattttgattttattgtttacatttttattttttgagacagtgtcttgctgttgcccag

SEQ ID NO: 97770 - DNA, 429 bp, Homo sapiens
tcaaggtcagctagacataaaagaggaggcccttttcctcatgtctcattaggtcatgtccagagttctacacatgtgtatgcccttctagatttctaggaataggtcagaggttttcaaagtgctgtctgaacatctcattcccctgattttccttttgacacttttaaagtcttgttaccttaattgccatctgctcaaaccccctcttcccaggtcggtcaactgcaaaattaaatagttgctatcatttgttttttgactaatgtcctagacatagggctattcacacagagtaaaatctacatcagattaatttaagacaagccctgagaatagagctttttcagggaactgtcagatagggacaaatagtgacagtctgggagatgggggcattttgcagagcttcagacttattgtgccccc

SEQ ID NO: 97771 - DNA, 687 bp, Homo sapiens
tcctctaggttctgtctatgtcaccaccctcttcaataaccaggtgaggcagacatgatttccatttggaggatggagaaccgaggctcaggacctcgcccgtgcagccaagaggagacaaagatggctaggtctggttcccaagcctaaagaccatgatctgtccagtgtggaacactgcaggcccccaagttctgtcatttgtaaagtcatgggcttgtgtgagtcccgagcaatcaaagcagcagaagcaatgctcccaaggggtgcacgagggccatgtttggagccatgccagcttgccaatccttggcatactctgtacatagccagataactacacaagctcacctcatctgcacaaactcactctctgaacacttctaaggtcaccgagaagtcagggaaaaatgagaaccaggacagtcaaagcctttgcctctcctgaagctatggggcttgttgccagagccaaagcccctcttagcactcttattacttcatttaacaaacataaggagagcccggccctctgcttttaagggtggattccattactattaagacttctgcggcccctgaaagattaactcaacagtcacccctgtgaaagctgatccaagtggaaaatcgagttagaaaattccaccttcccttccctcacacctcagcagattaaggggaagg

SEQ ID NO: 97772 - DNA, 598 bp, Homo sapiens
tagatcatcagctattgttagtgttagtgtatgttatgtgtggctcaagacaactttgtttcttttaatataggcagggaagtgaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcggtgtcattgaccttttcattatttcaactattattattccaggttatcaatagtctggctgtctatcgtcatcgtgagactgactttggtgtaggagttcgagaccaccctggccaacatggcaaaaccccatctccacaaaaattggataatttgataattatcattattgggtttctgagacgttacacatttaacattctcttctgcacaagttgcctttgtgtgagtatactaactttctgtagaggtatacttgtaatcacaaataagaataaattatataaaacaaaaaaaaa

SEQ ID NO: 97773 - DNA, 523 bp, Homo sapiens
ttttttgtaggtttcaggcacagaactgtatatccaataatagtgaaatggatcccactaattatgacagaaatgatgatacatttaaatgacttggatgttttataggttggcactcatgatgagccgctgttctcattctgcaaatggtgaagctctctattgtcctgaccccacagttcctgtcgcatgaccagagccagctcaccaaggagctgcagcagcatgtaaagtcagtgacatgcccatgcgagtacctgaggaaggttatcaatagtctggctgtctatcgtcatcgtgagactgactttggtgtaggagttcgagaccaccctggccaacatggcaaaaccccatctccacaaaaattggataatttgataattatcattattgggtttctgagacgttacacatttaacattctcttctgcacaagttgcctttgtgtgagtatactaactttctgtagaggtatacttgtaatcacaaataagaataaattatataaaacaaaaaaaaa

SEQ ID NO: 97774 - DNA, 317 bp, Homo sapiens
  misc_feature (25)..(25): n is a, c, g, or t
  misc_feature (29)..(29): n is a, c, g, or t
atataaaaaccagtctttgtcaccnaaanacattttgaccacgatagtgccactttttaggttatcaatagtctggctgtctatcgtcatcgtgagactgactttggtgtaggagttcgagaccaccctggccaacatggcaaaaccccatctccacaaaaattggataatttgataattatcattattgggtttctgagacgttacacatttaacattctcttctgcacaagttgcctttgtgtgagtatactaactttctgtagaggtatacttgtaatcacaaataagaataaattatataaaacaaaaaaaaa

SEQ ID NO: 97775 - DNA, 316 bp, Homo sapiens
  misc_feature (44)..(44): n is a, c, g, or t
atacattcgaataaaataatatttcgcaatcaaaaatgcaaccncccctggaacttcgagttatcaatagtctggctgtctatcgtcatcgtgagactgactttggtgtaggagttcgagaccaccctggccaacatggcaaaaccccatctccacaaaaattggataatttgataattatcattattgggtttctgagacgttacacatttaacattctcttctgcacaagttgcctttgtgtgagtatactaactttctgtagaggtatacttgtaatcacaaataagaataaattatataaaacaaaaaaaaa

SEQ ID NO: 97776 - DNA, 285 bp, Homo sapiens
tcacattcacctgtgggcagagggacaggttatcaatagtctggctgtctatcgtcatcgtgagactgactttggtgtaggagttcgagaccaccctggccaacatggcaaaaccccatctccacaaaaattggataatttgataattatcattattgggtttctgagacgttacacatttaacattctcttctgcacaagttgcctttgtgtgagtatactaactttctgtagaggtatacttgtaatcacaaataagaataaattatataaaacaaaaaaaaa

SEQ ID NO: 97777 - DNA, 488 bp, Homo sapiens
gtcacacagctggtcagcagcaacatagctggtctcaaatctaaggtgcctggccatgcctccatgagggaccgcctgcaagggaggttgatcctggctttggggagcctttcctgggctgcacgaataacctccattgttcgagaccccaaactctgctcacatcttcctttccctgtctctgcttgggctatgatcacggtgactctagcaacccttcatggacattataatactctctgccattcacttttggtctaatctgacttcaacccccacttacttggtctctccttttacaaccaacatggcaaaaccccatctccacaaaaattggataatttgataattatcattattgggtttctgagacgttacacatttaacattctcttctgcacaagttgcctttgtgtgagtatactaactttctgtagaggtatacttgtaatcacaaataagaataaattatataaaacaaaaaaaaa

SEQ ID NO: 97778 - DNA, 440 bp, Homo sapiens
ctgggtgacagagcaagactttgtctccaaacaaaaagaaaagataattactttatacttagcttgtcttagccatgagtgacgggctgcatgtggcccaggacagttttgaatgcagttcaacacaaatttgtaaactttcttaaaacattaggagattttggccaggtacagtggctcatgcctgtaatcccagcactttgggaggctgaggcgggcagattacctgaggtcaggattcgagaccaccctggccaacatggcaaaaccccatctccacaaaaattggataatttgataattatcattattgggtttctgagacgttacacatttaacattctcttctgcacaagttgcctttgtgtgagtatactaactttctgtagaggtatacttgtaatcacaaataagaataaattatataaaacaaaaaaaaa

SEQ ID NO: 97779 - DNA, 705 bp, Homo sapiens
tggcggatagcagaacctttttgtctccctctaattgctcctaagcctcacgctcccttgccccgcgtgtcctgttgcttccctgatcttctccgtgacctgtagctaaaccttccaccagcgcttgagaacttaatttgaaccggatcctttcccagacccctttcttcttctcctcctccacctcctccaggtgcccaacagcccccttctcctcctttcccttcccttacccttcccctccccctccccttcccctccccctcccctcccccgccccaactcagatccgccccggtccccgtccccttccctcccccctgccctaagccacctccacctctgtcctggccgcctcagggcaccctgaaaggatcaggacatgcggctgcgcttttggctcctcatttggctcctgctgggatttatcagccatcagcccacccctgttatcaatagtctggctgtctatcgtcatcgtgagactgactttggtgtaggagttcgagaccaccctggccaacatggcaaaaccccatctccacaaaaattggataatttgataattatcattattgggtttctgagacgttacacatttaacattctcttctgcacaagttgcctttgtgtgagtatactaactttctgtagaggtatacttgtaatcacaaataagaataaattatataaaacaaaaaaaaa

SEQ ID NO: 97780 - DNA, 847 bp, Homo sapiens
tggcggatagcagaacctttttgtctccctctaattgctcctaagcctcacgctcccttgccccgcgtgtcctgttgcttccctgatcttctccgtgacctgtagctaaaccttccaccagcgcttgagaacttaatttgaaccggatcctttcccagacccctttcttcttctcctcctccacctcctccaggtgcccaacagcccccttctcctcctttcccttcccttacccttcccctccccctccccttcccctccccctcccctcccccgccccaactcagatccgccccggtccccgtccccttccctcccccctgccctaagccacctccacctctgtcctggccgcctcagggcaccctgaaaggatcaggacatgcggctgcgcttttggctcctcatttggctcctgctgggatttatcagccatcagcccacccctgttatcaatagtctggctgtctatcgtcatcgtgagactgactttggtgtaggagttcgagaccaccctggccaacatggcaaaaccccatctccacaaaaattggataatttgataattatcattattgggtttctgagacgttacacatttaacattctcttctgcacaagttgcctttgtgtgtctttcctgaagactatcttctggtctcgaaatggacatgatggatccatggatgtacagcagagagcctggaggtccaaccgcagtagacagaaagggctgaggtccatttgtatgcacacaaagaaaagagtttcttcctttcgaggaaataaaattggcctgaaagacgtcattactctacggaggcatgtggaaacaaaagttagacct

SEQ ID NO: 97781 - DNA, 304 bp, Homo sapiens
agcatactaaaaagtataaaaaaattttggacagaccaccaattcaggttatcaatagtctggctgtctatcgtcatcgtgagactgactttggtgtaggagttcgagaccaccctggccaacatggcaaaaccccatctccacaaaaattggataatttgataattatcattattgggtttctgagacgttacacatttaacattctcttctgcacaagttgcctttgtgtgagtatactaactttctgtagaggtatacttgtaatcacaaataagaataaattatataaaacaaaaaaaaa

SEQ ID NO: 97782 - DNA, 538 bp, Homo sapiens
tggcggatagcagaacctttttgtctccctctaattgctcctaagcctcacgctcccttgccccgcgtgtcctgttgcttccctgatcttctccgtgacctgtagctaaaccttccaccagcgcttgagaacttaatttgaaccggatcctttcccagacccctttcttcttctcctcctccacctcctccagggcaccctgaaaggatcaggacatgcggctgcgcttttggctcctcatttggctcctgctgggatttatcagccatcagcccacccctgttatcaatagtctggctgtctatcgtcatcgtgagactgactttggtgtaggagttcgagaccaccctggccaacatggcaaaaccccatctccacaaaaattggataatttgataattatcattattgggtttctgagacgttacacatttaacattctcttctgcacaagttgcctttgtgtgagtatactaactttctgtagaggtatacttgtaatcacaaataagaataaattatataaaacaaaaaaaaa

SEQ ID NO: 97783 - DNA, 307 bp, Homo sapiens
ccgatgtgaatggtttagggcggagaaggggggaggaggggagggggggcttagggacttcgctacgctgctacctgattctgtgtctggctttgcagtatctcaaggcttttataaaagctggttctggactgtttactatggggacgtggagagtcggtggggacagcagcaaagccaccagagaagcctcctagaaaagatgaaactacaacccaaaattcggaacttgaacaggaaaataaataccaggaagatcaatttaattaactgactcccttggaaattaaaatattaattaaaagtt

SEQ ID NO: 97784 - DNA, 237 bp, Homo sapiens
ggtggttctaatgcttggggctcaccaccttccctcccttatactcctttcctgatgcagagtgccagagtagccaataccccctttcaacaggagctcacaggacagaagaaggtcaaaacttaaggaggaaaattacattaaaagaaagatcaaaactgtacaagacaacaatacataccacccaaagcaaaaatattagagcaaacagaccaaggaattttttttttttttttg

SEQ ID NO: 97785 - DNA, 190 bp, Homo sapiens
ctactgtggaaaaaatgaagcagaagggaagtgcagaaacaggaaaattaattaggctattgagtggttcaggtggcagatgatggtggcatggaatagggtactaacagtgaaaatggaaataaatagccaaatttcagatctattccagaaatgaaatgaaaacaacagggcatgcagatggtttgca

SEQ ID NO: 97786 - DNA, 110 bp, Homo sapiens
tcaccccaaaaggaaacgctgccgcctcagcagtcagtgctggtctcccctagcgtcctggagcgtttttccctgcatggaggcccacgagtcccgcgctttcctccttc

SEQ ID NO: 97787 - DNA, 400 bp, Homo sapiens
aaaccattgaaggtttgatgggattacatatttatttcagaaaagatataatgaaaaattttctgaagggaagagattggaattttaaaaaaacacacagttaagaagctacagtaccatagtaattcaggtgagaagctataaggacttgtgtaagggaggaatggcaaaggaaaaagggtgatacatttggggaaaaattggggcaaaattgccaggtcgaatgtgtggttgtaactaatttgttgtctctcttcttttttcataataagaccctcgattgtagacagcccatgttgactcaaaataaagaccacatctcccagcttcccttgcagctaagtgagaccatatgagtacatcccgatcaatgaaacggaacagatgtgtcatgtggtga

SEQ ID NO: 97788 - DNA, 276 bp, Homo sapiens
agagctagcaccatgagcttcaataccctgcaattgctgtcgagaaacttccccctcctaaccattgccgccaccacctaatatactagtctccctgttagtaaccggctccttgaggactgtattgttaacatctgcctccctaaagtttgacataggaagtacataagttatattacttaaattgttgaatccttatcacctcctaatggttttcttcctcacatctgagtttttacaaccggtctcttgaccatatcctatgataaaatgcca

SEQ ID NO: 97789 - DNA, 855 bp, Homo sapiens
ttaaattgataattaaatcgataaaaggaaagagagagaaggagcctagagggagacgagactctcttaatgtaccaccgctacacagtttcagagttacctgcttctcccagagagacgaggacagattgcctccagcaggggcacagcagacaaaaggcacagactgacctgggcagcccttgctaggcaaccaagctatgaaatcacagctcactggcaccagcccaagcctctctcttcccctgggctcatgaccagaggttggtttccagtgggcaactgattacctgctgtgccaattctctttgcattgtgatctgaagatgggcctggggtctactatgatatgaaaatgtcctacagtacctggcattggaggtgtatgggtagtgggagaaaaacaaggtttgaaatctacagagtctgaaagtaggtcatggggcattcctcccatcattagagggtgtacatttgttggtgaaggattgattcatctcccatcaacaccttgtcagcctgaagttcctttgtcagaaatatacttgataatgcgggtccaaattgtatatgtgtcatatcctataaagcatggatccatcccatcctctattgtggccacaaatgccttccacagtaacctgcagccgacctactactgacaaatcccagcaaatgtgtggtagtcacttctcttcctcgggtctgcagggactcagggtgcagcactgttctcagatttgggctggagctcagtatgactgttggggtctcctgctacccctggagcctccatgtgctccactcgggttgggatccagcagtgcagaggtgaactctgggcgcttggaaggc

SEQ ID NO: 97790 - DNA, 460 bp, Homo sapiens
cctaggtttattaccattagatcataccccttttgtctaatgtttctctacaactatccatgtctttcatcagacttcgcataaaaatacagtttttgctggtctttgggtcttaatttctgaaggctcctgtgtcatgtaaaactttgttaaataaattatgcttttctcttgttaatctgtttcgttacagagggttcagtcatgacccttgcgatggatgaggaaaatatgttactttttctcccctacaactgcctcttatcactttaaagtactgctagtgaaattctaaatgttttagtatgtttagtgaaatacaaaatgtttttgtataataacaatatttctcatcatttaaaaattgaatccattaattctttaccaatattcaagtgttctaagaggcaacaaatcttagtcttagttattatttttaaatgtttttatctttcttttt

SEQ ID NO: 97791 - DNA, 479 bp, Homo sapiens
cccctcgagtggctaggactacaagcacacgtgctaccatgtccagctcatattttattttttatttttgtagagataggctggagtgcagtgacactatcacatagctcactgtagcctccaactcctaggttcaagcaatcctcccgcatcagcctcccgagtagctgggactacagccaggtgccactgcaccagctactcttaaattttttgtagacagagtctctatatgttgctcaaggctcgtctccaactcctgtcctcaagtgatcctcctgccttggcctcccaaagtggtaagattacaggcgtgagccaccacaccaggctcacaggttaattttttttaattattttactgtgtatgtttgcctaaacaaaaattatttcattttgcttataattttacttttttttttttttttgagatggagtctcgctctgtcacccaggctgaagttgtgtgatctcagctc

SEQ ID NO: 97792 - DNA, 193 bp, Homo sapiens
gagatcacaccatcacactccagcctgggcagtagaatgaaactctgtctgaaaaaacaaacaaacaaaaaaattattaagagtaattatctcagtctgccaggatttataaatattaatgtcccaaactgaagttagggaggcccatttttaccttttttttttaccttttatttttatctctgtgtaattg

SEQ ID NO: 97793 - DNA, 454 bp, Homo sapiens
ctcactgcaacctcccactcctgggttcaactgattctcctgcctcagcctcctgagtagctgggattacaggtgcctgtcaacacgcctggctaatttcttgtgtttttagtagagacggggtttcatcatgttggccaggctggtctcaaattcctgacctcaggtgatccacccgcctcggcctcccaaagtgcagagattacaggcatgagccaccgcgcctggtcaaatattggctttctagtcactatcatctaaaacagtgggttttgggggacaaaatccaacagattcatgatttaaaaaaaaaaaacaaaaacctcagcaaatttggcacagaggggtacttcctcaacctggtaaataatatctacaaaaacctacagctaacatcatacttaagggtgagaaactagaggccttcccattaaggttgggaacaaggcaggat

SEQ ID NO: 97794 - DNA, 798 bp, Homo sapiens
ggggtttttgcgaaatacgcaccaggtaatgtaattggaaagctcagcgccccccaactccacatacctggggattccagtcattccggcacttttctttttctatgttaatgaacacatttgcactctgtttttgctcattcattctttttctcctcactcagatctgtttatgcaacagatgtttataaagtgaacgtgggccacccctgtaatcctagcactttgggaggctaagataggaggatcgcttgagcccagaagttcaagaccagccttggcaacatagtgagacccccatctctacaaaaaatacaaaaattagctgagagcggtggaacgcaccagcaatcccagctactcgggaggctgaggtgggaggcttgagcctgggaggtcaaggctgcagtgagccgggattactcaactgctctccagcctgggtggcagaatgagaccctgtctcaaaataaataaataaaaataaagataatgtgaacctgaagtgaatttgtgtggagggacttgaacccttggggacagctccctttctgtaggcgaggagccactgggtaacttgagtcaaacttgagcatactcaaatgagatgaaggccttcggtcactgtgtcagggatcagagggtacagcttcctcaggcctgacttccttctggaagcctttttgagcatcttggcccttactctgtgattttcccaaactctgcacacttctggcagaggcaggtcagggtaggggtggagagtgtggattctggggccagggtgcctgtgtttga

SEQ ID NO: 97795 - DNA, 613 bp, Homo sapiens
taagccaattgccagaagaaccaggaaaatttctcctgaacagcagcttcctaacccagggaatgtgaaagttaaagagtaatttttagatacctaaaatgtaacccctgactttgacaatggctcaaggtacagagtcaagaataactttattccagttcccagtgaagatgttaaaaagcattaaaatgaattcccaattccttacaaaaatatacaatgtagttaaggaatataaggcagaaaccaccccaccaacacacacgctcaaaaatgaccaataacataataaggaagacattcttggagaccaactggtaaaagatcttccatatggtcaaatctaattttaaccgtacttctacttctcaaaacttaagaggcaatgtagtttctatttaacaaaactccaatctgagataggcaatgcagaaatacctttataaaatagcaaaaaggacattcattagttttcgatgacttgaaaatatttttaaatttatcaatttagtcatttatgcaaacaggtgccttgatgtctttaatccttatttaattgtaactccacttacactatttgatgaaaggccacagaaaaatacaggagccaata

SEQ ID NO: 97796 - DNA, 361 bp, Homo sapiens
ctaggattgtataagtgcccatttaatagcttgttttttgttaattatactaaatatagttgggaggtggtgtttggagatgttcatctctcatttattctccatgatgtaaatattctacatttttctctacgatataaatattctatattataaaatactcaagtctgttcgggacgtgaaattaaagtaatacattacagaaaccacttttgcttgagtaattcagctacctttctgtagctaaattcaacgtatattttcaactcttgccatgcttggcatttttataacattttcgtctctgtcgaccatttctttcctgaaatacatttttctcctgacttcctacttctccctc

SEQ ID NO: 97797 - DNA, 779 bp, Homo sapiens
aataggaattggccttctctgaaccttctctggatctccaaggttttgcacgtttcttaggtatgttaattaggcattcttgaagtgttgtcccagtggggatgcactgatgacttaggtcatttgagtcttctccatgcaatgggaacgtgaatcttactgcagttccgtcacgttccacatgatggtggccttgtctccgcaaaccggacttcaggtccctgtgtgctaagtttattggcctcaatttcaagctctggtaataaagcagctgtcaacttgccagagcccctgtgaaacagctgggattctcaacttgggctacatccaacacctgtggctacgatacagggattgtgagagagaggacgcttgacgaagagcaatgggactgtctgaacattctcaaattctaatttactcaagcatgtttggttttgagttttacttttctgtagaatattttcctaaaacaattcaaatgttgaggatagaggattgaggtgcatagtgaaaatttaaataatgctgtgttctatactgtgcttattaggctttacttctaatcatttacctgtctctagagccgtgctttccgatacagcaaacaagccacatgttgctcctgaatacttaagatctagtctgaattgagatcagcagtaagtgtaaaatacacatgaaatttcaaagattaaatatgaaaaagattatgtaaaaattatactttaatatgaaaacataatactctggatatattgggttaaatatattactaa

SEQ ID NO: 97798 - DNA, 800 bp, Homo sapiens
aaccagtgttgtagaatgcctctgagaatcccacagcacatcccaattccagagttaacgtattttaaacctcaagagaatggtgactgcagtagcctcttaatttgtcatgcaggcttcttttgtcctaatccagccccatacagctactagtgacctttctgaaatgtaaatctgatcctgtctctcctcttctaaaattcgccaggtgtcccttgcctttgggattgtcagcataacacacagacctttccatttccattccctgctggcttttccagcctcatcttcctcactgccacacgtcacttcatctatcatttccatactgactgaatggcagcttctcaaacattatgtgtcttttcacacatctgtctttgtacatgtaatttcttctcatttggaatcacctcccttatccttccccacctctccccatttcttggctaaaccttaattcattgtttagtatttaaagtcaagtgtcagctcatgttggatagattttctttgagccatcgagactaagatgatacctcattcctgtgtttatcctttgtactcacataagagtacatgtatagcatgtaacatacaatgtgtataacattttttaagatagggtataacatataacgtgattcttccaggggagcactgtttctctaataatgataatcctgtattacagtttaaaggctttgtagtttgaaactgcaaggaaaagaaagagaattggtacctgagggtctaaggccaggctaagggagaatggtaggagttggacatggggatgt

SEQ ID NO: 97799 - DNA, 282 bp, Homo sapiens
atccccctccatggtgggtgccttaatagcatccaggaacttccaggggcttttatgttgattattttatttaaattcccctaacaactctgaggtgggtattgttattgttattatgcctatggtattggttgggagacttaaggattctgatggtgagaaacttgtccaggtgcacccatttaattcatggcagagcaaatcagctggagccaagctgagactcttcactcctaagcataggggaggtggcagtagaagtggaaagaagcagctgtactt

SEQ ID NO: 97800 - DNA, 791 bp, Homo sapiens
attttatctactctagaacttcatataagtaaaatcatatagaatgaacttttctaggtgttttatatggctcagtataatatttattagattcatccatgttcctctgtgtatgtatgggttacttttaattgctgagtagtattccattgtgtgactatgccacaaagcatttatttattcttacattgacatcatttggattgattccagtttggaattataaagatgctatgaacattctttttcttcaacatctgttttgtggacatctagtttgattcctgttggataaatacttatggtaggtttatgtctaaatgctaaactagtccaaggtggttttgcctttcacattcccaccataaatgtatgaaagctatggttgcttcaaagccttgccaatatttgggtttttggaattttaaatttaagcctcctactggtgtattgttgcgattttgatttgtatttccttggtggcttggttccttgaacatcttttcatgtgtttattggacatttgtgtaccttttttgtgaaatatctattccagttgtttgctctttattaattgagttacctgtctttactatggagttgtaggagttccttatgtattctgggcataagtcttttgtcagatatgtttttcgagtattttatgtagttgttttttttactgtcttaattgatgtctttcagtgaatagaagtttattcttatttcgatggggtctgatttatttttatttttagaaacagggtcttgttctgttgtcctgggtgaat

SEQ ID NO: 97801 - DNA, 718 bp, Homo sapiens
atgcaagtcaaaaaagacaaaaattatatgattatgctccatcaaggtcccaccacccaagtcagttcctgcaagtgggtgcaggccctgcttctcttcatcctccctggcttgggaaatcctactgctccatggatgggtgcacctccctgccaacactcagagcctccctcctctggggtaacctagccctgggtattataaagctaaacttttaaaaacaaaggcccaatatccatatgcaaaagaatgaagttagacctctacctcacatcataaacaaaaattaactcaaaatggatcagtgactttagtgtaagaactaagcctatgaaactcttaagagaagacataggggtaaatcttcaggactttggatttgagaatagattctcaaatagggcaccaaaagcttgagaaacaaaagaaaaaatagataaattggactttatcaaaattagaaatgtttctatatcaaaggacagtctcaggaaagtggaaagacaaattataggatgggaaaaatgtttgcaaatcatgtatctgataagaatctagtatccagaatatataaacaattcttacactcaccagcaaaaaggcaaacaatccagcttaaaaatgggcaaaggacttgaatggacatttctccaaagaagatatgcaaatggccaaacagcacatacaaaggtgctaaacattattagtcttcagataa

SEQ ID NO: 97802 - DNA, 1424 bp, Homo sapiens
gatcctccgggctgcaggaattcggcacgaggaaaagcaagggcagggttcagaaagactgaatgtaaagctgggctctgagtctgccaggcccttcgtgtgttgctctgcacattaattaaagggtctacgaggtcagcaaggacgcccaagaagactcagtcatgaaaggtgaactgctcctgttttccagtgtgattgtcctgctccaggtggtatgcagctgcccggacaagtgttactgtcagtcatctacaaattttgtagactgcagccagcagggtctggccgaaatcccttcccatttacctcctcagactcgaacgctgcatttacaagataatcagatacaccatcttcctgcttttgcatttaggtcagtgccatggctcatgaccttaaacttgtccaacaattccctttcaaatctggcccctggagctttccatgggcttcagcacttgcaggttttaaatctaacccagaattcactcctttccctggaaagcagacttttccattccctccctcagctgagggagcttgatttgtcatcaaacaacataagccaccttcccacatccttgggagagacttgggagaacctaactatacttgcggttcaacaaaaccagcttcagcagcttgatcgagcgctcctggaatccatgcccagtgtgaggcttttacttctcaaggacaacctctggaaatgcaattgccacttgctcggtcttaaactctggctggagaaatttgtctataaagggggactaacagacggcatcatctgtgaatcaccagacacctggaagggaaaggacctccttaggatccctcatgagctgtaccagccctgccctcttcctgctcctgatccagtgtcctcgcaggctcagtggcccggctctgcccacggtgtggtcctgaggcctcctgagaaccacaacgcgggggagcgagaactcttggagtgcgagctcaaacccaagccaaggccggccaacctgcgtcatgccattgccactgtcatcatcactggcgttgtgtgtgggattgtgtgtctcatgatgttggcagctgccatctatggctgcacctatgcggcaatcacagcccagtaccatgggggacccttggctcaaaccaatgatcctgggaaggtggaagaaaaagagcgatttgacagctcaccagcctgagagcttttgtctcaaataggattggtcattgcaggccagaagatagtgtctgagtagggctgatgtgtttcctgttagtctgattttgcttttgccaaaagacaaaaaaaaaaaaaaaaaaaaaaagaaaaaaaaaagatgtgtctgtaaaaaatatttctggggaggaatttatgttgcgatttttaaaatactataggtaaaataaagatgatacttgtg

SEQ ID NO: 97803 - DNA, 1377 bp, Homo sapiens
gatcctccgggctgcaggaattcggcacgaggaaaagcaagggcagggttcagaaagactgaatgtaaagctgggctctgagtctgccaggcccttcgtgtgttgctctgcacattaattaaagggtctacgaggtcagcaaggacgcccaagaagactcagtcatgaaaggtgaactgctcctgttttccagtgtgattgtcctgctccaggtggtatgcagctgcccggacaagtgttactgtcagtcatctacaaattttgtagactgcagccagcagggtctggccgaaatcccttcccatttacctcctcagactcgaacgctgcatttacaagataatcagatacaccatcttcctgcttttgcatttaggtcagtgccatggctcatgaccttaaacttgtccaacaattccctttcaaatctggcccctggagctttccatgggcttcagcacttgcaggttttaaatctaacccagaattcactcctttccctggaaagcagacttttccattccctccctcagctgagggagcttgatttgtcatcaaacaacataagccaccttcccacatccttgggagagacttgggagaacctaactatacttgcggttcaacaaaaccagcttcagcagcttgatcgagcgctcctggaatccatgcccagtgtgaggcttttacttctcaaggacaacctctggaaatgcaattgccacttgctcggtcttaaactctggctggagaaatttgtctataaagggaaaggacctccttaggatccctcatgagctgtaccagccctgccctcttcctgctcctgatccagtgtcctcgcaggctcagtggcccggctctgcccacggtgtggtcctgaggcctcctgagaaccacaacgcgggggagcgagaactcttggagtgcgagctcaaacccaagccaaggccggccaacctgcgtcatgccattgccactgtcatcatcactggcgttgtgtgtgggattgtgtgtctcatgatgttggcagctgccatctatggctgcacctatgcggcaatcacagcccagtaccatgggggacccttggctcaaaccaatgatcctgggaaggtggaagaaaaagagcgatttgacagctcaccagcctgagagcttttgtctcaaataggattggtcattgcaggccagaagatagtgtctgagtagggctgatgtgtttcctgttagtctgattttgcttttgccaaaagacaaaaaaaaaaaaaaaaaaaaaaagaaaaaaaaaagatgtgtctgtaaaaaatatttctggggaggaatttatgttgcgatttttaaaatactataggtaaaataaagatgatacttgtg

SEQ ID NO: 97804 - DNA, 1414 bp, Homo sapiens
aagcctctgaaatgcaccatgtcggtgcccaggctcattctgctctgccttaagtgtccttcgttctctggaccacagccttcccaagaatgaggacctgttcttgctccctgctggacccctgcctccagcaagatgctgagtacacagacgacccataggtgaactgctcctgttttccagtgtgattgtcctgctccaggtggtatgcagctgcccggacaagtgttactgtcagtcatctacaaattttgtagactgcagccagcagggtctggccgaaatcccttcccatttacctcctcagactcgaacgctgcatttacaagataatcagatacaccatcttcctgcttttgcatttaggtcagtgccatggctcatgaccttaaacttgtccaacaattccctttcaaatctggcccctggagctttccatgggcttcagcacttgcaggttttaaatctaacccagaattcactcctttccctggaaagcagacttttccattccctccctcagctgagggagcttgatttgtcatcaaacaacataagccaccttcccacatccttgggagagacttgggagaacctaactatacttgcggttcaacaaaaccagcttcagcagcttgatcgagcgctcctggaatccatgcccagtgtgaggcttttacttctcaaggacaacctctggaaatgcaattgccacttgctcggtcttaaactctggctggagaaatttgtctataaagggggactaacagacggcatcatctgtgaatcaccagacacctggaagggaaaggacctccttaggatccctcatgagctgtaccagccctgccctcttcctgctcctgatccagtgtcctcgcaggctcagtggcccggctctgcccacggtgtggtcctgaggcctcctgagaaccacaacgcgggggagcgagaactcttggagtgcgagctcaaacccaagccaaggccggccaacctgcgtcatgccattgccactgtcatcatcactggcgttgtgtgtgggattgtgtgtctcatgatgttggcagctgccatctatggctgcacctatgcggcaatcacagcccagtaccatgggggacccttggctcaaaccaatgatcctgggaaggtggaagaaaaagagcgatttgacagctcaccagcctgagagcttttgtctcaaataggattggtcattgcaggccagaagatagtgtctgagtagggctgatgtgtttcctgttagtctgattttgcttttgccaaaagacaaaaaaaaaaaaaaaaaaaaaaagaaaaaaaaaagatgtgtctgtaaaaaatatttctggggaggaatttatgttgcgatttttaaaatactataggtaaaataaagatgatacttgtg

SEQ ID NO: 97805 - DNA, 711 bp, Homo sapiens
aggaggaaaagaaatgtcatctgctttctaatttaattcccttttttctactctttattatttttccttattatagaagaaatggttttccattaatacaaaattcagacatcatcaaaactataataaacatttgctgtgatcctacctgctaaagataaccatcattaagttcaatgcatagtcttcctttttcatatttatacatatgctaacatatattagaattattcatttacttttacaagaagaaggtcaggctggggacatggagggctcctacctgcgtaagcagaggtcttgcacctgcataagcagggccatgatcatgcctgtaatcccagtgctttgagaggccacggcagggagtctcttgagtccaggagttctagaccagcctgcacaacagggtgaaaccccatgtctacaaaaaatttaaacttagctgagtttaatggtatgtgcctgtggtcctagctacttaggaggctgaggcagggggacaccttgggcctaggaggtcaaggctacagtgagccatgatcatgctactgtactccagcctgggtgacagagcaagaccatgtcaaaaaaaaaaaaaagtcacaaataatgttgcaatttttctaccacttttaaaatcctttgaaacatttcttgtgttggtatatgtagatcttatctgactgtattcttgtaaatagatatata

SEQ ID NO: 97806 - DNA, 242 bp, Homo sapiens
taactgtccagaatattactgtttcttttacagtgtaaatgataccttaaaaaggttacatatggggctgtcagtcccgttaatgaagcttactgtcatgtgtctagtggaaaagcttaatcttaggttatcttccctgagcctgtggtaatatcaccaggaaatgtctaaacaagggagtctgggactgatacctggtaccaggtataactaaagcagctgacagtagagtctattctaac

SEQ ID NO: 97807 - DNA, 215 bp, Homo sapiens
gccccattatatcacatctatccaatattgcaggcagtaactactcaataaatatttaggggtaacttgaagagctgggtagcagcttatgctgaatagctgcaatatcagactatcatcaaccagtagcttgcatcaccaatcctcagaccccctgagtccgtgtgacaacttagcagctcagcagtttacctgataagccaggactatttagg

SEQ ID NO: 97808 - DNA, 274 bp, Homo sapiens
agtcagatgaggggtcatgaataaggtcatgggtcagataggaccaaagatggggaagtcaacagatgggacagttgagttgaatggccagctgaatgctaaagttgaggtcagaaaatcagatggggttgaaattgaggtcagaggtcaattgtgactatttttttttttttttttttgagacagggtctcactctgtcacctagactggaactgcagtggcgtgattttggctcactccaacctctgcctcccaggctccagcaatcctccc

SEQ ID NO: 97809 - DNA, 1217 bp, Homo sapiens
ggcggggccagacgcagccgagtatcttgaggagaaggactttaaagcgttcagggattttagctgccgctgtggagttccgccgctgttcttccgctggagggcgcagtagttccttaagagggaatggtgcggcgaatagctgtgagttcaaagtcctgactacagagttttgctcttgttgcccaggctggagtgcaatggcgcgatctcggctcaccgcaacctctgcttcccaggttcaagcgattctcctgcctcagcctcctgagtagctgggattacaggcatgtgccaccaagcccagacagaatccgttgccctatcacccaggcgtgtagtgccgtggtataatcttgggtcgccgaacctcgcgcctcctggggtgcaaagccattcgtcctgcttcagcctccgtgagtagcgtgtgactacaggcgtgcaccacagagctggctaatttgtcatgggtagtagagacggggtttcaccatattggccaggctggtcttgaactcctgacctcaagtgattcaccctgctgggtcttccagagtgcggggattacaggcatgagcgcactgtgccggaccataactctaactattttatcatcgaagaaatgcttgtatatgtatacataccatgtagattcagcagctgggataagagtcgtgtgagtgcgcttcacttaacaaattctggagtgcgtaggacaagggtgcaaattcgtccctggaggacgtcacctggggggaattgctagaccgcgtcgtagggatcaggacttagaacaatcctgctacttcctgaaaagctctccagacacatgcgattccaattaaacccggctgcaccgtggaaagacattccacgggagaggggggggccaggcaaacaacgcagcgtagaccaggcgcaccaggtggggcgactaaacacacgcggggcaggcactgggaacaaaaccttagccaccggggcaccaccttagcataatcaccccggggaagggaacacacacaagacgccaacacatcataaggtgggaaagaacaccaacacgcgctgtggggagaaaccacactgtgtggagccaccgcggctgttgagcccgcagtgacacacgacacactcgaacggccactgccgcggcgggccagacacgcacttccgagctgaaacgcaccacatggccagacccacagatccaacag

SEQ ID NO: 97810 - DNA, 259 bp, Homo sapiens
cttcatcctctgagggaaaagagaaggaggaaagacagctggtggtggagaaaagttaccagtttgaagatagtgggcaggaagttgaagggcttcctgcctaatggtctctagtttcgatttcttctgcaaagaaggaggcacatgctttgctgagagggcagaggactgaggtaaggggccttgaggatagggtgaaagtttgaaatagccactgtgggaaatgggagaaagaatttatcagggccagtaagagcta

SEQ ID NO: 97811 - DNA, 327 bp, Homo sapiens
ctagatataactacccttctctattcctcacctaaatccttatactgctgatgactttggaaaatagtacagggttttacagtctaatcatgacaatacatctccaggatccttgagccaaatacattcctcagaatactttttttaaaaaactgaaattgattacttgtactttgtcatcaccaaaaatatctgtagcaagacatactgttctcagcatccacttctaccatcctcactattgtaactcacagtagactatgcctcctactttactgaaaagatacaaaccattacctagcaatcattcttccaccttaaacatat

SEQ ID NO: 97812 - DNA, 859 bp, Homo sapiens
aggcggtctccgctcaacgatccttcctcaaagcatggttgctgagtacccagagttgcgaggagttttttaactgatttagccaggtggcaatcatgagtgaatggatgaagaaaggccccttagaatggcaagattacatttacaaagaggtccgagtgacagccagtgagaagaatgagtataaaggatgggttttaactacagacccagtctctgccaaggttctactgtcacccaggctggaatgcagtggcgagatctcggctctttgtaacctccacctcgcaggttcaagcgattctcctgccttagcctcccgagtagctgggactacaggcatttgccaccacgtctggctaatttttgtattttttgtggagacggggcttcgccatgttgcccagtattgtccttgtgaacttccttgaagatggcagcatgtctgtgaccggaattatgggacatgctgtgcagactgttgaaactatgaatgaaggggaccatagagtgagggagaagctgatgcatttgttcacgtctggagactgcaaagcatacagcccagaggatctggaagagagaaagaacagcctaaagaaatggcttgagaagaaccacatccccatcactgaacagggagacgctccaaggactctctgtgtggctggggtcctgactatagacccaccatatggtccagaaaattgcagcagctctaatgagattattctgtcgcgtgttcaggatcttattgaaggacatcttacagcttcccaatgagaggccaggaagtgtgaacatactgatagaaaaagactatattttatccctcataaaatgttttaaatgtaaatgt

SEQ ID NO: 97813 - DNA, 708 bp, Homo sapiens
aggcggtctccgctcaacgatccttcctcaaagcatggttgctgagtacccagagttgcgaggagttttttaactgatttagccaggtggcaatcatgagtgaatggatgaagaaaggccccttagaatggcaagattacatttacaaagaggtccgagtgacagccagtgagaagaatgagtataaaggatgggttttaactacagacccagtctctgccaatattgtccttgtgaacttccttgaagatggcagcatgtctgtgaccggaattatgggacatgctgtgcagactgttgaaactatgaatgaaggggaccatagagtgagggagaagctgatgcatttgttcacgtctggagactgcaaagcatacagcccagaggatctggaagagagaaagaacagcctaaagaaatggcttgagaagaaccacatccccatcactgaacagggagacgctccaaggactctctgtgtggctggggtcctgactatagacccaccatatggtccagaaaattgcagcagctctaatgagattattctgtcgcgtgttcaggatcttattgaaggacatcttacagcttcccaatgagaggccaggaagtgtgaacatactgatagaaaaagactatattttatccctcataaaatgttttaaatgtaaatgtgaaaaacagaagaaaaaagacaggacaccctga

SEQ ID NO: 97814 - DNA, 687 bp, Homo sapiens
ccgggagccttaaccctagagttgagagccaaggccttggagctggagaggaaactcacagaactcacccagctctacaagagcttgcagcagaaagtgaggtcaagggccagaggggtggggaaggatttaactgggacctgcgaaaccgaggcttactggaaggagttaagggagcatgtgtggatgtggctgtggcacatgactgtgtgtgtgtatgtgtgtgtgtgtataattctttgttgttttggtaaaatcagaggagtgggttataagtgctaatttccttgggaaattaatgaactagggcaagtatagcatcccatgcataaaattagcacagggacatcagaattgtatgggtcttcttttttctttttttcttttttttttgagatggagtctcgctctgttgccaggtttgagtgcagtggcgcaatctcagctcagtgcaacctccgcctcccaggttcaaccgattcccctgcctcagcctctcgagtagctgggactacaggtgcacgccaccactcccagctaattttttgtattttagtagagatggggtttcacctgtatgggtcttttcttgtgatggggttacacccccatttttgttaggcaagaaaagcatttggaaaaaaatgtaacatgttagattcaatataaaatattatggtaagatca

SEQ ID NO: 97815 - DNA, 1022 bp, Homo sapiens
  misc_feature (830)..(830): n is a, c, g, or t
  misc_feature (904)..(904): n is a, c, g, or t
aggcggtctccgctcaacgatccttcctcaaagcatggttgctgagtacccagagttgcgaggagttttttaactgatttagccaggtggcaatcatgagtgaatggatgaagaaaggccccttagaatggcaagattacatttacaaagaggtccgagtgacagccagtgagaagaatgagtataaaggatgggttttaactacagacccagtctctgccaatattgtccttgtgaacttccttgaagatggcagcatgtctgtgaccggaattatgggacatgctgtgcagactgttgaaactatgaatgaaggggaccatagagtgagggagaagctgatgcatttgttcacgtctggagactgcaaagcatacagcccagaggatctggaagagagaaagaacagcctaaagaaatggcttgagaagaaccacatccccatcactgaacagggagacgctccaaggactctctgtgtggctggggtcctgactatagacccaccatatggtccagaaaattgcagcagctctaatgagattattctgtcgcgtgttcaggatcttattgaaggacatcttacagcttcccaatgagaggccaggaagtgtgaacatactgatagaaaaagactatattttatccctcataaaatgttttaaatgtaaatgtacatgactgtgtgtgtgtatgtgtgtgtgtgtataattctttgttgttttggtaaaatcactttatcacaggttccaggacatggacacatcattttaggggctatcgttcaattcacctacacgtagtatgtgtcagacactacttagagctgngaatataattgtgactgtttctgctcccattgggttacatttgagtaaggagactgtgctcgtataaatagaanagttcagagagtgagaagtgctctcgaaggaaaaagataggttaatgggatagagagtggtagtggtgctgtcttggggatgttacctaatgagaccatgggggacatttctgagcat

SEQ ID NO: 97816 - DNA, 675 bp, Homo sapiens
aggcggtctccgctcaacgatccttcctcaaagcatggttgctgagtacccagagttgcgaggagttttttaactgatttagccaggtggcaatcatgagtgaatggatgaagaaaggccccttagaatggcaagattacatttacaaagaggtccgagtgacagccagtgagaagaatgagtataaaggatgggttttaactacagacccagtctctgccaatattgtccttgtgaacttccttgaagatggcagcatgtctgtgaccggaattatgggacatgctgtgcagactgttgaaactatgaatgaaggggaccatagagtgagggagaagctgatgcatttgttcacgtctggagactgcaaagcatacagcccagaggatctggaagagagaaagaacagcctaaagaaatggcttgagaagaaccacatccccatcactgaacagggagacgctccaaggactctctgtgtggctggggtcctgactatagacccaccatatggtccagaaaattgcagcagctctaatgagattattctgtcgcgtgttcaggatcttattgaaggacatcttacagcttcccaatgagaggccaggaagtgtgaacatactgatagaaaaagactatattttatccctcataaaatgttttaaatgtaaatgt

SEQ ID NO: 97817 - DNA, 1163 bp, Homo sapiens
aggcggtctccgctcaacgatccttcctcaaagcatggttgctgagtacccagagttgcgaggagttttttaactgatttagccaggtggcaatcatgagtgaatggatgaagaaaggccccttagaatggcaagattacatttacaaagaggtccgagtgacagccagtgagaagaatgagtataaaggatgggttttaactacagacccagtctctgccaatattgtccttgtgaacttccttgaagatggcagcatgtctgtgaccggaattatgggacatgctgtgcagactgttgaaactatgaatgaaggggaccatagagtgagggagaagctgatgcatttgttcacgtctggagactgcaaagcatacagcccagaggatctggaagagagaaagaacagcctaaagaaatggcttgagaagaaccacatccccatcactgaacagggagacgctccaaggactctctgtgtggctggggtcctgactatagacccaccatatggtccagaaaattgcagcagctctaatgagattattctgtcgcgtgttcaggatcttattgaaggacatcttacagcttcccaatgagaggccaggaagtgtgaacatactgatagaaaaagactatattttatccctcataaaatgttttaaatgtaaatgtacatgactgtgtgtgtgtatgtgtgtgtgtgtataattctttgttgttttggtaaaatcagaggagtgggttataagtgctaatttccttgggaaattaatgaactagggcaagtatagcatcccatgcataaaattagcacagggacatcagaattgtatgggtcttcttttttctttttttcttttttttttgagatggagtctcgctctgttgccaggtttgagtgcagtggcgcaatctcagctcagtgcaacctccgcctcccaggttcaaccgattcccctgcctcagcctctcgagtagctgggactacaggtgcacgccaccactcccagctaattttttgtattttagtagagatggggtttcacctgtatgggtcttttcttgtgatggggttacacccccatttttgttaggcaagaaaagcatttggaaaaaaatgtaacatgttagattcaatataaaatattatggtaagatca

SEQ ID NO: 97818 - DNA, 1562 bp, Homo sapiens
aggcggtctccgctcaacgatccttcctcaaagcatggttgctgagtacccagagttgcgaggagttttttaactgatttagccaggtggcaatcatgagtgaatggatgaagaaaggccccttagaatggcaagattacatttacaaagaggtccgagtgacagccagtgagaagaatgagtataaaggatgggttttaactacagacccagtctctgccaaggttctactgtcacccaggctggaatgcagtggcgagatctcggctctttgtaacctccacctcgcaggttcaagcgattctcctgccttagcctcccgagtagctgggactacaggcatttgccaccacgtctggctaatttttgtattttttgtggagacggggcttcgccatgttgcccaggttggtctcaaactcctgatctccaaggatctgcccaccttagcgtcacagagtgctggcattacaggctgagtcactgtacccggcctacatatgagaacttaactgcccggcctagttattgtttttttaactctaaaagttaagtctaccctgccttcttctttttttttttttttccacgacagagtcttgctcaggctggagtgcagtggcatgatctcggctcactgcaacctctgcctcccaggttcaagcaattctctgcctctgcctcccaagtagctgggattacaggtgactgccaccacacccagctaatatttgtatttttagtagggattgggtttcaccatcttggccagaggttggtcttgaactcctgacctcgtgatccacccgcctcggcctcccaaagtgctgggattacaggcgtgagccaccgcgcctggctaccctgccttcttttctaatacacatttaaggcattcataacttgtttaatcctttaactgtatcccacaatgattggctgtaggctgggcaaaaagtttacctatttaggatccttagtgaatgtttgttgaataaatggaagcattcattggtgacaggattaatttcaaacagagtagagtgtcatctattattttagtgacctacttgggttgatgatgcctctaaacttacttttcctccaaagtattgtccttgtgaacttccttgaagatggcagcatgtctgtgaccggaattatgggacatgctgtgcagactgttgaaactatgaatgaaggggaccatagagtgagggagaagctgatgcatttgttcacgtctggagactgcaaagcatacagcccagaggatctggaagagagaaagaacagcctaaagaaatggcttgagaagaaccacatccccatcactgaacagggagacgctccaaggactctctgtgtggctggggtcctgactatagacccaccatatggtccagaaaattgcagcagctctaatgagattattctgtcgcgtgttcaggatcttattgaaggacatcttacagcttcccaatgagaggccaggaagtgtgaacatactgatagaaaaagactatattttatccctcataaaatgttttaaatgtaaatgt

SEQ ID NO: 97819 - DNA, 252 bp, Homo sapiens
caggcgtgagccaccacacccagccaggtgtttggttttttatgctgttgaaaattggtgttaattcttgaagctgaatatatgcgttacctatgacacattggttctactccctagtttacatatccaacagaaatgaatatccactaggaaaggtatatacaggaatgtttatagcatcattattcataaataatctaatctatcagcaagagagtagatacattgtagtgtgtcatataatggaatatt

SEQ ID NO: 97820 - DNA, 180 bp, Homo sapiens
atcagctttattttaggacactctatactactcatgctaccattaccgtctatcattctttctctcatccatacccaagtctttttttttcttttgagatggagtctcactctgccgccccagctggagtgcagtggcggcatgatcttgactcaccgcaaccccttcacctcctgggtt

SEQ ID NO: 97821 - DNA, 563 bp, Homo sapiens
aaaattaggaaacgaaaatatatcttaaagactttaatcattttcaactaaaatattttggataatactgccttatatttaggcagtatatattaaagattttcacatgcatgattgtactgtcgatgaccctgctgtatactactgatctgattatgaagtggttggcagttatttatagtagttagactttttttaaattggtagattaatacctaaagcaatgccaaagttatcccaaccaaggatttcattaatttagtcattcagcagatatagatgactgcctgctatgtacagttacagaactggactttacaaatagaaattaacaaactcagcctatttttgcccagggaagctgatcgcattgatcataaaaacctcattcgtagtttgaaaaatattttgtcagattattttcagcacaacctgcacatctccttaaatttttttaatgaccagagttaccccttttaaatagaattcttcgtgtttattacataaaagtaaaattcatactgttgtcttgacacttagtttttattcattttgagatctaa

SEQ ID NO: 97822 - DNA, 301 bp, Homo sapiens
attacagtatactccttctacttattaaaaaaagttgaccataaaataactcaggcatgtccttgaggaggtgcttcagaagaaagtattattatcagaggatgacatttccatgcctgttattgcccctgaagatcttgcagtgggacaagatgtgaaagtggaggccgagtgcagtgactcatgcctgtcatgagtctgaccatgactcatgggaggccaaggtgggcagatcacctgaggtcaggagttcgagaccaacctggacaacaaggtgaaaccccgtctctactaaaaatac

SEQ ID NO: 97823 - DNA, 608 bp, Homo sapiens
tttgcttttgtttggagaggaagaggggtgctgatctaattttggtttttattcattcaacaaatttttgaggagatagaagaagatacattgcatttaacttcccctagaagggtattttttaaatccatttttggctccacgttgtagaaatcatttcgtaaacaaagaccctctttaaataccagagcttggcaattattctacacacacatgtgcagaattatcttttacagacacatactaaaatatttacagatgaaatgaaatgatgtctaagagttccttcaaagcaatagagtctggaaaacgagggtggtaatattgattaaacaaggatggctttgaacagctcatggctgaagtcgggtaacgagcatatgaagttcactatatattctgtctactattggttatgtttgagtttcccataataaaaagttttcaaagcagaatggaggggcattttgccattcttttagcaaaaggaaaggtgccaaccagagcaaatagttatttgagctccagtttttagttgagtgtgccaatgaagagttgagaagttgaagaccttcattaattcctttttccttcttaaatctacttgg

SEQ ID NO: 97824 - DNA, 508 bp, Homo sapiens
  misc_feature (1)..(1): n is a, c, g, or t
ngaatagcgtgcagctgacatctcttaatctaccaccgctacagtccttgaaatattccttcctgacaaaagaccgtttgtgttttgtgatggaatatgttaatgggggcgagaggagactggaatgtgaattgatggactgagtgagaaatattcacccacaatgtgagcagacaccatccaatcaactaagagcccaaataggacccaaaaaagcaaagaaaaggcactctcctggaatggggacactcctcttctcctgtccttggacatcagaactctaggctctctgacatttggactccaggctttataccagcaactccctagtttcccaccaaaacccaggttcctggcccttagcctcagactaagaattacaccatcagcttcccagggaacttggacggagatacgttaccagcatcccaaggtctccagcttccagatggcctgtcttgggaattttcaacctccataatcacatgagccaatttcccagtgaatt

SEQ ID NO: 97825 - DNA, 467 bp, Homo sapiens
atttaacttcttgatatctaccaaccaagtagttcatgatttgtaagagttcatttataacagggacttataacaatagtgtttaacctttacttttctattacttgggacatgttggtagtctggcaacatccataatgagaatcatgtttgggttttttgactttttaaaaagctcttaactgttttgttttgtttttcttggagacagtttcgctctgtcacccaggctagagtgcagtgacacgatctcagcgtgctgcaacctctgtctcccaggtttaagcaattcttatgcctcagcctaccgaatagctgggataacaggcgtgtgccaccacaccaggctaatttttgtatttttagtagagactgggtttccccacgttggccaggctggtatcaaactcctcacctcaagtgatctccctgccttggcctctccaagtgctgggagccactgcacg

SEQ ID NO: 97826 - DNA, 221 bp, Homo sapiens
cagttctgggatttatgactaccttctctattttcatgtgcacatacaggctgaagctatactctcaaatggatgcaggaattaaattcctgagatccttacaacaggaaaatttaaatatccttttttgagatcaccacaccaattaactttccaccgtgcttgctactctatagtcagcatcaacaatatccagttaaagaccaaggatgggcatggtg

SEQ ID NO: 97827 - DNA, 289 bp, Homo sapiens
gtcttattttgctgatctcttttattcaatcccttccttcatatcttgagttatacttttgcctctgaatttcatcatacatctaacacaataactaccaattatgaaaaacatgcttgacagcactctcatcacaagttccttgaaaagaccttatactatattacgaccccactttgcagttgagtaaattactctgtacaatcaagtaaatctcctacggcacacagctgtaggtggcacatgcaaagtttgtacctaaaaagtccacatacctttcattatacca

SEQ ID NO: 97828 - DNA, 350 bp, Homo sapiens
ataatttagcaaaagtttgttaagcagaagagggaacaaactagttctttgtagttccagaggatagaggtagaggtctaggtatctacaaggtttagagtgcacaaaacatgcctcttcctctctgggagaatttttatgccgtttataaaacaaaagcaattcttcccttacaggtaacacaaggaacacactgtttctttaccagaatgtaaaaaatttagaaggccagtggcctgattgtttttacttgatcttatcttaaagaattatgtgtgactaagcatttcaatgcaagaatgcattgactaggaagacagatttcgtcttattatgagaaagaactttta

SEQ ID NO: 97829 - DNA, 512 bp, Homo sapiens
gttggctttataaacaggactgaagaaaccagaagcaacaaagtgtgtactcattacatttagaagagaacactagaaaaataactgattagttaacatccggttactttaggctgcctttttttgtgctaaggattaaagccgagagaacttcatgatcataccagttgacaatttaatcctgcttatttgagaaattgactctctcttgatttctcaggaagtcagatgacaacttagttttgtcgatggctgttgtaaaacctcggttcttgtctccttagtttaaaagaaattaaacaagagacacacagcaaaggagatgcagcatggagcgatttgttgcaaaagaggcaggatattctgaaagtgacgtgcagaatagacagtacactctgagacaggattcagggcgggctgctcgtgaggatgggacagcattgacttactggggagactcccttgatgacagccttacacggttattcataaggaggcaggaagaggcgcta

SEQ ID NO: 97830 - DNA, 719 bp, Homo sapiens
gtttctcttttttcagagaagtcatcagtttgaaaacgtctatctcactttcttttctttaaaagtggctgggcacagtggctcacatctgtaatcccagtactttgggaggctgaggtgggaggattgcttgagccgagcccagaagttccagaccagcctgggtaacaaagggagaccccatctctacaaaaaataaaaaaaattagctgggtatagtgacatgcacttgtggttctagctactctggaggctgagattgggagggtcacttgagccccaggaggtcgaggctgcagtgagccgtgatcacgccactacactccagcttggatgatagagtgagactgtctcaaaaaataaaataaaataaaaatggctttttatcatatgaaagagcagtttatcttagtggttctcagccttttctccttactcctgcctatcagagggatccttacttccatccttgacagtggctcacttctacaagaattctcagctggggtagaaaggtaacatcttatcagaatctgtgcggttggacaggaggagacatgtagttgcagtcttcaaaactcattctgcctgttaaaacattcttatctttctaagactagtagtacttctgaactatgccctgccccaatttctgaattgatatggcttccctggaccacttaagattagaggaagggttgctaggacagtagaaggaa

SEQ ID NO: 97831 - DNA, 477 bp, Homo sapiens
aggccccaagctgcaccgaatacagccgcactgtctcctgttcctctgaaggatcatctatcttctacttaaaagcattagggaaaggcaaaagcctacctaagagctaacaacactctttggtcttggccacagaagcaagatactgaagggaacgccatcgtttgaaaagtgttgcagtaagacgcacacattgtgccaccactgtggctctaaggcctgccaccttcagaagtcatcctgtggcaaatgtggctaccctgctaagtgcaagaggaagtataactgaagtgccaaggcttaaagatgaaataataccaggactggtcgaatgaggcacctgaatattgtataccgcagattcaggcgtggattctgagaaggaacaacatctaaacccaagagggcagctgttgtagcatccagtttatcttaagaatttcaatgattagtcacacaataaatgttctgtttttt

SEQ ID NO: 97832 - DNA, 315 bp, Homo sapiens
tatgttgcccaggctggtctccaactcctgggctcaagcaatcctcctgccttggtcttccaaagtgttgagattacaggcatgagtcaccatgcccagcactgaattgtctttaataaagatacagaaggtgtggcacagtagcttgtgcctgctggttctttttatgtcccaactgtttgttctgataaattttaaatctgtaagtggtgaaataagaatacagtgaagtacattgatgtttatattatgcatttattagcatgtttgccaggagctattgtaataaacagccttgggttcaacaccagcttc

SEQ ID NO: 97833 - DNA, 807 bp, Homo sapiens
gggatgcgtggccaataaagggcaagaataaggcggattccgccttcctcgtggctgactggatgcatccgctggtactgatttacgaagagaatgatcatgaagggcaaatggcagtgaagcaagaagagctggcttcaggctcagaagagaatgctgtgcctcttcctcatggtttgcggtgccctgcatgttcagagaaacttctctaagtcttgctctgttgcccaggctggaatgcagtggtgtgatctcggctcaccacaacctctgtctcccaggttcaagcaattctcctgcctcagcctcctgagtagctgggattacaggctggactttggtggcacaatctcagctcactgcaacctccacctcaagttgtcctccccacttcagcctcctgagtaactgggactacaagcgtgcatcaccatgcccagctaggctaagttttgtattttttgtagacaaggttttgtcatgttgccaaggctggtttccaacttctgagctcaagcaatccacctgcctcagcctcccacagtgttgggattacagctgtgagccactgtgaccggctgggctatttcttttctatgcaataaaaattgtgtcatgaaatgacagggtccgcagttgcagtgcttgaagccattgttctaaaagagatataactccaaatcggaacactttggaatataagaatagctggagaagaagatacagataattatgaaaaagaatacagttgaacattcaactataaaatggtagggaaatagactatgttttgttcaacctcaaata

SEQ ID NO: 97834 - DNA, 232 bp, Homo sapiens
ctttgaggatcgtctatacaccctatacaccctataccaccatatcccacaagatcaacatgatcacacccggtggacacaggagaaacacgaagcccggacagcatcagggagtttaggagaaaggatcatggtctccagtctggggcagagttttcatccttaaggcagtaagagccgagagagctggtgtttctatccttgaaagggatgttgttggcggtggttcacg

SEQ ID NO: 97835 - DNA, 815 bp, Homo sapiens
ttttggacctgaaacagaaattctggaatacctatctgagtggactgatgtactggcccttgtacagctgaccaacttcagccttgttcctgttcaatggagaacagcttacgctggagtctgtggttttctctgggccaccttcatctgtttttcccagcagagtggtgacggcacattcaagtcagctttcaccattttatatacaaaggggaccagtgccacagaagggtacccgaagaaatgagaagtcaaggactctcttaaagggaccacattttttacctaaaatgcacagaattgcctgcagacaaaatatttgatgtgccaattatgcacttcattttgaggaattactactatttatagacccactttttaaaaaattatcaatgattatttttgaattgtattcagacttttttcctgttctagtctgaaatattacttctctaatattttggttaatatgaataatagtggcaaaatggcattttagaattattaatatttctaatattttaacacaagtttcaggaaacttggttttgattgttcacatttctattctaaaatctcaggttatctcctgaacacttttgggcagatgaagttttataccaaaaaatagttcttagagtgaattttaatttacatagaactcaatcgaaatgaagatttaataaccagatttctttctccaaaacatacacaatttgttattttagtaaatacctttttttttttttttttttttgggggggagtcttgctgtctccccggctggagcgcagtggcacgatcgcggctcactg

SEQ ID NO: 97836 - DNA, 609 bp, Homo sapiens
atggatgttgcggggtggggggggagggggggagggggggaggggggggttaggaaatatgacccaaaatccactcctcacttggacactgctctggttatgatggctgacaagaagatcctggtggttgctggcttgtcttcctctaataaggagcctgaatttagaaggtgatgatatgagaaaacaccaaatattcagaagccatccaggcctgctttggatgtcttttgggacaagagagcatgtgagggtatatccaggctgcaaatagcactgaagatgtcatctctgtggctgttctacgttctacttcactcccaaagaccatgaattacttcaaaatatgcctgatctgatttttttctaaagtactgggcagctgtgcaaacaatattaaaacagaaaaaatattttgtgccatgcactgccttgattgtacacgcccttaaaataggaaacatagactctttctaaaaaatacagttatatcaagacctgctttttaaatatccgtaatgtattattaccttttgtgtttctgttcagtaagtattacattcactgagagtgatttgaccaacaataaaaacaaagataccatcattt

SEQ ID NO: 97837 - DNA, 548 bp, Homo sapiens
atggatgttgcggggtggggggggagggggggagggggggaggggggggttaggaaatatgacccaaaatccactcctcacttggacactgctctggttatgatggctgacaagaagatcctggtggttgctggtagtagatctcctaatttaacttcttcctgctaactagtaaaatcaaccctatgtcaaaatcaagcccagacttgttcctccaccattcacaactgctctaaatgagttttatcccatgctgtgtggttagcaaagtcttcaataggacagccttcctgcctgtttgtcaatagctaataatttcttttgtttctctccaccctgccaccccataaactaagtatgggcctcatttaccttatttgtaattcacaacatagaactgacttcctcattataaaagtttccttactcgaaacaattcaaggactgggcagcattgctaatattacctcctctatggaagaaaatcagccaaataattaccaccaacagttgtgccagtaagcaaataaatgtcttgggagatgcta

SEQ ID NO: 97838 - DNA, 412 bp, Homo sapiens
tggagacagagtcttactctgttgcccaagctggtgtgcagtagcgcaatcttggctcactgcaacatccgcctcctgggtttaagcaaatctcctgcctcagcctcccgagtagctgggattataggtacccgccaccatgcctggataatttttgtatttttagtagagatggggtttcaccatgttggccaggctgatctcaaactcctgaccttaagtgatccacccgcctccgcctctcaaagtgctgggattacaggtgtgagccgccatgcccagccacatgctagttctcgacttggctggtgtttatattgacttcagcctgtgctaatttactgaagttacacccatttttataagcacagtgcaataaaaagctttaaatagtcactggaagaaaatatat

SEQ ID NO: 97839 - DNA, 459 bp, Homo sapiens
ttcagtttcttttttgtgaagccttccaggaatagtacaggcatatattagcacatatctatggttttaacatgcatggttacaccctgatttttttacttaattaagcacatcaatacatacttttaaccaattaccattttgtctatttaataaatacctatacagcactttctatatgctaggttctccttttttaaaatttaattttttatttggagataagtttagacatacacaagagttgcaaaaatagtacagtttggccaggcatggtggttcacacctgtaatcccagcactttgggaggccgaggcaggtggatcacgaggtcagtagttcgagaccagcctgaccaacatggtgaaaccctgtctctactaaaaatacaaaaattagccaggcatgctggcatgcgcctgtaatcccagctactcaggaggctgaggcaagagaatt

SEQ ID NO: 97840 - DNA, 526 bp, Homo sapiens
catgaggtagacatcttatttcattaaaaaacaatagatagccaattatcccaggctcgttaactttatccattggtatttggtggtacctctgtcgtgcacgatagtgatttgtgagagctaagtgttagcatctctctccaactctgcattcagtaaagtcatattggtaccttgaaagcaggcaagttttagtatttacacatggaaatcagcaggcaactacaaacaaggctgttttggctggggagctggcttgttcatgatgaacggcttttgcaaaaagaatctagattctagaatctagaatctagacgctagatttgaattgctaatattttggtagatttaacatagattgttgcatctatgttcgtgagtgagattaatctgaaattttttttcttgtaatacttttgcttggcttttgaatggaaattgtgctatcattgtaaattaactgggaattgctttctttctttctattctctggaaaaatttgattaaaattgaaattaactcttac

SEQ ID NO: 97841 - DNA, 781 bp, Homo sapiens
  misc_feature (733)..(733): n is a, c, g, or t
taggtttgcactcaagactgacatttaccgtaatggaagctgttcatatgcccccaggaaagaatgaacaatttaatagaaaatgctaaaggagtgatattaggaaaaaatcaataaatgttactgatgctatcgtcatcatcatcatcatcatcattatcatcatcatcaaggtcatgacagaaagaggacacattacatgaaatctcaacttcatccctgggccatacacacctgtagctaatttttgtatctttctatttgagttcgggtttcgcatcgttttgtcccacacaacagaagctgatctccaaagagaggaatgatgtagcctcaagtaacaaagacattgagggaagtctttcacatcctgggatgcctgtggcccagcacagagggctgttgggttgccaacacagagtttacccctcaggtgtctgtaattgggtaaagagaggtgaagtttagcatgtgatatgtagaacgggcagctacaaatacaattctaaaacaagaaaaaaaaaaaagaaaatggcctattttggcctcatacgtggaacctctgaagccccttccctatacggaggattcatactgatgcctccctcactgactccatcgactcgcacccatgtatttgtcacccgccccacccacaccacaggacactaacacctcaaccacataaaatatagcgacaccgaaaacaaagcacatagccctcgcgcccgtntaagacccccactctaccacagacacccacactaagtcgccgattgtt

SEQ ID NO: 97842 - DNA, 820 bp, Homo sapiens
  misc_feature (56)..(56): n is a, c, g, or t
  misc_feature (772)..(772): n is a, c, g, or t
tttagtcaactagaagttgcaccaaatcaacaaaaaaaagtttaggtaacctcaanatgctatttaccgtaatggaagctgttcatatgcccccaggaaagaatgaacaatttaatagaaaatgctaaaggagtgatattaggaaaaaatcaataaatgttactgatgctatcgtcatcatcatcatcatcatcattatcatcatcatcaaggtcatgacagaaagaggacacattacatgaaatctcaacttcatccctgggccatacacacctgtagctaatttttgtatctttctatttgagttcgggtttcgcatcgttttgtcccacacaacagaagctgatctccaaagagaggaatgatgtagcctcaagtaacaaagacattgagggaagtctttcacatcctgggatgcctgtggcccagcacagagggctgttgggttgccaacacagagtttacccctcaggtgtctgtaattgggtaaagagaggtgaagtttagcatgtgatatgtagaacgggcagctacaaatacaattctaaaacaagaaaaaaaaaaaagaaaatggcctattttggcctcatacgtggaacctctgaagccccttccctatacggaggattcatactgatgcctccctcactgactccatcgactcgcacccatgtatttgtcacccgccccacccacaccacaggacactaacacctcaaccacataaaatatagcgacaccgaaaacaaagcacatagccctcgcgcccgtntaagacccccactctaccacagacacccacactaagtcgccgattgtt

SEQ ID NO: 97843 - DNA, 694 bp, Homo sapiens
cggcacgagggtgcaactttatttcttcagttattgagtagtttatacaaggcatgggatggggaaaggggcatttttttaacttaaagataaagcagatctttaaaaattatgtggattaatgaatcactttttgcctttttcttgctgtgtacagtcatccctttgtatcagtggataccacagatgttcaaattccttatgtaaaatattgtagtatttgcatataacctaaccacatcctctcatatacttgtatgtgtagattatttataatacctaatacaatgcctgcacgtcacttcattcacataaattgaacatagtactcagcacgtggcaaattcaagttttactcttcaggactttgtggaatttttttttttcctcaaatatgtttgatctgtggttggttgggttcagggacgcagaacccatgtatgcacaggaccgactacacttttgttaaagactaaaagagattctggtgttaaaaaaaaaaaaaacactatagcataatgagtagaggtatcagaaaagaaatcgtcatagaaaatttaataataagttgaaatttcaaactatgaagtcagaaacagatctaggtttaaatcctaactgctagctaacagtatagtaccttgagtaaattatccttcttttgatgccttaatttcccatctctcaggtgggg

SEQ ID NO: 97844 - DNA, 493 bp, Homo sapiens
cggcacgagggtgcaactttatttcttcagttattgagtagtttatacaaggcatgggatggggaaaggggcatttttttaacttaaagataaagcagatctttaaaaattatgtggattaatgaatcactttttgcctttttcttgctgtgtacagtcatccctttgtatcagtggataccacagatgttcaaattccttatgtaaaatattgtagtatttgcatataacctaaccacatcctctcatatacttgtatgtgtagattatttataatacctaatacaatgcctgcacgtcacttcattcacataaattgaacatagtactcagcacgtggcaaattcaagttttactcttcaggactttgtggaatttttttttttcctcaaatatgtttgatctgtggttggttgggttcagggacgcagaacccatgtatgcacaggaccgactacacttttgttaaagactaaaagagattctggtgtta

SEQ ID NO: 97845 - DNA, 510 bp, Homo sapiens
tctgcttttgtcaggaggtagcccggcaggactgacaataaatcagcttgcctgaacttgggtctgctggcctcactcctttctcggctgtccttccaattataccttatgtcttggtgccgaaaccgggaaggtggtacagttcggcctcttttctccctttatcctccccctgctccttcccctggccgaactcccccttccagaacctgctagagacccaaggatctcatacatcttttccattgctggcgaacacatccaacaccagggacacctcaggagaaagaaaaacaaaacaaaacaaagtgtggcttgcagctcagtcgcatgccaacgatcttcatcggcaagaccctactaagcccctaggggccgctgcagttccccgagaagaccttcctgggagtaccaacccacataacctggccaggcatctcataaccatgtgattacttgcctcatcacaggccttaacaaagcagcccataaggccataatttttgaaaa

SEQ ID NO: 97846 - DNA, 490 bp, Homo sapiens
ttcttgagatctgtccaagttgttgtgtgtgtcagtagttaattctttttttattactgagtagtattacatgatagggctgtacctcagtttgttaactgtatacccactgaagggcatttggattgttctcaggttttggctattacaaataaagctgctatgaagatttgtgtgtaagcttttgtgtggacataagttttatttttctgagatttatggcctagagtatgctgggtcatacggtaagtacatgtttagatttttaagaaacggccatattcttttcacatggctccttactacttgtaaaactctctgtacttagaatatctacctgtgtatttcagatgtgcagatagatgtgatttcaacaactagactgtaaactccatgagggtggggacagtaactggttcatttttatatccttcacagttcacaggaaactataatattgtttatggcagttgttctataaagatttatt

SEQ ID NO: 97847 - DNA, 181 bp, Homo sapiens
gaaccctatcgtatggtgctttagttttgaatcttgacgtacatttccccctacttccccaccattatccaagccttttcctcgcaataaactagatgtttatgaagatgcatgaaccactcctgcccattagaccagcaccacatggttcacagaggcactatatgacatcaccgctata

SEQ ID NO: 97848 - DNA, 131 bp, Homo sapiens
catctagtctgtggtattttgttatggcagcccaagaagactaataattacaacacccagaccaattaaatcacaatcactcagagtgggacacagacgacagtagatgccggaaacaagggagaaccgaa

SEQ ID NO: 97849 - DNA, 661 bp, Homo sapiens
ggaaggggctggacacccgctcatggccacagagggcagcttccgggcgacgctccagctctgcctctcggactcctcacggacacaggcgtgtgtttgaaacggatcgatgtccccccggttcctttcacagacaccagaaagcccgcgaacacacctcacaggctccgaagtctcactctgatcttggctcactgcaacctctgcctcctgagttcaactgattctcctgcctcagcctcaccagtagctgggattacagatgcccatcaccatgcccggctaattttgtatttttaatagagacagggttttgccatgttggccaggctggtctcgaactcctgacctcaagcgatccacctgcctcggcctctgggattacagatgtgagccatcgcacctgtgcgtgaaggttttctaaccttctatcagattttctaacctccccaagccacaggatgagaaaagtgtgcgatgctcccgcctgaggaagccagcccagccaacgcagagccaaggaccactgaaggcattgccactgctacacgcttggagccatccatgcctgcagccgcgttgaatgccttctgcttctttcctatgccagcttgaactgggttacttttgcttacaaatgaagtactctaactcaggaaat

SEQ ID NO: 97850 - DNA, 287 bp, Homo sapiens
tttatttgggtgaatgtaccttttcaaaatcaagatattctggggtttttaaaaaataaaaagtatgaaaatatcccaaaacagaaaagagtactgaggataaccatataaaaacaatttaagctgagaaaaataacccagtcctgtcgagtcctaaagagaaccttggtttccatgggacgttagcaaagtgcagagctcctagcagtgggtaggatggaatgtttgcagcctttccaaataagcaaatatcccccagaatccagcatccgtgccccacatgctgt

SEQ ID NO: 97851 - DNA, 505 bp, Homo sapiens
cttgataattggctgaataaagtgaacccacataaagtgtcacccgcctcttcagtggacagtaacatcccatcatctcaaggctacaaaaaggaaggccgagagcagggcactgggaatagctacactgatacaagtggacctaaagaaacgagttccgctactccgggacgagactccaaaaccatccaaaagggatcagaaagtgggcgtgggaggcagaaatctcctgcacagagtgacagcacaacacagagaagaactgtaggcaaaaaacaacccaaaaaggctgagaaggcagctgctgaagagcctcgtggaggcctgaagatagaaagtgaaacccctgtagacttggctagcagcatgccctccagcagacacaaagcagccaccaaaggctcaaggaaacccaatataaagaaggagtctaagtcttcccctcgacctacagcagagaaaaagaaatataagtcaacaagtaaatcttcccagaaatcaaggg

SEQ ID NO: 97852 - DNA, 505 bp, Homo sapiens
agcggtgctcgcgctccaaggcccggtggggggaggggcgctcacgcaaccgccactgtctggagcgggctcgcctctgcggcagccctcaccgcccgggctttactgaagcggagtctagcatgtgcggctgctccacagcggtgtgggtggcggcggctcctctgcagcagcctcggcagtaggggtcagggtggccaagcccaccgtggagctcatctgagagttgtaaggtacgggactgcctcggtctttgggacgccccgtctggtagcatcccagatccagcacgttccttccggccctgcaccccggcccggtgcctcacaccccgctaccccaagcatccagactctaaggcagcccctgcatctcagtcctgacatcgctgtccctggagcatcctccgctggagctggagcttgacagcttacagagtcaagtccctgggaacttcaggaagcagcccaccatgtttcaaccacttactatgtgccatttcctg

SEQ ID NO: 97853 - DNA, 529 bp, Homo sapiens
actgaaattctcttaaacattttcaactgcatttatacacgtagaatctaattttattttttagcatttcagttgtctgccttatcaagtattaatatttaaataattctcatagatatattaaatgtcttcatttcttttaaacttttaagttctctttgctccaattataatcacaaacttcggaaaatgttatacctttcaacttacagtcgctatcaaaaatcaaatacttagggcagggtgtgatggctcatgcctgtaatctcaacactttgggaggtcgaggtgagcagataacttgagcccggggcttcaagacaagactgggcaacatggcgaaagccagtgtctacaaaaaaaaaatacaaaaaaattagccaggcatggtggcacacacctgtggtcccagctactcaggaggccaaggtgggttgatcatctaaacctggggaggtcgaggctgcagtgagtgagtcatgattgtgccactgcactccagcctggctgacagagtgacacctcgtct

SEQ ID NO: 97854 - DNA, 799 bp, Homo sapiens
aaatgtgtaacttttgcattccataatgactatagtctgatgattttatattcttggggtttcacattaacagctgtttaatctgaatgtttgtttcagtatgtttcagaagtcagaatttgtttataatcttagaaagttaattcaggacctgtactgtatgtaatacaacatccccagcaggatcaagctatcatattcatatttctgcaataaaacatagagatatttcctctatatgagatcaaaaaagactatgagtaacttcccatcagtttggaagttagttatcagttaataaagtttggattaatacaagtttttggttttcagaacttttgaattttagaattgtagataaagaattgaggactaaatatgggccaattatttcatattgtattttgggttgagttctacaaagcctcttcaaatgagctatttaaattaaggatatattctttgaacatcaaaagttaaatataaggaagcagtatatttttaaaggattttacatatatgtgtttctgatgaatgtattaactgcattcagttaaagtaagtgaaaataagagtaatctgcagctctgtttaatatatttgagtctttaccttaattttttctttttctaaaattaattgaattcaaaatatctggaaattcctgcaagttgtttttttgaactgtactccagcctgggcaacagcgagactccatctcaaaaaaaaaaggaaactgtgtatcaagaacatgattatccaggggtatttctaattcagatcatcaaatgattatatg

SEQ ID NO: 97855 - DNA, 1544 bp, Homo sapiens
  misc_feature (484)..(484): n is a, c, g, or t
aatttcttaattttttggtggagatgaggtctcgtcatgttgctcaggccgctcttaaactcctggctttaagccattctcccaccttgccctcccaaagtgcaaagatgcatttttaaacttgctatgtctctaaggcatttctggtggctgtctgcttgaattcaccagggtagtgatgatagatttttttttttttttttaaatataaggactgggtctcactatgttgccccagctggtctcaaactcctggcctcaagcgatcctcctgcctccacctcccaaattgctgggattataggagtggcctaccatgcccaacgtgtttttttgtttgtttgttttgtttttttaaaggctgtgtgttacttagtttcttaagtgttttgtttgggttttattccacaggaaggttgaggaccttcagttccgggttgaagaagaatcaattaccaaaggtgatcttgagcaaaagagccanatttctgaagatcctgagaatacgcagaccaaactggagcatgcccgcattaaggagcttgaacagagcctgctctttgaaaagaccaaagctgacaaactccagagggagttagaagacactagggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggtaaaggagctagaggtactgcaagccaaatgcaatgaacaaaccaaggttattgataattttacatcacagctcaggctactgaagaaaagctcttggatcttgatgcacttcggaaagccagttccgaaggtaaatcggaaatgaagaaacttagacagcagcttgaggcagctgagaaacagattaaacatttagagattgaaaagaatgctga

SEQ ID NO: 97856 - DNA, 142 bp, Homo sapiens
gaaggttgaggaccttcagttccgggttgaagaagaatcaattaccaaaggtgatcttgaggtaaaacccctccagctctcttacagcttttatgggtatcagtattcagaacacgggcgaaataatgcaccaattgaaatg

SEQ ID NO: 97857 - DNA, 203 bp, Homo sapiens
tcggcactcgctattcatcggcacctcgcttattcatcgcaccccgacattcttgccttccccagcatgtcctggaattggaagccaaaatggaccagctgcgaacaatggtggaagctgctgacagggagaaggtggagcttctcaaccagcttgaagaggagaaaaggtgaccccagactgtttcctggtgcaagtgtggc

SEQ ID NO: 97858 - DNA, 1164 bp, Homo sapiens
tcggcactcgctattcatcggcacctcgcttattcatcgcaccccgacattcttgccttccccagcatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgaggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggtaaaggagctagaggtactgcaagccaaatgcaatgaacaaaccaaggttattgataattttacatcacagctcaggctactgaagaaaagctcttggatcttgatgcacttcggaaagccagttccgaaggtaaatcggaaatgaagaaacttagacagcagcttgaggcagctgagaaacagattaaacatttagagattgaaaagaatgctga

SEQ ID NO: 97859 - DNA, 586 bp, Homo sapiens
aacaatctatctggtcagatacttagtacctagatgtggagaccatatctcacagttctgtcaggcaggagcagtccaaacactttgattatcagctgtctcttgctcgggaaattactaggtaccaacactgttatatatgcagaggtgtctgaaaaatgaatgcagatcaatttccagttccacacagagcacatctgtaaaatatgacctttggataatggctggagtgtttacctgcagtattcgtttttgcatgtggctttccctagatatgtcaggatacagcaggaccaaaacctagcctttgtcctatgtctggagacttcttggaagctggagcacacaaatagctacagcaaacttgaggaatgggcatgaatagactggcttcggggaacctgccagcttggccgtgtggccaaggtaataggcaagccaaggcagagctagagctcagagctggaggggaaattaaagcagcaaatgtagaaacattaagcctgaagaggcgacgacgttgaattctaaaatgcaggccaaagctcagactgcaagctgtctggctgctccgggtgtgcccaga

SEQ ID NO: 97860 - DNA, 3123 bp, Homo sapiens
ggtgaattaatctcagaaactgacctataaaataatgactcattatagattgggtgaacttctcattttatttagcttttaaaagtgctaaatcctctcataaaggaaaaattataggaaactatagcggtatccagattctgatgagctttaaaaattataaaatatagcaaatgtcttcatattttagccagaaatattagtacacaaccaatatagaagtcttgtttgtttctgggttctccagcagagactttttgtttgtggcttactctgtatagcctcatgtgccttaaaggtggtgaactctagtttttgtcaatatcaggcttttcaaaactcaaaaacaatccaaatgttgtaatttgttttgcataatgcccatggaattggatatcagtaagcaaagccattaaatcgaaccaatcaatgctaatagagtataaaaacaaaaaccttcaaattttaagtttcatttgtgtaactttattttcggcctagctagatcattgaagagccttgaaagttatctaaagtatggcttaatgtatttttttccctctgaaaaagatcatatgccaggatacttcttcaaaccagatcacttttaatatctagaaagataattttcaaggtataggcaaaagcacttcaaggacagagattatgtagcaagttgattctctaggaattctttgaactcatttgtgtaatagctggaacacactcctcttctttcctttaacaaatgaacttttagcacttctgtcttcaaggaaaaacatttgtttggaattggtggagggtactcgcagtccgtttatagtttgggacaattaataggaaaatccccagttgcattcaaataatagtgttgatgttgagggcactgactcattcagcatgtctgaactagaagtaaatttaattctgaaaggactgttagttaggaaataagtatttgtatacatatgtactgtggtaactttggattcattttaagtctgataaagtaagataaactttgtcttaaaaataaaattatgctaagtgaataaaaactgagatattttaagctaggcatctttgttagcatagtatccggaacataactacttataatgcttaggtcttatttctttggaaaataagttacttattccagaagccttagaaggaattctgaaaattcttctaactggccattaagagtaaggaagttgaatggtactgctgaagatctgagttgactcactgaaattttattttcttatttttttaacattaaaattatttctttttggctctccctctagttattttttaaattaaggtaattactgttttaacctagagcatataatggcaaattaaattttaatttgacactcataccgaactcagaaaagcttgtttgatcttctctaaattctgtatgtagtactttttttaattgtcacatttctttgttacatctttgtgtccaacaaaacctgtggaaatctgtgttcatttttgtggtgagggatgggggtgaaaaaggggagacttgctctaattatgcatatacatttgactatgtaaaggtagttgtagactatatgtataaataacaagttaacacttaatattctaaattgttctaaggaacagtggcctgaagccatgactagttttgtggagctgctggctcttttaacagtagctgacctattggatttaaactgagactgaaattgacatttgtggttaggttatctagctgaggcttttaacaatggagcagataatgtctgttcctgtagtggatccatttaatttcctatttgagtactctcacttaacaagtattatctattctgaacctttgtgttgggaatttaaggactattgtcaaaggctattaatggtaaacaagtatatgcaaaacaattcacatatgggtaaaaatttcaaattgtgggtttttgtttttgctttttagtttcaaagattagttatgtagcagcaatatcataaccaaagcaagtaggaagttgactggtttggagaatcttcaagtagttttaaatactgtaatgtatcagattgttaaccaggatttttttttcctgtattactgctaaatatattactatattaatgcacttttgtatatataactgtcttctgtacattctgtacttactacagtgtatataaagcctgttttccctgaagctgtgagggaataacaatagttgtatcataagtcgtttctattttgagttccttcttgtacttgaaagtagttcagtagtgaaatctaaatgagtgtgtatggttgtaattaaaactggcaatgtggcagagctgtcttttgaaactgaataccagaatgaaaagtgttgttttggttaagaactcttataatatattatttcttttgatgtaccctgagttgttacacagcccactcactgctgcttactactttatacttctgagtcagctcctttcatgctctatcccagaatatttaccaacagaggagaactgctcccttttctgtttctcacagtttggttatggctttataaacttttatttggtgaaagccccagatacccaaatgtcattggcaaaacttatttttttttctggacagatcagatttctagagagagcagatttctagagagattagcattcatagtaagtgaaaattgtctaatttttttaatccatgctattactgggcagtaggtctaattttttttgacaaaaaatagatctattttccttatatattgatttagaatcttaagttagaattttatagaagaaatgtctgagcagttctatgtatggaggagcaattcagcttttcagcagcaactttatcttttgccactagagggagatctgtggttgctttctcctttggagaatagctgctttgcttttatttttaatttctaaggttggaatagaacttattctcaaaattcctttagtgttattaaatattttcatttattagtcaaaggtaagttaattaagcttgtttaatgatgccaatcttatgcttttctgtaatcttcaatttttaataaatgtgagttagatactaaaaaaaaaaaa

SEQ ID NO: 97861 - DNA, 1715 bp, Homo sapiens
cggtcctggtaccgcccggagttaggatatcgtcgacccacggcgctccgacatttctttgttacatctttgtgtccaacaaaacctgtggaaatctgtgttcatttttgtggtgagggatgggggtgaaaaaggggagacttgctctaattatgcatatacatttgactatgtaaaggtagttgtagactatatgtataaataacaagttaacacttaatattctaaattgttctaaggaacagtggcctgaagccatgactagttttgtggagctgctggctcttttaacagtagctgacctattggatttaaactgagactgaaattgacatttgtggttaggttatctagctgaggcttttaacaatggagcagataatgtctgttcctgtagtggatccatttaatttcctatttgagtactctcacttaacaagtattatctattctgaacctttgtgttgggaatttaaggactattgtcaaaggctattaatggtaaacaagtatatgcaaaacaattcacatatgggtaaaaatttcaaattgtgggtttttgtttttgctttttagtttcaaagattagttatgtagcagcaatatcataaccaaagcaagtaggaagttgactggtttggagaatcttcaagtagttttaaatactgtaatgtatcagattgttaaccaggatttttttttcctgtattactgctaaatatattactatattaatgcacttttgtatatataactgtcttctgtacattctgtacttactacagtgtatataaagcctgttttccctgaagctgtgagggaataacaatagttgtatcataagtcgtttctattttgagttccttcttgtacttgaaagtagttcagtagtgaaatctaaatgagtgtgtatggttgtaattaaaactggcaatgtggcagagctgtcttttgaaactgaataccagaatgaaaagtgttgttttggttaagaactcttataatatattatttcttttgatgtaccctgagttgttacacagcccactcactgctgcttactactttatacttctgagtcagctcctttcatgctctatcccagaatatttaccaacagaggagaactgctcccttttctgtttctcacagtttggttatggctttataaacttttatttggtgaaagccccagatacccaaatgtcattggcaaaacttatttttttttctggacagatcagatttctagagagagcagatttctagagagattagcattcatagtaagtgaaaattgtctaatttttttaatccatgctattactgggcagtaggtctaattttttttgacaaaaaatagatctattttccttatatattgatttagaatcttaagttagaattttatagaagaaatgtctgagcagttctatgtatggaggagcaattcagcttttcagcagcaactttatcttttgccactagagggagatctgtggttgctttctcctttggagaatagctgctttgcttttatttttaatttctaaggttggaatagaacttattctcaaaattcctttagtgttattaaatattttcatttattagtcaaaggtaagttaattaagcttgtttaatgatgccaatcttatgcttttctgtaatcttcaatttttaataaatgtgagttagatactaaaaaaaaaaaa

SEQ ID NO: 97862 - DNA, 586 bp, Homo sapiens
tgtgaccttggaatagccaacaatttcttggatatgacaccaaaagcacaccaatgaaacagtaagtaaaagagataaattgcacttcaccaaaattaaaaatatgtatgcttcaaagcaaatcatcaagtaaaaagacaatgcacggaatgggagaaaatatttgcaaattctggtaagggtctagtatttagagtatacgaagaactcttacaattcaacaataaaaagacaaataaccaaactaaaagttgggcaaacaattgatagacatttttccaaagatatacacttggataaacatctaaacctgagcttttaacactaaaaagcacatgaaaagatgttcaacgtcattagtcatcagggaaatgcaaatcaaaaccacaatgagataccactttacacccactaggatgactataatcaaaaagacataataacaagtgttggtgaggatgtagagaaactggaaccctcaagcattgctaaagcgattgtaaagtggtgcagccattttgaaatacaacctggcgttcttcaaaaggttaatatagagtcactataccacccagcaattccaatc

SEQ ID NO: 97863 - DNA, 477 bp, Homo sapiens
tgagatcacgccactgaactccagcctgggtgacagagcaagattccatctccaaaacaaaaaattctaacgctgtagttaacacaaactaaggcagcaaagcaggagaaaaggagacagaaaaaaaaaaaaagctaaactaaccaagatattttgtactctgtggcaagcaacgtagtaagcatgaagtaactatgtaaacatcatcaaatgagtactggctaggacattgttttgtaaatgctagaagtttgagaaccacactcaaagtatgcataaacatgggtccaaaaacaccaaaatacaaatctatgtgattctcccatctatccttcaaatctgagctcaagaattaccacttctataagtttctctcatacagagttaatcaagccttcttctttaactctttatcttgtatcacaccataccacacagtaaattatttaatgtctgtctatcctccaagaatatgag

SEQ ID NO: 97864 - DNA, 107 bp, Homo sapiens
gtgctgggattacaggcatgagccactgcgcctggcccatgggagccctttttgattaaggacacctgaccatccatccattagggcatcagaatgcctgctgattt

SEQ ID NO: 97865 - DNA, 393 bp, Homo sapiens
tggcaattatatgcctcagaaaaggtaacaattcactgcttcttaagactatggtagtttatggccaggcgcagcagctcacgcctgtaatcccaacacttaggaaggccaaggcgggcagattgcttgagcccaggagttcaagaccagactgggcagcatggtgaaatctagtctctaccaataacaaccaaacacgcaaaaaatccaaaaaacaaaactgataattttgagggttttttttttttgagcattgatttagaggtgaagtagagaaaccaatttgttttcttttttcttttttttttttgagacacggtctagctgtgtcactcaggctggagtgcagtggtgcagtctcggctcactgcaacctctggctcctgggttcag

SEQ ID NO: 97866 - DNA, 838 bp, Homo sapiens
agcggtggcaacctgttagggtctgcttttgtcctgtgggagctttccttgtttggttttcgtagtaaatcttactgctgctcagtgtttgtgtctgtgctgcgtttgtgagctgcaacgctcacggtaaaggtctacagcttcactcccgaagccagcgagactgtaaatccactgggaggggcaaagaactctggacgtgctgcatttttaggagctgtgacactcaccgcggaggtttgcagtttcactcctgaaatcagtgtagaccacgaacgcaccagaaggaacaaactccagacacaccgtttttaggtaaccgtaacatgtaccgcgagggtctgcggcttcattcttgaagacgagactaagaacccaccaacttctggacacaaaaccaccccaaaaagtgagtttctaaaggaggagctaaaaataaagaccacgaaagtgttgcccatggtgatagctccagacgtccggagacggtgttcagcgctgctgcaggagagactttatcttctattccgttggtctgcctatctagaaagcaaaatttcaaatactgagaccgatagatgaagatgctttcgcttcttccctgtttcatccagttggggactaagtgtccttcggtttggactgtgcagctcgggtcaccttctctgtggaacagcaagtgaagaaagaggcgcagagccctgtgttccaaaccctggagacaattgagaaagtgggaacccattattccccaagcccagccagcaaacctcaccgatgaaacagataagcacttcctgcaggtggggccgacactggccaggacacagccctctct

SEQ ID NO: 97867 - DNA, 526 bp, Homo sapiens
cacagtgtccctcgaacatgcggggatggccggccaaatcacccagcctgctttcacgagcgaccgctgagctgtgttgcggcagtccctcccagggccgctgggccaggcccagctgcggggtagaggagaggatggggagaggggcctgagatggggcagggaagtctgtgagctcagcccgggacctggggccaagcaccaggaggccagggggagtctccaggggctggggctggagccgcatcagagaggaaaggggtgtttgaaaaaggggcagggcctgggacccaggaaactgttcttccagagacacccgtgaagctgagctttgcctctcagggaagctgtgaccccacgggtgctgcccagagagatcgggccaggtggagccaagatggactggaattccccgacggggacaaggggccggacgaggctgacttgccctgtctgatgaatggtcaggtttgctttttctcctgaaaacacgaggcagtgatcccggccagctaattccagcaga

SEQ ID NO: 97868 - DNA, 581 bp, Homo sapiens
acatctctttcgtgagaagaaagagaggagggaagatgctctgtgatgctgccagtaatgctgaccagtcgtggtgctgtcacctccttggctgtctttgcaatctgttcccaactgaggtttccattgcagtgtaactgaccactccaggggccactgagggctgtcaggatgagctatccctccaccccaggctgtcactgccagcaagaagttgcagctgaaggatgtggtccatgagagatcccagggcatggaccagaggcagaaagaggatcttgtcagtaacctcaaaaactcggattaggtcctgaatttacatctctggtctttggtttaggtttgtaattaaaagatgaaagcacttggcttccttgcataagcgactttggttttgccatggctgtctacctgtgttggccaacatggcagccccgagtcacatgaggctcctgagcatagggaaccaggctcatctgaagcgagatgcactgcaagagtgaagtacccgctgcatctgggggacttaatgcatgcaaaagaacatgaaatacctcatccatatttttggtattgatgac

SEQ ID NO: 97869 - DNA, 690 bp, Homo sapiens
agacgggatggctccttgaccccgtgtccaggcgtcgatgataccctgctactgctggttggaatagtggggaaacatgactttttatatgacctaggacaataagagatttctaacctcctatttggcctcaacagagacaacactaaagatttcctgaagccaagctgatgacaggaaaataaaaaaatctcattagattataccaacacctgtcacagggaatcaaacccactcagcctatgattctcttcattcataacctaggaaccataactcagttttctacttcacaattccttcattctagttcattcaagttctaaacaaactgaccatctgcctttggtgagagaggaatcaacaactagtttgcaactaccactccccaaaaaagttttgttttttaaaaattctttcaaacttccataaatttccaagtggaataaaaattggccagacgcagtgactcacgcatgtaatcccaacacgttgggtggccaaggcggcagatcgcctgaggtcaggagcttgagaccaggctggccaacatggtgaaaccccgtctctactaaaaataccaaaattagcctggcatggtggcacgtgcctgtaatcccagctactcgggaggctgaggcaggagaatcgcttgaacctgggaggcagaggttgtagtgagcagagatc

SEQ ID NO: 97870 - DNA, 383 bp, Homo sapiens
ctctagaggatctgcaatggctgcgtgaccatctgcctttggtgagagaggaatcaacaactagtttgcaactaccactccccaaaaaagttttgttttttaaaaattctttcaaacttccataaatttccaagtggaataaaaattggccagacgcagtgactcacgcatgtaatcccaacacgttgggtggccaaggcggcagatcgcctgaggtcaggagcttgagaccaggctggccaacatggtgaaaccccgtctctactaaaaataccaaaattagcctggcatggtggcacgtgcctgtaatcccagctactcgggaggctgaggcaggagaatcgcttgaacctgggaggcagaggttgtagtgagcagagatc

SEQ ID NO: 97871 - DNA, 556 bp, Homo sapiens
acagcgacgggcgttgcccggcgggggatggactgcgcgccgccttccgaccagcagcgggccagtggtcgacgtaggcgggcggcgtggcggggcggaaaaccgtttccgggagagaccttccgtggtggacgtcgccccaggctcccacacttagaaaactaaagggaacgcctaacggagcgatggatctccgtgttcccagcaaagcagggagcacggagagtcaaagctaacatagagcccaaccgacgcttaaaggaggtgttttgggttttgttttttttttttctatttgcgtacggtctattttgtcgtttttttggtttggtttggtttttttctttgttttccgctttggctgaggtgacttagtaaaggagaaaaagggcagtccgctacaccatttcgtaagacgaaaataaccctatgagaattcactccaaaaataggcatctttcatctctcctcaaatggctaatcggtggtttggcagagtgtgtccattagattctgaaactagtttgaatactgacagtgcagaattcaagaaatt

SEQ ID NO: 97872 - DNA, 285 bp, Homo sapiens
tatgtgtgagggggcgggtgtggggtgagaagacgctgagacgctgaaatagtcacactgaaggtgggcgctgattatctgccacatccaggcatatgtcctatctttttaagattttttgaaataattatagatgcccaggaaattgccaaagtcctgcagagaggtccctgtgcccttccccagcttcccttacagcagcatcctatataatgataacattaaaaccacaaagctgacgttggtgtaatactaccaactagaccagacctcattcagatttta

SEQ ID NO: 97873 - DNA, 606 bp, Homo sapiens
  misc_feature (479)..(479): n is a, c, g, or t
  misc_feature (489)..(489): n is a, c, g, or t
  misc_feature (492)..(493): n is a, c, g, or t
  misc_feature (501)..(501): n is a, c, g, or t
  misc_feature (503)..(504): n is a, c, g, or t
  misc_feature (507)..(507): n is a, c, g, or t
  misc_feature (511)..(511): n is a, c, g, or t
  misc_feature (522)..(522): n is a, c, g, or t
  misc_feature (526)..(527): n is a, c, g, or t
  misc_feature (534)..(534): n is a, c, g, or t
  misc_feature (544)..(545): n is a, c, g, or t
  misc_feature (547)..(547): n is a, c, g, or t
  misc_feature (552)..(552): n is a, c, g, or t
  misc_feature (560)..(560): n is a, c, g, or t
  misc_feature (569)..(569): n is a, c, g, or t
ggtctgcaagaacatagaatcgttacgtgattttttgcagaaaaggctcgtgggtgtcctgagtgcctaggaagctgcacaccccttttcctgaaggcctgaaggtgagcagggatggggtcagagggagccctcacctcccctgaggtctgctgttcccatggggaatcccctgcccagcctccacagggtacccacagaagtccctttgtgaagagctattgatacacttggggctcgctaataaccatctaatccgggccccgtgtgatcttggacaagctaaccgacctctccagcctcaggacaatgggaatcaccagacttcccaggcctttggtgaggatgaaataaaataatgtcgaccacacattgggtatatagcaagtgctcaataaatggctgcttctatcgtggccacaaccaccatcacccaaccactgtccctactgacagcagcagtcaggtacatagttagntgaacccaanagnnaaactctngnnacnaganatttcttccancacnntacatantgaggtatanntnacatnataagtgnttccttctnacgatcgagcacatacggtaccgagctcgatctatct

SEQ ID NO: 97874 - DNA, 514 bp, Homo sapiens
agagggttgatgtgaggatttaatataatgaatgagctgtttaatagtttaggttcagattaggagctaaggcggtcctatccttccagctattttaggctgtcccattattcctactattaattgcacagagccctccattcctttgattcccactccaggtctcacatctttactcctccataatctgccttctccactcaacacaatggctttttggccctgctagagaaggttccaatgtggaacctgattggtgcctccagaaatattatctctacaatacatggtggggatcagtgccaatggaaagtgcttttacagtctttggacactgttcttttcattcctgttttctttggcaactatttcaaacatttatagccaatcttcaaaagctctaattactatatgaatcacacttggcagaggacatcattattgggaaaattctactgattagggaggaatttacctatcactttacatttaaattcacgtttttatttcaggg

SEQ ID NO: 97875 - DNA, 530 bp, Homo sapiens
gcttgcattgaaaggaagtctttctaaggagaaggcttggtaactgagcagtcagcctatgtaagtggaagttgaggtacaggtggaaggtttatgaccaaaggttagaatatttcaacccaaagccttcctggttgccttgatcgtctaatacgtcattccttaaaaacaattttttttcttcctactctgccaggcactttgccaagtttggggaatgcaaaggcttaattagacccctcacctttccccaggtattgcccgcagtcaagggggagagccttggccctgcttgctagttagaatgtaccttctacaggttcagtaaggcatacctggaagtctgagtctccatgctcctttctattttgactcctgtctgccatgtccacgtttatgaaggggttaaaatgaaaaatcaaaattccccttagcccaaagtgtgtgtgtttaattcccaactaataaggtttggctctgtgtcatcaccaaattccagtggaattgtaatccccagtgttggagatgaa

SEQ ID NO: 97876 - DNA, 591 bp, Homo sapiens
agcgtgggagataaacaaataagcaggccctgacaatctagcagaacgaaagccatgtgagatcgtgccttggtagctttgggggcttcggggaagtgcactatgccaacatgtatcctgcagtatggaaattccacccgtggagacaggaagccctcttaagaagtcttccgtttaaaataaggtcttaccttggcttctcccagaaagggcagtctgagccgacggcctgtgtgtcagtggtttattttgataagccatcctaggggtctggtgtgagggaatcaagaagaaccaaacaagggctgggcttggtggctcacgcctgtaatcccatcactttgggaggctgaggtgggtggatcgcctgaggtcaggagttcaagaccagcctggccaacatggtgaaactccatctctactattaataaaaatataaaaactatccgggcatagtggtgcatgcctgtaatcccagctatttgggaggctgaggcacaagaatcacttgaacttgggaggcagaggttgcagtgagctcagattgctccactgcactccagcctgggcaacagggcaagagtccatctc

SEQ ID NO: 97877 - DNA, 700 bp, Homo sapiens
tctagaagtcgaccgggcatggtggctatgcctataatcccagcattttgggatgccaaggcgggtggatcacctgaggtcaggagttcaagaccagcctggccaacatggcgaaaccccgtctctaatacaaatacaaaaattagccaagcatggtggccactgtactccagcctgggcgacagagcaagactccgtctcaaaaaaaaaaagaaaaaaaagagaaagaaagtatcatgcttttctgcattctgtgaattgttttagtgagttattgaacttgagggcatggtgggaacctccaaatttgcagccagttggtgagaagtacatgtggtctgaggacacccaagcctgcaggtgtgtctaaagcgagggcagcctagtgggggtctggtggccttaacctgtggcatttgaggtaacatcagggagttgacatcagaattgcatcacataggctgggcgcggtggctcacgcctgtaatcctagcactttgggaggccaaggcgggcagatcacgaggtcaggagatcgagaccatcctggctaacacagtgaaaccccgtctctactaaaaatacaaaaaattagccaggcatggtggcgggcgcctgtagtcccagctactcgggaggctgaggcaggagaatggcgtgaacccaggaggcggagcttgcattgagccaagatcacgcc

SEQ ID NO: 97878 - DNA, 558 bp, Homo sapiens
actttagaggatcccctcacggcacgtccagcctgggcgacagagcaagactccgtctcaaaaaaaaaaagaaaaaaaagagaaagaaagtatcatgcttttctgcattctgtgaattgttttagtgagttattgaacttgagggcatggtgggaacctccaaatttgcagccagttggtgagaagtacatgtggtctgaggacacccaagcctgcaggtgtgtctaaagcgagggcagcctagtgggggtctggtggccttaacctgtggcatttgaggtaacatcagggagttgacatcagaattgcatcacataggctgggcgcggtggctcacgcctgtaatcctagcactttgggaggccaaggcgggcagatcacgaggtcaggagatcgagaccatcctggctaacacagtgaaaccccgtctctactaaaaatacaaaaaattagccaggcatggtggcgggcgcctgtagtcccagctactcgggaggctgaggcaggagaatggcgtgaacccaggaggcggagcttgcattgagccaagatcacgcc

SEQ ID NO: 97879 - DNA, 482 bp, Homo sapiens
cgcaagtgaagaaatatatacatatatatgtatatatctatatctcaaaatctgagagctcagggaggccgtggaaatttggggaagaagaaacagactccctgagcagagctcagggcagcagctccaggcatgcctgctgagcccatcaggccaccgccacctgcaggaagagcctctggcctgaactgctggggatgggctgcagaaagcctgagacatttgggccagcaccttcccaggggcacaggcccccaaggcggggacaccacctctgctctgcaggcctgcctccagggctctgaggagaagccgacttcacggccgcggtgccagtgagggctgcatagccagggccttgtctgtagtctgggcggcccgtggcgctgcccttcagcccaactactcattgccgctgcgtctttggcgaggctttcatttccaacctttcttccatctcagcccttttgttggcccgggtc

SEQ ID NO: 97880 - DNA, 221 bp, Homo sapiens
gttttgccttttgctaaactttatgatgcgcattcttcattgattaagattatcgtctggtttctctcttctaagtctatttctgatgttgaaccatccttttattcgtcatataaattctacttaatcctgatatgtcattattttaaaaatacatgattggattcacttgaacccgggaggcagaggttgcagtgagccaagattcataccactgcact

SEQ ID NO: 97881 - DNA, 563 bp, Homo sapiens
acatctgtcctcctcaggatgcagataatactcatgtaaattatggagcacaatgtaagacaaaaggagacactttacatatgtattgttgatacagaaattatcagggcatgaatgagctgatgtgacattatgccacttctttcttttggttctcccttattaacttggcatttttaatttgaccatagagccaaattagttctccatgctttcttcgtagaaaatccttttttttcccataatgttttcatgccctgagaatcagaaaaatactacagaatagaaaaagatttacagtcattggaagatttgtgttttgcaaacagtgttaagtgatattgctagatggtgatatttttttcagcctaaaactctgttgaaatctgtgatcaaaatgttttaaactatccaaaaaaaatttgtatatttgggaaaaatggatttttacatagcttttgtatgcagatataaaactgtaattatgaatatagtgggcgtagataaactcataagcttaaattctaaaaaagaaaaagcttataacagatatattttcctgt

SEQ ID NO: 97882 - DNA, 552 bp, Homo sapiens
acatctgtcctcctcaggatgcagataatactcatgtaaattatggagcacaatgtaagacaaaaggagacactttacatatgtattgttgatacagaaattatcagggcatgaatgagctgatgtgacattatgccacttctttcttttggttctcccttattaacttggcatttttaatttgaccatagagccaaattagttctccatgctttcttcgtagaaaatccttttttttcccataatgttttcatgccctgagattctgacacttccttccccatccccaccccagtgctggtcaatgtggcatttgtccagcttgtcagtagcttgcccctcagtgtaaatggtgtcttttttatcagcaagtggctttgtccgaattggtgcccactgtctttttatcgtgccgggacatagaatgatgaagggttcccctggtgttgtacgtttttaatttatttaaaactttttttagatcctatggttgtagtggttgtagataatatcatagccattgtgtctactaaagaaaaagcttataacaaa

SEQ ID NO: 97883 - DNA, 459 bp, Homo sapiens
gttttattacttagagttaccttcagtgaattatggaatgaaggatcctaatcattggaggaacccattgaaaggccctataataagttgatgctcagatgtgggttgccaaaaaaaaaagcagcagcttttataggtatttctggctcagtaatgctttgcttaattagtaacctttgactgtagagtgagcaaaacatctctttgagcatttttatggtgcaccataaaagggagaatgcaaatgttatatgttttcatttgccactcctgtttgtctgctcagttacctctgtaaacccctgccattcgcagccatttgctgtgctctaatagccaaaataacgtctagtcttctcaaaagcctgccctgagcagagttttccataatgaagatgctagtggtaacactttaggtacagctaaaactgttttcattctgaaaatggaaagcaaaaa

SEQ ID NO: 97884 - DNA, 304 bp, Homo sapiens
ttaaacaagatgacttatgtaaagctcttaatatagttcaaggcatataatgggctctaggaattagttattgttattaataaggtatggaataaaaggggttggtttagagaaagaaaattggtaaaaacaaaaataagataaaaacacagaatgtaacatgatagaaatataacagagcccctcagtcaggttgggcttcttatttagacctaagggtttacactgtgttagggactctgccactgagtgacagggaatattctcactctttgaacataccccatccatctgtggtagcctg

SEQ ID NO: 97885 - DNA, 160 bp, Homo sapiens
tagagagttcttccttctctccatgtgccccatcccaatcacaactttcttcctccctctaaaagtagccaccattctgactgttaggaagaaaccctcgacattctttgtcttcatcaccgagctgcccctcaactatggttgagtcttacccattgtt

SEQ ID NO: 97886 - DNA, 404 bp, Homo sapiens
aaccgattatacttgttagagggggaaccccctgggggctttgcacgagaggaaaaagctctcttactgtctcatctgggcgagacctctcctgttgttggagcaggcgtttttatcctgctctgtaaatagggaagtgtgacccctgctcccctagtataacttgcgagttgacagcagagttagaatccagatcgcccctcttttgggctgggcagggttgcagcctctttttgaccttgtctgacgagggagaaaggaaggacgtcacttggaactgtcttatgttcatttggctgtttatcgtctttcacagccacctttgagttaattattagagaccaatctggaaggatttcttcgtatcaaccatagtactagaaattgttttgtgggtgtatgaa

SEQ ID NO: 97887 - DNA, 199 bp, Homo sapiens
ggctctttttttacaatttacattttgctcttgagattgcctatttggtttgttattaaggccatattttattttaattcttttaacatctttataaaggttgctttaaagttttgtctactaagtccaaaatctagactatcttgtttcagtttctattgacagattctttttttttttttttttttttttgccctat

SEQ ID NO: 97888 - DNA, 210 bp, Homo sapiens
gggaaatgtgtgctcatctcttttccctgtttcctttatttttatactattgagtttcgagagttctttctatattccagaaactaggtccattgtcaggtgtgtgacttgcaaatattttctcctagtctatatttatctttacatcttcacatggtcttttgcagagaaaggttttgtttgtttgtttttgtgagaccagtctggctc

SEQ ID NO: 97889 - DNA, 580 bp, Homo sapiens
attttcggtttgccaacgacaacagggtaccggcaaaagcactgctgagttgattacaccactctgcggctcaggtccacccagaaacccgctgttttgcataacatgaggtaccagatgaacttcaatcgcgaggggactatgcaactctctgaatgccctccccgcagccgggctattcccagaatggtcctgctctgccctttggtaatcacgacccagaaggtgaatggagaagccaacaaacaatcagtggcaaactgtcctgagagttatttctagggcatcaagttcttcaaggatgttcccatctcgttttggtttttatctgttccttactgcctcctttttgagaatattattacaacaagaaaaaagtaaagggtattcttatttcaaagccatctggaaacctaactcacagcaatagtcttagactcatttcggttctctcattcttgagagttgttttttctccttgttggaattatgtggcacctttccctacataaactgaaagtctgaatcagtcagtctctttctctctctctctttccctctctctctctctctctctctc

SEQ ID NO: 97890 - DNA, 172 bp, Homo sapiens
tcaaagtcagcttcttgacctgcagggcttcaatttgtggctgacagttttaactcagaaaatccctgacttgattggctacataaattatatgttatatagccattaagatcatggttttggaaagtattttaatgatacaggaatgtgctctgaaataataagtgagagt

SEQ ID NO: 97891 - DNA, 131 bp, Homo sapiens
ctgagcttaagttttctcatctgtgaaatagggaaaataatagtgtccacctcctagggttatcaagactgtaactcattataaatgagttatgtttcttcaatgagtcattcaaagcacgaagccctgtg

SEQ ID NO: 97892 - DNA, 746 bp, Homo sapiens
attagggagttccaaagtagatttttgcagctaaattctttggccatgcagggtgagcagctgttgcccagacactatcctcaaaggtaaagctcccaacgccacggtctgcagagcacttgctcctcccaggctggcctcagttagccatcgtcggggaagcccgtgggaccacatcctgcagtcccagcttgcaggacctatagagccacttcaaacattatttccaagagagaccccattgacctcttctgttattattcagacatatgttaagctctgcagcaggactggctagatcatatgcagtgcccagtgaaaataaaaattcagggcttcttgttcaaaaagtattaagaatttcaaaactcaccagtggggcattagcccagcatgggcctggtgcaactgatgccacatgccatgaagcagtcctgctttgcagtctgaatcatgcgtatgatctgagctggggttctttctctccgtccctctctctgctcaggttctaccatactcttctacacaggaagccaggctgaggtcaagagtcattgtgttctgtacacaatgcatacatgatggattatttaccaggtgagggcctctttatttgtacctcatgatataatccctaaaagctgctattcatgaaaggaagtgtgctattcctgactgaagaatacgaaaatgtcctccagcctaagattcaaatattgttgaatgtctttgagatcctcagccag

SEQ ID NO: 97893 - DNA, 879 bp, Homo sapiens
ccttgtatgtcgtttttattaagggaaatttgatttttcccaacaggcctcaatgggctctaaatgatcccttcctagattctacaaaaagaatgtttccaaccttctgaatcaaaacaaagtttaactctgtgaaaggaatctgcacatagcaaagcattttcacacattgcttgtttctagttttaatggcaggatattcggtttttcacaatataccttaatgggcttcgaactgtccctttatagattttacaaaaggaatgttttctaactgctggatcaagacaaaggtttaactctgtgaaatgaatccgcacatctaaaagcatttccacagtttgcctgtttctagtttttatcgtggcatattcagattttcactataggcctcaatgtgctttgatacgtcccttcttagattttactcaatgagtgttttctacctactgaattaaaagaaaggtttaacactgtgagatgaatccacacattgcaaagaatttccacaggtagcatctttctaatttttatcgcaaatattcatttttttcacaataggcctcaatgggctctgaagtgtcccttcatagataccacaagaagcttgtttccaacctgctgaatcaaaacaaatgtttaactctgtgagataaatgcatgcatcataaagtattttcaaatataactagtttttagtttttatcatgggatattcagtttctcactataggctgcaatgggctaagaaatgtccctttgtagatactgcaaaaaagtgttaccaccctgctgaatcaaaacaagggtttaactctgtgaaataaatgaacacatcacaaagcattttcacagatagcttttttctaatttttatcg

SEQ ID NO: 97894 - DNA, 244 bp, Homo sapiens
atactaaatagagtgttttaatacatacttgacaggattaagtttatatattttgacactaaaaccacagtaatttttttataaccatggaaacattttttaatggctcatttgagagattggaaagaaaaccttaccaattcaccctaacttcatcagtggttacatttcaggttatgagtcactctaatctctttatgtacaccccaaaattttacagttaatattacttctacttacagat

SEQ ID NO: 97895 - DNA, 500 bp, Homo sapiens
caacatggtgtagtgaaaagaaagcaggctttggaatggatagaactatacttgaatctctgctctatcaccttatcatgttatgtcaagcaagttacggaacctccatcatttgtcagggacctgaagatatattttaaaagaatgcgaaatgcagtatttgcttataagaaaataaagtcggccagtcgcagtggctcacgctggtaatcccagcactttgggaggcctaggccagcggatcacctgagatggggagttcgagaccagcctgaccaacatggagaagccccatttcaactaaaaatacaaaattatcttggggtggtggcgcatgcttgtaatcccagctactcagggggctgaggcaggagaattgcctcaaccctggaggcggaggttgtggtgagccgaaatcatgccactgcactccagcctgggcaacaagagcgaaactccatgtcaaaaataaataattaagagatataaattaacccgga

SEQ ID NO: 97896 - DNA, 493 bp, Homo sapiens
agtggacaagaaagcccaatagaaaattttctaaacccccatgaagctagaaaacatggattagtatgagatgagaaaaccaagactaagagaggacaggagtatctcttctctacacaaagccacttgagcccatttgaaatgtaacttttgccatggaagaattctaccaacacttttgtcgtcatttaaactacccactaaataccttttctattttttatactattttttgttactgtgtgtgtgtgtgttttatttacttttcttaatatcataacaaaacaaaattaaacaaaaaaattgggttttaccagtgttgccatccaaaatatagaatacccagtttaacttgaatttcacgtaaacaaaattatttaactggatatctcatcttttgtttgccaatctagcaaacttagtttttgcaatcagtaatgtgttggttcctaatgctgctataataaattactataaacgttgtgtcttaaaa

SEQ ID NO: 97897 - DNA, 606 bp, Homo sapiens
  misc_feature (3)..(4): n is a, c, g, or t
  misc_feature (261)..(261): n is a, c, g, or t
  misc_feature (333)..(335): n is a, c, g, or t
atnnagcactttgggaggccgaggctggcagatcacaaggtcaggagatcgagaccatcctgactaacatggtgaaaccctgtctctaccaaaaatacaaaaaattagccgggagtggtggtgggcgcctgtagcccagctactcgggaggctgagccaggagaatggcatgaacccgggaggcagagcttgcagtgagccgagatctgccactgcactccagcctggcgacagagcgagactccgcctcaaaaaaaaganaaaaaatgaatgagtactccaaaaatagtcaaatcacagaacataaaggactagtttcctgactagattaannnaggctgcagtattaaacacagaattaactattagaagagaaggtggagtgccttttattcgtattttctcagagatctatagcaagcagtttgagcttacaaaagattttaactttgttttaggtcaaatttttgtaatttactcaagagaatttttaaagctagctacaacactatgatgcgtctttttcttttaattttatctttccatcacctatttaaaataaaagatctccaaaatctttttttaatgtaggagtccaatttaaag

SEQ ID NO: 97898 - DNA, 484 bp, Homo sapiens
ggttttagatttcaggatttattagattttagaaaggtaatatgggccatgattctcatggtactccagtggggcctgcagcaacacctcagtatcaaacacaatattgctgcagtgaaatgtatggatattcacactaaataagattttttttttaaagatgataaataacctcacatccattcaggacaagtttaagaactgagtacgttaataaataaggtccagttttcagtttggggatgtctgagttgttgataaggtcctgtgaaccagaatgtcttagtctctctggctgctatcacacaattccttagactgcataatttataagtaatagaaactcatttctcatagttctgtagtctgggaagtccaagctcaaggcactggcagattcggtgtctgctaagggcttgttctgtgctccgtagatggtaccttgtggctacatcctcacgtgggggaaggggaagacagctct

SEQ ID NO: 97899 - DNA, 216 bp, Homo sapiens
ccccgtttctactaaaaatacaaagaattagccaggagtggtggtgcattcttgtaatcccagctacttgggaaactgaggcaggagaatcgcttgaacacaggaggtggtggctgcagtgagccaagatcatttcagagaatgaaaagtaacgtgaaagccatgagccgggggctgtgtggctctgagagactggctgggaaggggctacagggg

SEQ ID NO: 97900 - DNA, 339 bp, Homo sapiens
agaataaagagaaactgcaacctaaggtagtactgaaacaaactggaatctaacttaggagtctaacttatgtaaaaaaaaaaaaacaggtctcagccaatcataagcagcagtgctttagccaatcacagacagccaactcatcagaccatatccaaataaggcaaacaccttgctgtaacaaatcagatgtgttctctacttggcttccatgttcagcctatggaagctcacttctcatgctcctgggtggagctctttgaacctcttctgattctgagtgctgcctggttcatgaatcattttttgctcaaataaattctgttaagtttaatttgt

SEQ ID NO: 97901 - DNA, 621 bp, Homo sapiens
accactatactccagcctgggtgacagagtgagactccgtctcaaacaaaacaaaacaaaccatgaaaataaaacaacaataacaaaaacaactaaagagcagaaaatgctaaaatcttaggtattagaatgtcctgaaaatgttttatcatgcctgtatgtgtttagcacttcaagagttcagaaaataaaattaaagagccatgctcagatgaacttggttacttttgctctctaagatgagacaaagaggcgtgccagtgaattgcctctgtgctcgttttaaaaatgcagtgttctaggcctaatattcatagattcccatctatcagttttgtgttagagtctaaaaatacatatttttgacaacttcctaggtgattctaatgctgttggtctatgaaccaactggaacaagggtaaatagaagcgaaatggcaacttttcatttcctgttactaatagcattgtttgcaatattggcagaaaaaaaagtactcctttgggcagtatgcttttagagattaacagaagcactgcaccagctgaacaaatttagatcctgacttcagcacagtctggggcatagttaacaaaataattgtgatgcctatactatca

SEQ ID NO: 97902 - DNA, 617 bp, Homo sapiens
agcggattctgaggtactggcgttaggacttcgacacagaaattttgggaggacacaattcagcccataacagagcccatgctggaagacagtccctgaaacactgagtggacatcatggataatactcttttgatggatggcttctctatctgctcctgaaatatcagtgttccttaggaacccatctgtggcctataacctgtctcaccctacaacacccctgggctataaattcaacaactttctatataaaggtgcccattatttttggcttcacttttacaacatcctccaggctggacccctttcaattcactccaagagaactttgaagatcctggcacttacagtctatctgctgcttaaagtctgcagtgactctccattgcctacagggtttttgttctttaagctacgactcctcagcctgacctttgaagacttgttctcaagtgcctgcctccctgtccagcctcgtttgcctcagtctgtaaaatccatgaggacagggcccaggtgtgtttcagctcacacgcctcacatggtggactcggaactgcccctctctgagctggagaaggaggcccacgagagcacaccggagatatccgagag

SEQ ID NO: 97903 - DNA, 441 bp, Homo sapiens
catgcatggtcccggtgctatgctctggagttactgccgacagtgagttccgttttcgtccgcacgcagcactcccaccctaatttcatcctccccctccctccacacatatggagatccactttatttcattgtgttttatattcttctctatgtatactcactgcttcccttcaccaaattataaatgctgtaaagcaggggtgtctaatcttggcttccctgggccacattggaagaattgtgaattagtaaaattcactaacacgaatgatagctgatgagctaaaaaaaaaaaaaaaaaaaaatcacaaaagaaatctcgtaatgttttaagaaagctcttgaatttgtgttgggccacattcaaagccatcctgggctgcatgtggcctgcgggcggcaggtggacaagcttgctgtaaagggtacagagtgtgt

SEQ ID NO: 97904 - DNA, 492 bp, Homo sapiens
cgggtgacagttaactcccgcgctgggcaggggacgtgtgggcacggtgccgggtgacagttaactcccgcgctgggcaggggacgtgtgggcacggtgccgggtgacagttaactcccgcgctgggcaggggacgtgtgggcacggtgccgggtgacagttaactcccgcgctgggcaggggacgtgtgggcacggtgccgggtgacagttaactcccgcgctgggcaggggacgtgtgggcatggtgccgggtgacagttaactcccgcgctgggcaggggacgtgtgggcacggtgccgggtgacagttaactcccgcgctgggcaggggacgtgtgggcacggtgccgggtgacagttaactcccgcgctgggcaggggacgtgtgggcacggtgccgggtgacagttaactcccgcgctgggcaggggacgtgtgggcacggtgccgggtgacagttaactcccgcgctgggcaggggacgtgtggg

SEQ ID NO: 97905 - DNA, 675 bp, Homo sapiens
tgagcggtagcaaggtttattgtgaagagcaaaagaacaaagcttccacagtgtggaaggggacctgagcgggttgttgctgctggctggagtggccagcttttatccccttattggcccctcccacgttctgtttctttcctatccgagtgcacttttttcagttctccctgtgattggctacttttaggatcctgctgattggtgcattttacagagcgctgattggtgcattttatagagcgctgattggtgcattttacagagtgctggttggtgcattttagaatcttcttgctagctacagagcactgattggtgtgtttttacagagtgctgattggtgcattttacaatcctctcgtaagacagaaaagttctccaagtctgcagtcaacccaggaagtccagctggcttcacctctcaatctccccccacccccgtctaaacaggacaccccagctgctgttgggaattgggtgatgaccgctctagttacttcttgctggataggggcgaagaaggggccctgcagttgtagtgtcctctggaggtgaattctctaggccagtcaaagggccagtgggttggtccaggggtcctcagtagaagttgtgagttgagctcatttggggtgccatttgtaagaccatctgtagcttgatggcctcgat

SEQ ID NO: 97906 - DNA, 301 bp, Homo sapiens
ttgctaacacgctgctggtacttcccaagtatttgaaacttctgggagaaaattcacgtggatgcaactgagctttatgcagcagggctgcagtagtgtggccacggcagtagaaacgagtgttgagctgtgtcccaggaaggagacttggtgccttgtttgtttaccagttttaggaaacagtgacaaagattggccaatactactgtgaagcttgcttgcttcttttcgacttttaattcatattgtgaaaaatacatggaaacatattctctgtctgtggaagcctctgaaagagcat

SEQ ID NO: 97907 - DNA, 771 bp, Homo sapiens
acgtaagtaaaacttggcttgcttgcatttgaattttatgtggtcacagcagatgctactcagtggtaaaattatacaccacagagagggcagaaactcagaagcagatgtgctagggcttagggaggtttgtttctgtttgggtaactaaaaacaaatcacataatggtattagaaatgcctttaaggcagaagtaaaacaggtgaataaaaatcactcttaaaggagcccttattttcaaaagtaacgctttctttagggcttaagttacatatatggaagaatagtctaacagttggtgaaagaggtatgtgataaatcactaggcgatgcaaaagagtgactccctttttcttttaaaaatgatgtctgcatgtatatttgcatatgctagtaagtgcatagaaaatgattgcagaaacagataccaaacgtagtggcactggagggagaggtaacaggaggctgttcctttttccttgatatgcatttgtattgttttgattttctgcactccagcctgggcaacagagtgagactatgtctccaaaaaaataaaacaaaaaaacagaggattcgggtgtacactggcgctgatgatcctttaaccctgtaatatttactactagttgcgcaacatggaattgacacagactaggcacaacaaattctgcctaccttatctcacctcacctctgggcccaagtccatgaagattccacaatattgcaacaacaacgaacaaatgtccatgttgaaatacttctaca

SEQ ID NO: 97908 - DNA, 480 bp, Homo sapiens
tgcctcagcctcctgggtagcgtggattacaggcatgcgccaccatgcccagctaatttttgaatttttagtagagacagggtttcaccatgttggccaggctgatctcagactcctgacctcaggtgatccacccacctcggcctcccaaagtgctgggattacatgcatgagccaccacaccgggccaattatcttttagccatccctactctctggtcagtctcattttaaaagcagataattgatttatcagtattcgctacagaaagtagttgaccacatttgactttgcagacatttcagaagatgtggtggtggttagaattttctgcatcccacatatttttaaaatctgcaatttagagagaactttatccagtccagccctaggggtagatagatgcatcctactggcccaactcattgcaaggccatggaaataggaactgacagtgttgccccagaaagctggagaag

SEQ ID NO: 97909 - DNA, 312 bp, Homo sapiens
catttccccactatcccccgtccccccaaagctaatattctaacctgtttattatatttattcactgttggtcttatgtttgaacaaaatgattttgtttatctccaaaaagcaataaggcgtcaggaccatgtattctgttatagaggcacatagctacttgttttcaggggtgctttgccattaaaaccatggcaacattttcaaagtgacttattgatcaatgtttcccctgagcacaggccaattacaatatcactaattaaatgtctctcaaacacctttaacaggaaaaattctttgtaagagaaa

SEQ ID NO: 97910 - DNA, 356 bp, Homo sapiens
gaaaaaaataaataaaagaatggctactctacaggcaaagcagtagtttatccctctgtacagagtgtgggctgtggtgatccaaaggcctctcccctgcatgggtgctgggacccctgtgtagcacacaggaggtgccgagggagctccttgtgttaagagatggacctgatttgggctcacctgggtcatcttacactgggccctggaatccgggccttgcctacctacagccggggggtggagctcccccaggtatggccccagcacctgggcctgccaccagaaaccttcaatttggagatctttctgccaagaacccttcagaggagggggccggcctggccaggcacatg

SEQ ID NO: 97911 - DNA, 509 bp, Homo sapiens
gaaccagcagcagcatccattaatttgattagttgtttatgggctggaagagaagcctggcacctagccctaagcaaatcaattgtgtgaggtctaagcataagtatccatccaagccagccttgccagccaggattctacacagagtgacaacagtggagggagggcaaaacgttagacaagaagtgtcttacggcccctctttctgcctgcttggcattttaccatcagttacctcttatctaaaggcagtgagtgtaagctgtttttctactccaccctactccggccccataccctgttgtcctttctgaaggacagagtagagggatttctgtgggtggttgttttttttttttgtttgttttgttttggttttttttttaaacctaaggacttaaatatgtatcatcatccaagcctgaaaacaaataaatctgggacattgaaggaaaacagggagcaagagcccaggggcccaattccactgcaggttcctctgtttttta

SEQ ID NO: 97912 - DNA, 619 bp, Homo sapiens
ttctcctgtcaacactcttctggaacaaatatttttaatgtgtgactaatatttaatagtattaagttgtattaaaatgtaattctgtatttttgaaaaataccgatattctaattaggacaattcagctttttgagaaagcagataaaactgaataaatgaaatatttaatgatttttgcctcaatccaaaatgccataacattgtgagtaaatttttttttcttggaaaatcgctcagaacatggcctcaggtatatgcgccaagctgaacggcagaggtctgttctgaacaacggcccttgtagggtgaccgtatttcatttggcaaagtataccagtaaaactgaagccagccgatggaagcctcctgcctgcaggcttaccaagcctggctccccatggaaaccagagagaagatgtttgttgcagggaaagtaagttctccgtgtgaacccacaataacaatacactctttaagggtttgtccaggttgcgatgaaatttgacaagcatctttcctgcaaaatgttactaactcagaagtcacaagatcacagtattctgttgattgcccttgcaacagtcaaaataaatatagccatgaatcttcccattaa

SEQ ID NO: 97913 - DNA, 441 bp, Homo sapiens
gaaaaaaattcacatataaatggatacgtggactcaaacccgtgttgaaccagttcatacctacgttgttcagggtccactgtagttgcgttttcttttatgtgcatgaagtaatcctagaagaataaaactggttatccaggaagggtgcagagaggaggagatgctagaaactgagcaaatggggcacagagatgggagcaagctctctctacatgtgtgtctgtgtactgtatgtacatatattatatattgtatatatatgctgtatacataatttcatccacatatacattataaattaatattaataaaacattaatatttattaatgtcataatcaatatagtattatatatttctatttatattatatacttgtataattatatattattataatgttataattaatacattaaaattgcacattaattaata

SEQ ID NO: 97914 - DNA, 451 bp, Homo sapiens
ctcctgatagtccctaaagaccacacacatggtctgcttccttatgaaaggctccactgccaatcactgcagtgatactgatgacaaaggatggcaacaataacaaagctaggcaagcttcaagggctccagaatcttactcaggtatctcagccacgagcccgggtctagggggactgaaagggactttggccactgccattattcttgagagtggagctctccacccagtgcctgaaagtaaaggagatgcgggttcagcccattctccactttgtaggcgtgaagatgcagcagaggcagaagaacagctgctgccctcagggacaagtgtgcaatttctacctaagaggcctctaggctgcgtgatgtgcatttcacaggttctcggcctctacctcttgatgttcctcacaatgtccactaaaaactgtgtttctaattaaaaata

SEQ ID NO: 97915 - DNA, 603 bp, Homo sapiens
agtgagcctagatcacaccactgcactccagcctgggagagaaagactccgtctcaaaaaaaaaagtaattatatttcccaacataaatgaatagagccattaaggaaaataacatggagattcatcagaaattaaaaatagaattactgtatgttccagcaatcccacctgtgggtgtatagctaaaggaattgaaatcagcatactgaagagataactgcactaccatattcactgcagcagtatccataatagctaagatatgaaagcaacctaggaggccagcattagatgaatggataaagaaaatgtgatatatatacacatacacacacagacatgcacacacataaaggaatactatttactctttattttatttattttattttgagatgtagtttcactcttgttgtccaggctggagtgcaatggtgtgatcatggctcaccgcaacctccacctcccgggttcaagtgattcttctacctcatcctccccagtagctgggattacaggcatgcaccacctagcctgactaattttgtacttttagtagagacgggttttctccatgttggtcaggctggtctcgaactccc

SEQ ID NO: 97916 - DNA, 387 bp, Homo sapiens
ccacacttccagatggtcccttgaataaagcaagctatagacaaagggctctgtcatatggtatccagctcctgtgggcatctatgccatctgggaaatgatctatagtgatgtgggagatagtatgacatagaaacatgggatttagaacaatacagaaggaatccaaattcttgcttcaccatagttgagctgtgtgctttaagtaagtcacctgtaaagtagggataatgctaatcatgaccgcctatggttgttgtaaagaaaaaaatgagataacaaattaaaattcctagcacagtgcctgttatacagtaagcactcaatagagtttaaccattactcttatttctgcttctgtactcaagaaagtacattgagaagact

SEQ ID NO: 97917 - DNA, 233 bp, Homo sapiens
accagcgcacctggccgcatatgtgtatttttaagaatgtaatagtgttttatgaaattggaatcatactctatatattgtttataagcttttaaaaactttagtaatgtcttatataatgcaaacatttccatgtctttaaatattttgctgctgattttttgtacttagtgttccttagtatgggtatagtttaaccagtcactttgctattgttggacccttagattgtt

SEQ ID NO: 97918 - DNA, 403 bp, Homo sapiens
ggaggatcacctgagcctgggtaggttgaggctgcagtgagctgatatccagccattgcactccatcactccaaaactgttcacaagtatagtttcagttatgtttaatgataaatattattaaaggatatggagatgctatatgggggaaaaaacttcacgcacaagaaggaagcaatccaaaacagttacagtatttatttcagggttgttcaattatagctgttgcttttcttctttatacttttctgaaattcatgttttctgtaatgaccctttattacttttacattaccaaaaaaaggtagtctagcatcgttagaacttctttatgaacttcttaagtgtactaaaatccttgtgacaattctactagaaatgctatttcaacctgtgagattcc

SEQ ID NO: 97919 - DNA, 252 bp, Homo sapiens
taattttttttttagagatagggtctcactatgttgcacaggctgatctcgaactcctggcctcaagcaatcctcccatttcactcttccaaagtgctaggattacaggcatgagccactgtgcccagccatgataccatttgtttttgaatgttcattctggatgctgaatgtggaacaggtgatggtggagcaagggtagaagcagagaaactagtttgaaggtgactgtggtaatcagggaggaaggtc

SEQ ID NO: 97920 - DNA, 345 bp, Homo sapiens
ttctttatatattctttatgtatggcccttatcagatgatttccaaatattttctcccattctctgtgttatctttttactttcttgatagtgtcctacgaagcattaagttttaaattttgatgaagtccaattcatctattttttcctttggatgcttatgcttttggtgtcatacctaagaattcactgctaagccacagtcatgaagatttattcaagtttccttataagagttttatagtgttagctcttcaatttaggcattttgagagtttttgtacatggtatgaggtaggaatccaacttcattctcttgcatgtggatatctagttgccctagca

SEQ ID NO: 97921 - DNA, 657 bp, Homo sapiens
gtctttagataatttaacagtttatttcacaaaaaggcattataggcaacattaacaggcaaatcgaatggagacaatatttacaaatatgacaaagaatttattcttaaagatattaagatataagaagtcttataaatcagtaaaaaaaagactaattccccattgaaaaattacaagtaaaattccggataatctaaaaaatgctcagcctcatctataatttttgaactgcaaattaaagcaatatgtcacttttaaggtattaaactggcagagacttcagaaattataagtagtggtatgctcataaatgtttaataaccacctctggcgggggtggggggttgttttgtaactttgccaatttctgtggtgtcaatacttctcaccatggtgatttcaaactacgaacatgacatcactgaatacagcagagttaagagatgggcatttgcctcttataagctgttactatctggctccagcacatttccaattcatactctgctgtcaagggtacatcagaatggacatgtccatgtatttctggtatcaggattccgggagcgtggtccatcttgtgcatcattcaattcctccgcccttcacctgcacaccatgtcatcatacgtttttatctttgccaggctgaga

SEQ ID NO: 97922 - DNA, 294 bp, Homo sapiens
tctactggtttctatagaagcctctctaccttaactattttattaaaatacttggatttgttaagtctaagcagaaatcacatttattccttctacttccttttcaaacctgttctctcaaatagttcttttcttgccaatggatgaagtcttaggtaagccctagagctatgctagtcccttttagcggtaatatctcatttaatattaaaaagcgtgagctgatataatattaaaactggaaattatgtggtagggaagctgggtgaagtcagcatttactttcatccacac

SEQ ID NO: 97923 - DNA, 395 bp, Homo sapiens
aatgggaccatacttgttttcccacttgatacattatggatagtttgcccgtgtcaaaaagtagaactccatgttagtattttttatggctgtgtagttgcagtagacatttgctcctgccatcatctggacacatgttgggatcccacgtctccatttgaggtcaagaaaggcccttgtaacttgctttagcaaatgaaacgtgggcagaagctctttactgcaggtgagcctctggtaccatgacactttcttccatgcccctcatgaagcatgtgttggtgaagtgtgacgctaagccattctacagatcacaaccgctctaggactgcagtggactttgcatgatcgagaaataaatcattgttttagcccactgtggtaggggtgtgtgg

SEQ ID NO: 97924 - DNA, 226 bp, Homo sapiens
cctatgtaccccttgcctccattaatgattgtgtgcttgccacttgtggaggatgagacttcgaagcaggtggctttctgtggctgaagaaaaccttaaatgtgctgacaaagttttccaaagagacagagaatggcatctgccatgtatgttgcccctttccaaagaggaagcaacaagggtaatggcctccaatggctctgtatgcagataggtggacagtaat

SEQ ID NO: 97925 - DNA, 368 bp, Homo sapiens
tgtcagcatctgcttagggtctaaggaagctttaactcacaatgtaaggggaaggagagccagcatattacatgacaagtgagggagcaaaagaaagatgggaggagttgtcaggctctttttaacaatcagatctataggaaactagtagaatgagaactcactgattattactatgagggcagcaccaagacattcatgagggacctgccctcatgacctaaatacctaacaccagctacgacctccaatattggtgatccagtttctacatgacctttggaggggacaaatatccaaataatgtcagccattctgggtattttgcctcttcatataaactttagaattagtttgtcaatattcac

SEQ ID NO: 97926 - DNA, 474 bp, Homo sapiens
ggctttgccagaatgaaaaagtgaatggtttttggggccttcaactttttgtgctcttgaagaaataagaagacaaaatagctttcaatccacatcaggcccaatttgcattgcttcgggagttcctgggaaagtgacggacttctatccaaaatcgcgccgtgaatttgattattggtagttctacagtcagcttgagggttgttggtttgacagttgtcagagcatgttgcagctgtatgaggtgggtatctgtacatatggatgtcccatattctccagcattgcataggaatagctggtgtctagatcctgcctcaggagctatgtgtcctgaatttaaaaatcaggtatgttatatccctggggcatgtcagacatacaacaacagtgcattagtccattttccattgcttacaacaaaataccttaaactgggtaatttgtaaagaaaataaatttcttactgttgtt

SEQ ID NO: 97927 - DNA, 241 bp, Homo sapiens
actgtgtccttgaccaactacttaacttgttcaagtctcaacttcttcatgtgcaaacgaggtactcgccaatccaagccaacccacaagattggaatgtaagggttaaattgaaacaaagatgggctgggcaggggctcacacctatgatcccaacattttgggaggcagaggtgggaggatcacttgagcccaggaattcgacaccaggttgggcaacatagggagaccccatctttac

SEQ ID NO: 97928 - DNA, 382 bp, Homo sapiens
agagagagagagagagagagagagagagagagagagagagactgttagcgaggttacaacctcagctttctttttatcatttacttggcatacttttgctcatccctttatttttagcctttccaaattctttgttttatgtgtgtctcttgtatacagcgtggaattgggttttgttttgagagccagggccaatttgattgatttgaactgtcattttgtgaaataatgtccctgtgtttttttttttctctgctaagcatacttttgtctttctcaattttcttttggtatttggggaagtttgtatttttgttctagtggttacctttattcttacacctttttaatgctctcttactatctgttttgacagttttaa

SEQ ID NO: 97929 - DNA, 443 bp, Homo sapiens
ggtattttttagtggagacagtgtttcactgtgttagccaggatggtctcgatctcctgaccttgtgatccgcccacctcggcctcccaaagtgctgggattacaggcatgagacaccgcgcttggcctcccctagcttttttaaaatgtacaccctcctaagtagaatgaagaccaatggatgtagcttaaagagctacataaaatatgcagtgataagctacaatggatgtagcttaaagagcaacataaaatattcagtgataatactttattgcaactaaatgaactcttgcaaagtttcctccagttgtgaaagtcatgggcttcagataataatgagggcattttccatttttaattggactagtttccatattaaccaatcatattactgatttggttacttgtggcaaggggatgatagaaataacacactttgt

SEQ ID NO: 97930 - DNA, 253 bp, Homo sapiens
tgattagcggacttgggcacttagcagagggtgcacgtgcccgtgtgtgtgtgtgtgtgtgtgtgtgcacgcacacctgtctcagggggtacctagcatataccctgagcagatttttaacacctgccctcttctataagacaaaattattggcagtagtaatcatgaaatgagtaacaataaatggcaggcagccaaaattttcttttattgaatttcctatataaactcatgccaattcaaaaataaataa

SEQ ID NO: 97931 - DNA, 301 bp, Homo sapiens
gaggaaacaggctcagggggttaaggggtttgctcaaggcacacagcaggtcagtggagagtgtgtgttggaatccaagtaaatgggtaaagaccaagagaccacagtggatacatgtttcttttcttggtttttcaagtccccttttaaggggctttttaactagcagtgagagtacacagaggtgctctccaaagggttatactctttgtgatttaagtaagtgaagtgaataaggggaaaaatgaaagaaaaaagagacaaaccacaacaagtttcatgtataggcctcttcagttgg

SEQ ID NO: 97932 - DNA, 391 bp, Homo sapiens
  misc_feature (107)..(107): n is a, c, g, or t
aatgaatagcatatgcaaaggcagaggccaaacttccttagtttaaggaaggaaactaacaaatataacaagctatgcttacttgaagtcagaggtgagggctaganaggaatagagcttaaggaaacctgtttttacttctctcccagatacagaacttcaaactgtttatggttgagacactcatgaaaaattagccatgtgggagtggagagagaatggaatatgacaatggctaagcatggcaaggtaactgacatagcaaatgttacaggtggaactataaagtggcccctacttggcagtacagtcctagtctctattctgagtctgataaggagggcctgaggattctgatggctccaagggtgcaattcaccctcttcctgaa

SEQ ID NO: 97933 - DNA, 296 bp, Homo sapiens
tgcagtgcctgctatgaagcacacacaatgcttatctgctgctccattggaaagccaatagcaaagaagggaaaggaccttctgattggagagtggaggagtgagttagaagatggttttatgtttactgcaatgccctttgtcctcatcagaactgtgaagtggaatttgattttgatgcactctttaacaaggatgctttgtgttatccatgcaatcccctactactctgaaccataacatacacatgctacatcccaaaagccagaacccccaaaaatgggttgttcctggtt

SEQ ID NO: 97934 - DNA, 831 bp, Homo sapiens
ctggaatctgggtctccccaccctgtgggacccctcgtatcatgttttggccgtgcttgggaactcaggagggggtttcctgcttgcaaaatgcccacgcataacaggacagccctgtgtctgatacagctgagcaaagtctgggacacgacagaacaggtgtcacatcctggctttgccaccagagcctcagtttatgtaaattggggaagatctccaccctcacacttgttcacagcagagctgtggagccgtgtaagacctcaggccctgccgtgatgcttcttccctcccaagcccggctccggcgcctgccagcagtgccgccttggcaccaccttcttggccctcgccaagcctcagcttcctcatttatgaagtgggcatagtggtcctatctatttcacaggatgctggtaaagatcaaacgagctgatccaagtgtcccctgaagtgctacaccagccatttagcaacctcgccatgcgccacctgcatgcagcctggagtggcaaaggccctgaagacgctgaagctgttgaccttttcctctttttcaggaacatggtccctgggagtcattttctttcatcatccacaaataagaaaagacgttgttacattagctccaagatagctctttccacaatgggaaatttctgctgacagtcactaaggaaacacaggcccaccgggtggggctctcggccagcatcttgaaggcgggtacaggaagcaactcactagtgactttgagtgtcacctagcaggtcaccactgcctcaggagtggctggcaagggcagcgcaggcctccacctccacggagggg

SEQ ID NO: 97935 - DNA, 481 bp, Homo sapiens
ctcaagctacttttgctcttaaaccctcacatccaacaaaatactgtagatttgattatctcccctaaaatccttcaatctgtaaactcttctctgccctaccaccacagccctggtttcaaacctcgtaatttcttgattgcatccctccagtggcccaatatctctcagccactagtcctctgtctcctccttccatcagccctccgtatcctccactggctcctcagaatgtttcctaaaatacagaattgatcaggaagcctgactttatatccgtcattgacttcccttatcactctcagtattttatcccaaatccctggtgcatggtatacaaggctcttcatgaactgtcccagaattggtcctgctccctctaatatcacacacatgtgcatgcacacacacacacacacacacacacacacacaccatgttccagtgcaatgaagggggcaaaggatctgaacagacattt

SEQ ID NO: 97936 - DNA, 775 bp, Homo sapiens
ctagagtagctgcaacactagaaagatggcggagcaagagcaaagaaaaatcccttggttccagaaaatctcctgaaaaagaggaaggcttatcaagccctcaaagccacccaggcaaagcaggcacttttggcaaagaaggagcagaggaaaggaaaagggccaggtttaagcaactgcaattattcctacatgattcctggcagcagaaatatggcaaggtgagtctttgacgactagaagtgaaacctcatgacttggaattgccagataaacattccttggcctttgttgtactcatcgaaaggattgatggcatgagtttactggtgcagagaaccattgtaagactttgcctaaagaaaatttttagtggtgtctctgtaaaagtcacccctcagaacctaaaaatgctgcatataatagaaccttgtgtgacctggggatttccaaatctgaagtctctctgggaacttcttttgaaatgtggacaagccaaggtcaagaataagaccatccttctgacagacaacacagcgattgaggagcatctggggaagtttggtgtcatttgcttggaagacctcattcatgaaattgcgctcccagggaagcatttccaggagatttcatggttcttgcaccctttccacctctcggtggcctgccatgctaccaaaaatagagtgggcatcctcaaggagatgggcacatctggctattggggtgaacgcatcaatcagctcatccccctgctgaactagacccaggtgcc

SEQ ID NO: 97937 - DNA, 635 bp, Homo sapiens
gcttacctggaaaactgtaacaatctccaggttgacctttctgtctccctctaaacacatcacattggctaaaattatcttttgttaataaggattatattacatataaaagtatttaaatattttaatgactcttacccttaggatagggtctgaactccttagcaggcttcatgatatattaaccttgttgacctctttggtctctctcagtacttctcaattcatactttgctcttcagccacagtaagttagttttagttccctgagtatgttatcagctctctggattctgggctttgctcatatttcctctattcaaaatactcttatacttcatgtctttcttgccacaccccccaccccttcccaccagcatatgtgtatgtatcacaattactcatccttcagatcagattcagtttaaatggcatttctttgggaagcatttcctgattctctacctcccaggctgggttgattgcatgtatagcaccttctactgtagtacccttttcatggcatttacttaccatagcctatttgttattgccctcaagctccattagggcaaattgttttttcattgttttaaagtcagcacctaaatctccctggccaaaaaaaaaaagaa

SEQ ID NO: 97938 - DNA, 207 bp, Homo sapiens
atgcttcccaaagaaatgccatttaaactgaatctgatctgaaggctgggttgattgcatgtatagcaccttctactgtagtacccttttcatggcatttacttaccatagcctatttgttattgccctcaagctccattagggcaaattgttttttcattgttttaaagtcagcacctaaatctccctggccaaaaaaaaaaagaa

SEQ ID NO: 97939 - DNA, 391 bp, Homo sapiens
ggataaaaaagaaagatatattccacacaaacgaaaaccaaaagcaaaaagtagctatacttaaatcggatgaagctgacttcaaataaaaacaggaaaaaaaagacaaagaagctcataacataacaataagggaatcaatttaacaatgggatataacaacattaagtatatatgtatacaacaacagagcacccagattcctaaaactagacctaataaaaaaccaacagtaatacaataataatagaggatgtcaacagctgactcacagcactagacagatcattaaaacagaaaattaacaaagaaatcttgggcttaagttgacttctatatcaaatggacataactagatatttacagagcattctgtccaacaactacagaa

SEQ ID NO: 97940 - DNA, 249 bp, Homo sapiens
gggttcatggagggaagtcaagggagctgagatgggatgcaggagagactgtaaggatctaaacagcacaaaatgaacatctaacccttgctcctgctcttctcctgccaactggtcctgttccacgttttctgtttagtgactgtgccactgtggtagagattgctggctgtcccctgattatctacaactatgtgtggccatgagactcagttctgacccttgggatgtaagcaacttctgggtggt

SEQ ID NO: 97941 - DNA, 263 bp, Homo sapiens
tgtctctgtcaggacatgatatcaggaggcccataactatttgtagttagtagtattggtgatgtgaagttcgatcatttggttgaggtggtggttgccacctcaatagctaatccgtagaatgataaatttcagacattgtgactatcctgttgtttcacagtagttttagcatctgttggtaatttgtacctaaatcacggtggatgctaaatggtgatttgtctgttagtacttctatgtttattagctgttactctttt

SEQ ID NO: 97942 - DNA, 470 bp, Homo sapiens
aggttgtcactcacagtacttgtcacctcactcgcagggtgagcacctgaccctggcctcctaatcataattcaggctaatgctggagtccaagagaagggccttgtgaccaggcaaggccaattagaatctttccctaggactgatgtataaaagctggggggaaaatgctttctctttcccctggggttgctggggtagagtctaggtctctccctatcatagagatctagagtcatagtctgtctcaggatggggtcatgaaaaggcaaagaaacaccctagttccatgccctgaggccctggttgaggtctctctctcttgcttggattcagccacctactccacttccttcccagtagttgctctcacttccttaagccacttaggcttgggtttcagccactcccacaactccggcccatggccatgtcctcccactccatgcctaggagcccgtctctaaggc

SEQ ID NO: 97943 - DNA, 598 bp, Homo sapiens
tagaaatttcccagggctacaaagccttccctgtatgagctgcaaatcaagccaaaacgttaccagagatgaagagatggggacagccatcaggcctggggatggacctccctggagctgggcattcaagaggatgagtgcagcagaagacgtatccagggagcctttcagtgactgtttgggcaaagcctcccttgtggtagaagatgcctcacttctggggagaggaggctcctcatcttgcagacaagaagcagcacccactggttcctgctccaaaagccattaacattataaactggccaggtgcggtggctcaaacctgtaaccccagcaccatttgggaggttgaggcagaaggattgcttgagcccaggagtttgagaacagcctgggcaacaaagtgagacccaatctctacaaaaactagagaaaaaatagctgggtgtggtggcactcacctgtactaaggaggctgggctgggaggatctcttgagcctaggtggttgaggctgcagtgagccaagatcacacctctgcacttgagcttgggtgacagagtaagaccctatctcaaaaaataaagtacaaactgat

SEQ ID NO: 97944 - DNA, 553 bp, Homo sapiens
tagaagacagttgaataatatcttcaaaatgctaggcacattttcaaataccaggtaaaacatgattcaagaattaaggcaaaatattctcagactgctaaaataattactaagcaatatatttgtgtaaaataaaatgaaactagaaggaaggagacagcgatgtaaagctgtataaaattgttttctctgtaaataagaacatttattaaaaaagcttataatcctaaaatttggtcagtgccaccaaggaaaacacagaatactaggagaatgcagtgtttgactgatcctgtgtaaagagagagaaatcaaatagaagacttattgcatatcctatgaattacatatccttaattcatatcctgcatattacatatgctatgtaaagggagataaaaacaagacttattcgagataatggcaacaaatataaggcttgtgcataatgtgttctatgtaaattattaccaattataatgtttctagatagcaaaaaagtgctaaacctctgaaatatgtatacatacatgacctttccaagaacagcagc

SEQ ID NO: 97945 - DNA, 453 bp, Homo sapiens
ttcagtaaattttgacaaatgtatacacctgtgtaaccatgacctcagtcaaggtacagatatgcagtgactttttcactatcacacccattcctgccactttttttcatatccttaccactatctggaatttttatgtgtgccatctctagtaaaatacaatctgcatatgtgcatggatctggtaaaattgttacttttgctatccccttctttcctactaagtgcatcaataaatagcatccactctatatttgtgtctttcctcaagtaaattcatgaaaacgagatcctgcaagtttgtgtttttatattaagtgttaactctagagattacaacactgttcttgtaggatgtgtttttggggaaagcattcctcttatggcagccctgttagcctgaggcagggcttaaacaaactgattgagcaggctcaaaaggacagtatcgta

SEQ ID NO: 97946 - DNA, 465 bp, Homo sapiens
gatattatagatttatagatttttacatagatttatatatagaatatatgagtcactcttatccttcataagcgtaggagttaatctgccttcatttctttcatcttgcctttttggatcagtataccaaattttttcagacctatattccagttcactgagttcctcttcagtgtatccaatctgctatttaattcatccataaaattttaaattttgtttgtacatttttgatttctagaagttctatttgattatgtttccaaggtgttaggttactttttgttatctcttgtttgcccaaagggcaagtagattttcagtttatttaggcatattccatagttccatatttcatacttcatttacaattcagtttctgataataccagaagtacttgcaggtctgttttcatgtttcatctcacttgttctcacaggacctcgtgtgctttgggattttct

SEQ ID NO: 97947 - DNA, 451 bp, Homo sapiens
tgcctttggggaccagttgttaaatttgtgacctaataactagaataaagtttgatatagaaaaaacatgtctctgtctagtgaccttatcttgccttagcagagggtgtgcttagtgattccctgagtctttcctgtggtcttattttatgaaaaaccatagaagccatacgaagcgaaggcttttctgggatatgtgcataaaacagtactttaaagctaacctttaaggtaattgcaccaagtagtactttcttataacaccatttagtagcagaacgtgcctagataattctagggtagtaagacctctgggacaccagccacttagagaagataacaggtatagttttttgttttttagggttttttttccaatgcccaagcagaggccactacacccagggatcaaggttatgggatgaggattatattttatcccgtttctatg

SEQ ID NO: 97948 - DNA, 657 bp, Homo sapiens
tataggaaattcaatagggcctgaaaagggggtcaaccaagtactgcgactttcacaataaaatgaatcaaagctctcatgagttcataacctgagccaaagaaaaagacggagtctcgctctgtcgcccaggctggagtgcagtggcgcgatctcggctcactgcaagctccgcctcctgggttcacgccattctcctgcctcagcctcccgagtagctgggactacagaggcccaccaccacgcccggctaatttttttggatttttagtagagacggtgtttcactgtgttagccaggatggtctcgatctcctgaccttgagatctacccgcctcggccttccaaagtgctgggattacaggcgtgagccaccgcgcccggcctttaaagttattttcaataacacctagcaattaggaagcttaaaattacatgtttttaagacttggaatcaaataacttcactctctaaagacttaaggcaacgaaaattttttcgttttaagtttcactttcgttcttaattatgacactctaggaatttctgtatttgtcctttaaggtaattctactcttgggtattataaaatgtttgtcttgtctttatgtttgtttctcttggttctataaattgcatcctcgagtccagaaaa

SEQ ID NO: 97949 - DNA, 371 bp, Homo sapiens
cttggctttctgcggttaggatgcgctggccgaaggctcttctccctcccttgaatgggctctgtggccaaccctggagcatgagaaatgctggctcctcacttgcaggtgggataacagtgacaggagttccctcagggtgtgtgacagctgagtgaagtgacctctgctacctccatctcctcaccttggaggcctgcgtcagagccatgggaggtgagaccctgactgcctcggggggtatttgcctcaggctgggagctgttgcctgaattgagtaggaagttcggatcacctacaccctgatcacctacaccctggtcagcaacagcccatcacctacaccctgatcgtctacaccccatcaccta

SEQ ID NO: 97950 - DNA, 374 bp, Homo sapiens
atttacaaagatgttttctgccactttcctcacctcaaagaacgagtcagctgcagtcctgtactgctgcccaggagactggggaagaggggcccgaagctccttggacatgtggatggtgactccacccccacaggactgcacactgttgggctggttgggggtgtggggctcgggcagagaggagccatctctgcttcctgggctgttatcaatggactgtcaacatgtggcatagagacatgggcgctacaggcgggagggccacggcacacaccaacccacccacagaacagagtggacacaccctggtcagatggggcaggaggggatccttgtagcaaggagagaacaaagtctcaaagtgggggcgc

SEQ ID NO: 97951 - DNA, 499 bp, Homo sapiens
ccttaagtgatccgcctgccttgacctcccaaagtgctgggactacaggcgtgagccaccgcacccagcctccaaagtgttaggattataggtgtgaaacgccatgccctgcccatttcctcttttataacgatgaacatgaaatcgtgatagtagttgctctcctaatcagactatatgtaatatatgggtcattctcatgaggcatttgctggagttaaaatatctgtatatttggcaccaggttagaatgctatttggttaagatgaatggctttgtcctcagcccttccagttgtttaatatagtattataatataagcagaaagaatatatttgctgttttcagtggttaagatgaaagcaaaaggaatataagatttgatatatcagcataaatcagcattggaatggagtccttttagtaaaactgtgatatagataatctgcttaaaacctagtgaaaccactaagttttacgtaagttcaaataaaaaga

SEQ ID NO: 97952 - DNA, 356 bp, Homo sapiens
tattctccttacacactgccagaatcccggtcaaagccaccatccttttatacctgggcctctgcaggagcttccttaattgtcaccctctcttacttttgcccactataacctgttcccatagtagccacgtccatcgtccctcacttaaatgccacaagcactttgcttcatgctttcagtaaaatccaaactccttacctggtccacaaagccctaccgctttctctagcccccttttgtttcctgctaccctaatccaccacttccttcctcattgctgcctctgacttgtcactctcacatgactttatcttcattttttgcacagcatttacccttattgatcttatatt

SEQ ID NO: 97953 - DNA, 816 bp, Homo sapiens
agcggcatttgctttatacttggaagtcttagcaaattaactctcattccatgtgaaaagatatcctgggcttgaaaagaaattcaggtcttgaatttggttgagaagttgggaagtttgagaatttttttttgtggtcaaatggtttagtaagagataagttattattatatagaaactagcccttaggccagacaaggcggctcatgcctgtaattccagcactttttgggaggccaaggcaggtggatcacctgaggccaggagttggagaccagcctggccaatatgatgaaaccccgtctctgctaaaaatacaaaaaattagctgggtgtggtggcggggacctgtaataccagctactcgggaggctgaagcaggagaattgcttgaacccaggaggtggaggttgcagtgagcggagatcacgccattgcattccagcctgggtaacaagagtgaaactctaaaaaaaaaaaaagggaaaagaaaaaagaaacagtccttaaaggacaagtatctttagcactgtctgccatgagaaacattttcttcattttttcccctgagtttaccctgacttaaatactttctgaaagtcatcatcactaatgagaaacaaacaacagaatctgaatcagtatgtgtttttgaaatgtgaaagtgtcttttccttcactttgaaggcccatccttgggtcttcttacctatccaaattctatgcacatctgaagattctccctagttcctttggcttctgtgccatcttccatgactattccaaattctagtcaccccaaataatatctcccca

SEQ ID NO: 97954 - DNA, 429 bp, Homo sapiens
gcaacatatttatttcatctctgaaggtctaaatatcaatgaatttcccatcattgaacaaatattttggggtagctattatgttctagaagagtattgacaaagttatgtcttaatttataggacatttttatgactgaaattagataacccttaaaatagaaaactagacatctgtctttaataagaaatgctaacactaagaataaagggatatagaaacctaagacttccctcacatgataacatcttgctaaaggaaatagaaatcatgtggttaaaaaagaaaaaaaaggaagaaggaaagaaggaggtggtggaggctgtgacccatggtagagacaccacccatgatggttgtgggcattgtgggctacgtggaaacccctcgagacttccggaccttcaagactgtctttgctgagcaca

SEQ ID NO: 97955 - DNA, 414 bp, Homo sapiens
ctttcactaatggatgtaaaaagaagtgaaaggatttgagatgtatcttgagttaccatcaagaaggcttggttactcactacgtcccaaaaggcccaaaaggaatgagttgcaaaggtataaaagaattataaattcagtttgtacatgatgcatctgagatgtccttgaatatgtttatttgtaattttagaggctcagaaagaaaactgggctgaagagataaatttggaagttgccagcatataaatagcaactaaagccttgggagaagaaaagaagagctacaattaagtcattaggaaggctgatgttcaaaggtaaagtggaggtgggtgggcctgcaaagaagacccaggaaagagaccagaccatattaggaaagccaggaaagtgtgacattgggaaaacaag

SEQ ID NO: 97956 - DNA, 444 bp, Homo sapiens
ctgaattgagataaaagcagggtaatatgaaatggcaagggaggaggaaagaaaactagaaaagttgatatcttgaaatattatttttagtctggtttaaaataagccccaaatgatcataaatctttcagaaataacgtatcctttcttgctggaaaacagaaaaataactggagtccttttgtaaatactattgttgatgttatttctcctactgtttttcactttcctctttcacatatattaatttcctcttaccgctccaaaaataataaagataagatctaccgggaaaggacaaatgggaattgatttgtacctcgtaagtattacatgaaaaaaaaaattcttaaatatggctacaaattcttttgaacttgtttgttttgtgttccaatatgtcaaggaatagatatccacatgtaatactaaggtcttgggaga

SEQ ID NO: 97957 - DNA, 266 bp, Homo sapiens
ctcccaggttgaaggaattctcctacctcagcctcctgagtagctgggactacaggcgcccaccatcacgcctggctaattttttgtatttttagcagagatggggtttcactgtgttagccaggatggtctcgagatctcctgacctcgtaatccacctgcctctgcctcccaaaatgtgggggttacaggcgtgagccactgtgcccagcccatgcttggctgatttaaaaatttttttgtagattcagtgtcttactgtgttt

SEQ ID NO: 97958 - DNA, 614 bp, Homo sapiens
ttttgagacagagtctcactctgtctcccaggctggagtgcagtgttgcgatctcagctcactgcagcctccacctcccgggttcaagctattctcctgcctcagcctcccaagtagctgggactacaggcatgtgccaccacacctggctaatttttgtatttttagtagagatggggttttaccacattggccaggcaggtgtcaaacttctgacctcaggtgatccacccatctcagcctcccgaagtgctgggattacaagtgtgagccaccatggccagccacatttttctatgagaacaaagtcatgtgaaaagagtaaagaatctccacatgcgaaaatcaccattttggctaaagtttagaagtattaataattaatttcatagcttaggcaaaatgtccattgttccaaaagtcatcatcaaatattcacactagatacgaatttcagtaattaatcctatttgtaaattaaaaaccaagatttcagcttgaataaatgatgaagatcagccaagcaacgttcacttcttaaaagcgtttgttttgtgaaaaatgcaacaagactccgtctcggtggaaagatgtgctaaatattcatttatctc

SEQ ID NO: 97959 - DNA, 1625 bp, Homo sapiens
acaagacaaggatgtctgatcttgccacttctacttaacaatgcaatagagattctagccagggtaattaattaggcaagataaagaaataaaagatatccagattggaaaggaagaagtaaaactagttcaatttgcagatgatctgatattgtatatagaaaatcttaaggaagacactgaaagaattagaactgctggtaatatggacagtaaaagaaaagaaagcccacaagaactaattgatgagtttagcaagattgcgggatacaagatcaacatacaaacatcaattatatttctatacaccaactatgaacattcaaaataaagcaattacatttataataccatcaaaagaatataaacttaggtataaagaaaaaaagtgaaagacttgtataccaagaactacaaaacgtcactgaaaaaaataaaaaagatctaaataaatggaaagattatccatgtttgtagaccagaagacttaatattgttaaaatagcaatactctccaaattgatttacacatcaacacaataaactatcaaaacccaagctggctttttttttttttttttttggtggcagaaattaagctaaggcaggtgtggaaatcatttactcaaagaatttatatccagaatacagaattgtttcaactcaataattaaaagagagctcagctgtttaacctcattagtcattagagaaataaaaataaaagccacaatgaaatgtcacttcacacccactaagatggttacaatcaaaagatggacaataacaaatgttgacaagatgtggagaaattggaaccctcatacatagctggtaggaacgtaaaactgcagtgactgtgggaaacagtttggcagttcctcaaagttaaacacagaggtaccatataacccagctcaattccactcctaggtatatttctgagaaaactgaaagcacatgtccacacaaatgcatatgaatgttcatagaggcattattcagaagtcaaaaaaatggaagcaacccaaatgtccaactgggggatagacgagtaaaatgtggtagatgtatccacacagtagagtgttactcagtaataaaaaggagtgcggtacttgttcatgtggctacatggatgaactttgaaaacatcatgctaagtggaaaaccagtcacaaaaggccacatattgtatgattccactgatatgaaatatggaacaaaggcaaatttatagagactgaaagattagtagttgattaacgcaggatgcagcagggatacagggaatggggagtgacagctaatgggtggaggattcttttgggagggaccaaaatgccccaaatttgatagtggtgatggctgaataagcctatgaataactaaaaaacactgaaaacactaaactggcgaattgtgtggtatgtgaactatatttcaataaagctgttaaataaaatcacagtattatagtttatattctttgtaattaattagcttaataacttttataattagctaataaaaatcttgagcccaggctgcagtgagccatgactgcaccaccatacttcaccctgggtagcagactgagactctatctctgggaaaaaaaacaa

SEQ ID NO: 97960 - DNA, 434 bp, Homo sapiens
actgcaagtaaaaacttacatagaaaaatacaatggaacaacaggtgagggttaaaatatgggatacatatggtaacctgcagttctagactttcctcagttaacattatcatttccctctttgtcatccaatcatctcaagaacacaagcagtgactctgctgtatctcattctcctgaagggctcactgtggcctctacagctcctactctggccaggggtctctaatatgaaaagaatacaagaatctcgtatatacctttagaaaacagaacatcctctcactcataggtgggaattgaacatgagaacacatggacacatgaaggggaacatcactcactgggacctgttgtggggtggagggagtggggagggatagcattaggagatatagctaatgttaagtgacgagttaacgggtgtagcacac

SEQ ID NO: 97961 - DNA, 422 bp, Homo sapiens
gccacggcactccagcctgggcaatagagccagactccatcttaaaaaaaaaaaaaaaaggagggacaagaggcaccagaagctcctgtccaggtctgggcctcccttgggtcactcagttctcccccattcattcattcattcattcactcactcactcactcactcactcactcattcccacactctgcagccactgacttcagctagccatgctggatgctaagacatagagtcccggccatcaaggccagtccatctcagtggcatctagacatgcacagagatgaccagggagcccttgagggacagagaggcacaccctgcctcctgatcccatctgggggctgcatgaaggaggggcacaggtgtggccttgaaggctgggtaaggggctgggagggctttaggggcattccagg

SEQ ID NO: 97962 - DNA, 296 bp, Homo sapiens
cagaaagaagatggaagaagaaggaaagaaaaggcataatgtaaatataaacgctgtctttatttctggatctagcaaagagttagtttgaaagagcaattgcttataagactacaaggctgatttctcccatccctgcaatgctgaaagtctgtgcccttctaagcaaattctagtttccctgacaattagtctaatggaatgcctggatgtaggaatattgattccgatgacagtacttttacagatggacctgagatatttctgctggttcttcactgacaacacacaacata

SEQ ID NO: 97963 - DNA, 300 bp, Homo sapiens
caccggctgggagagggagtgggcctccaccgacattgttgggagaggtggccttgattatggatgaaaggcctgagtggataactaggcctcttctacatcaccctggtggggaagggaaggagtacttcattacagcctaacaaggtttggagatctaggctttccacttggcctttgctgatgggggtgagggtggggctggagtagaggggctatagtctaaaggctgtctgtcggctggatgcagtggctcatggctgtaatcccagcactctgggaggctgaggcaggcggatc

SEQ ID NO: 97964 - DNA, 580 bp, Homo sapiens
atttgtttgtagaaacagggttttgccatggtgcccaggctggtcttgacctactaacctcaggtgattcaccctcctcggcctcccaaagtgccgggattacaggtgtgagccactgcacccagccacctgcattgttttctaacagcaaaacttgggagcatgctgaatgtatttaataaggaatgaatacaatagaatattgtgctgtcataaaagacagtgaagtaaatggtccatgatgtatatttgtataaatatatattgtttatgctgctgtccatgcttagaaaaaaatatcaagcaaatgacctcagaaattaactgtgtttgtgacctctagagaatgggaagagaggacttaggaggccaggttgcactttatgccctccagtacttttaaaaaattgttttactgagatatggtatatgtatcatgcagttcacccacttaaagtatacagttcaggctgggaatggtggttcacacttgtagtcccagcactttgggaggcccagacgagaggctcacttgaggccgggagttcaagaccagcctaggcaatgtttgcatgtctct

SEQ ID NO: 97965 - DNA, 756 bp, Homo sapiens
agcgggtaaaaactaagatgtcagactcgaagtgtggggtatgactttatctttccctggatctgcatgtggagaggacggagagtgggtgcacacaagccaaatctgagctactatcacactgaagcacacaatggccacgaaaggcatgaggttgaaatccacaaaagaggtgttccctctggcacatgtgtgcaacgacacaaataagatgacattaattaacccccaaggagccaaactcaatatctacaagcgaaaagtggaacaggcaattcaatcctatgaaaagcgcttgaataaaattgtttggcgagcattatctcaagaggaacaaagaaaagttagatgcaaacaaaccaatacagtacttggaaaacaaaacagttttaaaccaggctttagaacggttgaattggcccatttcactgaaagagctgtcgatgctggaaagtgaaatcctagctgggaaaatgtacatccagcaggccatggaactccaggaggctgccaagaagaattatgcaaacaaggccccgggagagcaacagaaattgcaaggaaatccaacaaagaaaaccaaatcaaaaagaccagatcccctcaaaggacagaaggttattgcaagatgtgatgaaaatggcttttattttccaggggttgtgaagaagtgtgtgagccgcacccaagcactggtgggcttcagttacggagacaccaaggtcgtgtccacctccttcatcacgcctgtggggg

SEQ ID NO: 97966 - DNA, 366 bp, Homo sapiens
ctacatgcttcatttgcagtgtaatattggattgtatgagactttgggttttgtgttaatacctacagaaaatgttgatattttctcttagcaggctgtcaaccaggttaggttcaggtcataagtttctacccacattctttgaactgtagttgtcattttagtttatttttcaaaaacttttgcagtacctttttggtctgtcttgtgtgtgccttgcagtgaacagtctggatttggacagtggtctgtctgttagttcagtttctcaagcctttgtcacactaataggattggatttatgtatgtccagcttgggaattattacaggaattaaaaacaactttttagagtgctttcctgagc

SEQ ID NO: 97967 - DNA, 197 bp, Homo sapiens
ctgctgtgcagcccagttcctaacaggccacggactggtatccgtgtatagcctgggagttgagggcccttgctgtatatcagatgttgtaatttactccagatttttcctaaacatatattactgtgtttcactaaattttgttacatgccttctatgtttcagtaaaaagtatattattgctattgctattgctg

SEQ ID NO: 97968 - DNA, 920 bp, Homo sapiens
aataactaataccgtttccgcacccgacgcccgagccagcgagtcataagcaggtcatgaattaccctccctaaaggaacggcccgatctatctttattgtactgagttcatacaagtcaatttaaaaatctattaagttctaataaataagtgaacagaagttcacgtcacaaaatatagtaaacaaatagatggaaaaactttagttttgctaacaataaagaaatgtgaagttaagataagggcatcttcctttttcctcatttatgtttgccaaaaaatttaaaagcatgatacttattatgagtatggattcagtgaaattggtactgggatggccactctgggtcctatgcttttggcaggcagcctggtgttttaaaaaggcttttgaatggcaacagactttaccattatattctacagaaatggtaaataagccatgatttttattttatatattcagatatacgtgtgaatgttaattgctttgtgccttcgctgtttttagaacagccttctttcataccttactggtgatgtattaatagcaccattttggaatgcagtttggtatagtatgtttcaagaatcataggattcttgtctttttttgaattccgagtcccatttctgagattctctactaaggaagtaataaaaagtatagtaacaactatatccttaaaaatggcctatataacaaataaatagactctaaatgccctattaaaggaaagtggagccaggtatgattacttgcatgcctgtaatctcagctacttggggggctgaggtgggaggattgcttgaacccaggagttaagagagccaccgccctttaagttgagatgggggggacaaaccacttgctggttacgaatttactgggaagggcgttatggacaaaaaatcactg

SEQ ID NO: 97969 - DNA, 551 bp, Homo sapiens
atatgtgagcattaagtgatagaaagcacataaagcacttagcagagaccctcagtaattgagccttgtggtcacattgtcgtcatcatcatcatcatcatcatcaccatcatagcaatcgacatcataccaatcatcattgtcgagcaaagtggacaggacattccacagggagggacttgaggagtggagcacccaggaggcagccagcttgcctgtgatttccacgggaccaactcacctgagctattctcagctaaagtctgcgatcctgataacagacttcagtggcttctggggagtgttgtagcaggaatgatcagccccttgccctcatcggtcggctctgttcggattggctgcattaacccatactgcccagtggtctggctgtgcatttcctcctccaacagtggggacgctcactctggaacccagtctccagaatgcatcagtggagaacccctgcatctacagaccctgaaagcagatcctcctcgtggctgcatttctcttgaagagagctcataaagacacccagcagccacagt

SEQ ID NO: 97970 - DNA, 189 bp, Homo sapiens
tttcatttggttcagcctaactctttgtatagtgtcagaaatactgtggcatataatgaaacatcctaggataggatggtcaaaatacaaggaagattctctcaggttgtgttatgttattaagataaaaactatatttatattttaatagatttctgacatttagtgacattaaaaatgcagggtaag

SEQ ID NO: 97971 - DNA, 338 bp, Homo sapiens
gcatgtgccaccacgcccggctaattttgtatttttagtagagacggggtttctccatgttggtcaggctagtcttgaactcccaacctcaggtgatccacctgccttggcctgccaaaagtgctgggattacaggagtgagccaccatgcccggcccagaaaatacaactttctactggctactgctttttgtggtaccagtcctaggaatgttttactaatttatgtgcaattcatgttaccttagatgatgggaaggatcttcctttttcctcatagatgcctttacgtcttggttcaggaaatgattgtacaattaaaaatgaattgcttgttg

SEQ ID NO: 97972 - DNA, 505 bp, Homo sapiens
acatataagatcatgtcactgacaaacagaacttggttctgtgttttagtttctatttctttgttaatgttctaattttgttcatgtatcattttcttgattgtttagctttctgtctgtatcctctgatacttcattcagcttctttaaaacaattattttgaattgtttgtcaggtaattgatacatcatcttttctttcaggtgggtttttgagatttattttgttctttcggttgggtcatttttacctatttctttgtacgtggtattattttctggaatttgtgcacttgaaaaaacagccacctctctcaattttcatggtctggattcttatagggaaaacccttcaccaatcatcttgattagagagcctgagggtctctcaagctttttctgggaatcatgcatataatttcccaatgggagaagtttcttgttttatcaggaacttgtaatttcttgctccctcttgtgtatatctgcagtactgcaagtgctc

SEQ ID NO: 97973 - DNA, 494 bp, Homo sapiens
acaatatatgtggctaaccctcagttcatgaggtgaagtttaattctgtcctctacctcctaagaacagggctgacttagtgacttacttctacagaaaagagtataggaatgtaaaatagttaccacacactggagaaatttggcaaacagtaccttaaccaagtgatgaaggttaacatcaccattgatatcatatgggtagcatgtaaacccatatatggtgtgataaaaagggcaattcatctctgcggtattccttctgaaaacccataacctcagtctaataatgagaaaaacaagttatgcctgtacttctcatgaaatcaagcttatgaaaatagtctggccatacctcaaatggttaacagggagttaccatatgacacagcaattccacccctaggtacatagccaaaagaaatatgcctacataaaaacttgtacctgaatgtatacaggatcatcattcaaaatagccaaagagtggaaaca

SEQ ID NO: 97974 - DNA, 552 bp, Homo sapiens
tgtcatgagcacccctatggggagacccatgtggccagaaactgaagtctcctgctggctgccatgtgagtgaagttgggagtggatcctccagccccagtgaagccctcagatgagactgcagccccaggcaacagcttgactgcaacctcatgagagacctaatgagcagctaagccactcttggattcctgacccccagaaactgcatgagatagtaaatgtttattgctttaagatgttatgttttgggataatttgttacattgcaataaataaccaatacgtggtgctatcaagttagtgtaattataataacagaggtactcaaacttggaaactgctaagcaaattatgatatattatcttgatgaactcatggatattgttaaaattacaagcatttttgtgttttctctaagcatgtgtgtacaaaatggcttgaaaaaacagagtgcagatacatgcactaattaaacaatatagaaagtatgcatgtatgcattttcttaaagatcactgaaaatttggaattaaataaatagctaccct

SEQ ID NO: 97975 - DNA, 347 bp, Homo sapiens
ggttcatttatttattattccacttggaaataattttggggagagtcaaaggtcagcctttgattagagtgaaatttccttcactgacaggtcactggaagtatttgcaggaaatggaattatgggaaaagtccttctagggtgacataactgtgggtgggtcatttcaaaattggtgtcatcattcattctgtcatggttagtgaggaggtggttggcagagagccatgtcccattcctgactctcatccaaaccctcccccacaccctaccaccactccctgttccggaaaaggaagtggagcacagtccccgtaggaccgtctaactctgagccagactaacag

SEQ ID NO: 97976 - DNA, 448 bp, Homo sapiens
ggtctgggtgtttgtgttatcccaaaatttatatgttgaaagaaattctgacctacaaggtgatggaattaggagatggggcttttggggaggtggttaggtcaggaaaggaaagccctcatgaatgagagtagtacccttataaaagaggccctagaaggcttgttgattccttccacaatctgtgaacctgtaagtgccttgatctctaaattcttagcctccataactatgagagataaatttctcgtctgtgtgtggtgactcacatctgtaatcccagcactttgggaggcagaggcaggcagatcatgaggtcaagagttcaagaccagtctggccaacatagtgaaaccctgtctctattataagtacaaaaattagccaagtgtggtggtgtgcacctgtaatcccagctacttgggaggctgaatcaggagaattgcat

SEQ ID NO: 97977 - DNA, 580 bp, Homo sapiens
tgagaattggcatgttaagcagcgtcaggtttctcagctcaaagctggggcagagctattgatgttctttcagagagcatccagcactggctcagcaatcaataatttgacatgaaactctccagtttgcttctgagagtgacccaatttgcaatgctaaaactgggtgtttaccattactagtgcagacaatgtccctatgccagtggttctcaaagctcagtccccagaccagcagcataagcatcacctggaaacttgttagaatgcaaattctcaggctcgacctaccgcgacccactgaatcaaattctgcaaagtgtgattcacccagagttgaaatcatccagagagcttttaaaattcccaatgctcggccaggcgtggtggctcacgcctgtaatcccagcactttgggaggccgaggcgggcacgtcacaaggtcaggagatcgagactgtcctggctaacatggtgaaaccccgtctttactaaaaacacaaaaaattagccgggcgtggtggcgggtgcctgtagtcccagctactcaggaggctgaggcaggcgaatggcgtgaatc

SEQ ID NO: 97978 - DNA, 476 bp, Homo sapiens
tgctccagtagaaacctgtcagatgtttatctagctccctcgcattagctgagctgcttggtatctgccaggtggacaggagggctggcatcccttccaatctgcagctcggctttggcctccacgccccagtgtccagagagcagctgagggcagagagaggagggggctgggctggtcagggctcagagccaagtcttagaagtgacacctgagagctcaggaaatcagcctctcctgaagctcagggtcacgggtagggggagaatggctgccatggagatggggcaggcttggcctcagctttccatgtcccacctcatgtttccttcagaaccgtgcacatgacccgcctctctgaaaaggtaaccagcatcactgagctaccatcaatccaggccccatgggcctccagaacttgacggtcattctaggtcaggaatccttctctctattgaatgagctttctcttttca

SEQ ID NO: 97979 - DNA, 737 bp, Homo sapiens
aggccccagaaagctttgagctgctttgggggaaaaaaaaaatcaagaaacagagttaacccatttggaaactacaatacactctgagagaccctcagcatcacaggacaggaacatcatcttcctctctgtgttcccagagtacaggatgatacaagagcttgggaacagaattcatgtaatcaaaccactctacccaatcaacagctaagggcatcatacatgctttgaagaacataaccaagactgacttgattcaggtaatctgaacaaactgttaaaacatccacactggcctggttatatctttatacacacacacatacacacacacacacacacacgactgggaaatatgctgagattagagcaaaacagcaagacagacaggagtctggcttccaatggggtacctatttataaacgaatttacgatagtgggctagtatttagtaaaggttatataagtgcctaatttagaaaaatacaacccaggccatgctggctattagtcaactctgaaaaagttatttatggccctgagcctgagttttcttatctctgacaacgtgggataatactccttatttcacagggttatggccaggagtaaaactgtgaaatctaaaaagtatttagcagagaggttttcaggacattacaggcttacttggtttatggtgcttggcttaatggtgcttggagatatgtgtgtgtgtgttgttacattgaaggtg

SEQ ID NO: 97980 - DNA, 747 bp, Homo sapiens
ggagatatagcccagtacatagatggtacaggaaaaagcttcctagtcttagaggtagaggcatccttcagagggacccgctgaagtcccttcctgcagtaaaacttcattccctgttaaatgccaatttaggattccaggtgccagacaagtcacaggccaggccttcttaggtataacttactccttctgctgtgggtgttggaattgtgagcccagctttggcaaaatatccttagattttcccaaagtttgcaaaatcaggcaatgcccctttggccttttcctcactcctgtccctctctccagtggctgccgggactggggaaactgttttttaaatctggattaaaggttggagggttgggggcctgacctgtttcatcttatacctggagttaagcttctaaaagaagggtgcatctaaaagaagggtctttccaatggtctaattaacacttatcaccaaaatcgcatttttaattagcccttggtgtcaataggggaaacagaagagcttcttggaaatctagcttttcattaatcaatcaataaataagttacataagaggtatgaaagagaaccaaggaggcatggggggggctgggctgagtttctaatctaggggcttttttgcttccaaagggagcccgtgagccggccacttctgctaagccacaggggagggagggcagacccagccgccaaccctggcgcctttatctgtgcactgcgagcgagcggag

SEQ ID NO: 97981 - DNA, 257 bp, Homo sapiens
cagagatcgcgccactgcactccagcctgggtgacagagcaagactctgtctcaaaaaaaaaaaaaaaaaaaaagagtgttcacagcaagcagcattatgtgttatagtcagaaactggaaacaggccaggcacggtggctcatgcctgtaatcctagcactttgagaacctcagataggaagatcgcttgaggccaggagttcgagaccagcctggggaacatagcaagaccctgtcttcacaaaaaataaagaca

SEQ ID NO: 97982 - DNA, 441 bp, Homo sapiens
ctacctgtaatattataggattagaatgggaaaagattattttcatattacacacatgaagtttatataagtttatatcttataaataacattttaaaaaactgatgaagtacaaaaaaacaaaactcttctcagccccaccccagatcaacttaattagaatctgcacacagtaagatccacaaatgttttaaaagctactcaaaatttagaatatatgaagaactcataaattattaagaaaaagacaaacaaccaaaatgtttctatatgaagtaaaagaaagtgaacattctgtaaaagaagctatccaggctgggcacggtggctcacgactataatcccagcactttggaaggtcaaggagggtggacagcttgggctcaggagtttgagaccagcctgggcaacatggcaaaaccccatctctacaaaacaaaa

SEQ ID NO: 97983 - DNA, 170 bp, Homo sapiens
gcgatagagcaagaccctgtctctcaaaaaaataaaataaatttgagtagtgtaagctatgtaaacttggataatccggttaccttcattctttaatttttccatagcatatatttggcttcaatgtccaggttttcgagcacgagaaatctgcattttcattctaagaa

SEQ ID NO: 97984 - DNA, 945 bp, Homo sapiens
ttaacacttagccttaacggtttaagttcccctccagccccgagccaggagcagttctcaataccgggagaggcacagagctatttcagccacatgaaaagcatcggaattgagatcgcagctcagaggacaccgggcgccccttccaccttccaaggagctttgtattcttgcatctggctgcctgggacttcccttaggcagtaaacaaatacataaagcagggataagactgcatgaatatgtcgaaacagccagtttccaatgttagagccatccaggcaaatatcaatattccaatgggagcctttcggccaggagcaggtcaaccccccagaagaaaagaatgtactcctgaagtggaggagggtgttcctcccacctcggatgaggagaagaagccaattccaggagcgaagaaacttccaggacctgcagtcaatctatcggaaatccagaatattaaaagtgaactaaaatatgtccccaaagctgaacagtagtaggaagaaaaaaggattgatgtgaagaaataaagaggcagaagatggattcaatagctcactaaaattttatatatttgtatgatgattgtgaacctcctgaatgcctgagactctagcagaaatggcctgtttgtacatttatatctcttccttctagttggctgtatttcttactttatcttcatttttggcacctcacagaacaaattagcccataaattcaacacctggagggtgtggttttgaggagggatatgattttatggagaatgatatggcaatgtgcctaacgattttgatgaaaagtttcccaagctacttcctacagtattttggtcaatatttggaatgcgttttagttcttcaccttttaaattatgtcactaaactttgtatgagttcaaataaatatttgactaaatgtaaaatgtgaaaaaga

SEQ ID NO: 97985 - DNA, 1047 bp, Homo sapiens
ttaacacttagccttaacggtttaagttcccctccagccccgagccaggagcagttctcaataccgggagaggcacagagctatttcagccacatgaaaagcatcggaattgagatcgcagctcagaggacaccgggcgccccttccaccttccaaggagctttgtattcttgcatctggctgcctgggacttcccttaggcagtaaacaaatacataaagcagggataagactgcatgaatatgtcgaaacagccagtttccaatgttagagccatccaggcaaatatcaatattccaatgggagcctttcggccaggagcaggtcaaccccccagaagaaaagaatgtactcctgaagtggaggagggtgttcctcccacctcggatgaggagaagaagccaattccaggagcgaagaaacttccaggacctgcagtcaatctatcggaaatccagaatattaaaagtgaactaaaatatgtccccaaagctgaacagtagtaggaagaaaaaagtggtaaaagaactcagtgatatcaaagaattgaagaggaacaaaataagtatcaaagtggtaatgacgcatcaattacaagaaaaagaaatgattagcaaaggattgatgtgaagaaataaagaggcagaagatggattcaatagctcactaaaattttatatatttgtatgatgattgtgaacctcctgaatgcctgagactctagcagaaatggcctgtttgtacatttatatctcttccttctagttggctgtatttcttactttatcttcatttttggcacctcacagaacaaattagcccataaattcaacacctggagggtgtggttttgaggagggatatgattttatggagaatgatatggcaatgtgcctaacgattttgatgaaaagtttcccaagctacttcctacagtattttggtcaatatttggaatgcgttttagttcttcaccttttaaattatgtcactaaactttgtatgagttcaaataaatatttgactaaatgtaaaatgtgaaaaaga

SEQ ID NO: 97986 - DNA, 264 bp, Homo sapiens
cctctttgattagaacagccataggggaagagtggaggaagtaagtaagtgcttcattcttggatgaatatatgcataaacatacctgaaagaaaacatctagtcagctgggggtatgtatacccttgaaaatacagcaccaggccaggcatggtggctcaattctgtgacctcaacactttgggaggcttaggtgggaggatagcttgagcccgggagtttgagatcagcctgggcagcatggtgaggccccatctctataag

SEQ ID NO: 97987 - DNA, 309 bp, Homo sapiens
ctacttgggagaccgaggcaggagggttacttgtgcccaaaagttgaagctagtctgggcaacatagcaagacgccatctccaaaaatatattgcatgagccaataaattcactattgaaacaataaaacagataacgtcaaaaccggttacatgaccttttgtcagctcatgactctattgtgcatttaaaattgctataaattatttgttttccttcacatttaattttctaaaatttctccccatgttaaatcatagtatcttcctaactattcagtatttggctttgttgggctttgttgttgtt

SEQ ID NO: 97988 - DNA, 1075 bp, Homo sapiens
caaagatcttgaaagcaccaggtagagaaagatgtagccattgtcaaaagactgcctgttagatgaatgggacagtgggatgaccaccctgggttcagtggtaaagtcaaatggagtaaaggatgcctgttgccaccccagctgcacttgggtgctgaagatcagaagtgaaactacagaacaaatccagatgagagctcacctaggggctcacacatatagttcaggccaaggttcagtgatggaccatcatcagtactcagagcactgaacttgtcctgggtgtgatgtatttgagagtcacttaaaatcatcatatcgctgccattttggccacccaatctcataggattctgtgaaataaatatggcactgggcagcaggagcaattcacttgtcaggaatccctcctggaatcagggcttggccaaggacttcaagccaaccacccaaggcatgaatcccagaactcctgggggcatctggcaacttcatgtgcagaatatatcttctctgacctagtgtggctgatgatgagaggtctgatgctggttgaagttcttggttttcacaggtatcttttacatttctatctttcctgctaaaccttctcagtatcttctattatggatgtattgaagttttatagtgatgggtctagatgtgtgtgtgtatgtctgcatgtgtatgcacatatgtgagttgtcaacttgagcacttgggtacttgattggcttcttaatttggatactcatgtcctttgactctgggacaatcctttgcgataattctttgatttctttctttttgtttttctctttttgtcactcctattgatcagatgtggggcctcttggactgatcctcaacacatcttacctttctcattttcttacatcttcttgcctttgttctacaacattggttttattatattttacctactattagaatttcgggctcatatatttatttttcaatagtttttccttgttagctagttgtactttgttgatgcaatatttttttttactactctttctaagaatatttattaaagagtttttaaaggtta

SEQ ID NO: 97989 - DNA, 298 bp, Homo sapiens
aaatcacaaatagcatatatccgttttatctttaatagtgtttgagcccatcatttgaaagcattggagcatgtaaccaatatttctgaaaatgaaccatggttccagtcataatctatatgctttaaaattccttccctttattctttcttcccaaatccatgacatctgaatttcaataaggaagaaaataagcatgtttttaaaatgttttagaaaagattttcaaaattagattaaaatgtttgaggaaataaaaacttctttatgtattcattgtgatactgatttttatcaa

SEQ ID NO: 97990 - DNA, 589 bp, Homo sapiens
ctagatttgacatttttcatactattataaattatataatttaaaaatatttattttctctctttatgttgctggcatacagaagtacaattgaaatttgtatattgaccttgaatgaagcaatcttgctaaatttactaatcacttagatttttctagattttttaggtacacaattatagtatctgcaaataataacagatttttttctttctctccaatttatttatatttgccctactccccccagttttactgtctaggactccagtatagtgttgaacagaaattgtgataataggtatccttgtcttttttccaacttcatagaaaaaattcccaatatttcataaatgagtattagttagctaggaccacaggtgtccaccatcttgcctggctaatttttgtattttctgtagagacagggtttcaccatattgcccctactggttttgaactcctgagctcaagtgatccaccagcctcagcttcccaaagtgctggctgggattacaggcatgagccaccactcctagcttgtagttagtcttttggttaagttcatctttttgtctttctattcaag

SEQ ID NO: 97991 - DNA, 146 bp, Homo sapiens
tcatttctggtaacatgcctaaaactgacagatcccaaattatgcatgtacctgcaatttgttaggattttgtttgttttttgtttttttgagacagtctcactctgtctgcactccaagctgtagtgcagtggcctgacctcggt

SEQ ID NO: 97992 - DNA, 887 bp, Homo sapiens
agtgttccaggtagaagtagcgtaagagggttccaaatgattcaatttgaccaatgtttgatgtgtgtttatagtgtggcaaggctgggcatggtggctcaccagcactttgggaggccgaggtgagcagatcacttgaggtcaggagttcgagatcagcctggccaacatggtgaaacctcatctctactaaaaattaaaaaaaaaaaaagcctggtgtcgtggcaggtgcctgttaagtcccagctactccaaagactgaggcaggagaattgtttgaacctaagaggcagaggatgcagtgagccaagatcatgctagtacacttcagcctgcacgacagagcgagactccatctcaaaaaaagaaaagtaaatatagtatgacaaaatgatttaaataatatttcaaacattgcagcaaaataatttaaatatttccatcaaagtttattaattatgaaggcttgagaatagtgcataaaaatgactgcttgttcctaatttatagataggacttctaaggcagtttatgccctattttgaagatctatatcaacattccctttatgaatttaaatttttaaaattggaatttatatgcggtattagcgtaaaataggattcttctttaagaggtgaggtcttagccaggcacggtgactcacgcctgtaatcccagcactttgggaggctgaggcaggcggatcacgaggtcaagagatcaagaccatcctggctaacacagtgaaaccccgtctctactaaaaatacaaaaaaattagccgagcgcggtggcaagtgcttgtagtcccagctactggggaggctgaggcaggagaatggcgtgaacctgggaggcggaggttgcagtgagccgagatcgtg

SEQ ID NO: 97993 - DNA, 492 bp, Homo sapiens
ttctgtgtgagagatagaagactgagtgaaatattcatccagtatttaagtagagcttgtttatttagctactattatagccaggcattgggcgaggttctgacaggggaaggggagtgagatacaaagttgatgaggccgggctggtggctcacatctgtaatcccagcactttgggaagccaaagctggaggattgcttgaggccaggagttcaagaccagcctggtcaatcctgtccctacaaaaaaaaaaaaaatgtttttttcattagctgggcatggtggcacacacgtgtagtcccagctacttgggaggatcagttgaggccaggagttcaaggctgcagtgagcttgatcataccactacactacagccagggagacagagtgagacctgtgtctaaaaagaacaaaaacaaaacaaagcaaaaagatgaccatgatacaagcccagactttgaagaaattgcaatctggcaggaaagggtca

SEQ ID NO: 97994 - DNA, 299 bp, Homo sapiens
attgtcttcacgttgaggaggctaaggaggaggaggaaggggaggggttggtcttgctatctcagggatggcagaggcagaagcataatctgagtataagtggacccgtgcagtttaaatgtgtgttgttcaagggtcagctgtttgttgaataaatgaatgacatgaagtattacagtggcttttgggcggtgtcgaaacttctttgtaaggattttaaggatgaaataatcacttaactgtctggaatgaacactcagataaactgagtcctccagctttctcatcagatggcttgt

SEQ ID NO: 97995 - DNA, 656 bp, Homo sapiens
  misc_feature (214)..(214): n is a, c, g, or t
  misc_feature (532)..(532): n is a, c, g, or t
  misc_feature (542)..(542): n is a, c, g, or t
agcagggctaggggaggatggcgaggagatgggtaggagagacctggtgtctggaggaagcaatgaaggaaatgggaaggaagactgggccatgaaaacagatagcgatgaggcgatgtcaggcctgttgcctgtggtggggcaatgattagcatgataacacgagttggccactatggggagcatgattaacggcctgaggatcgaggctgcnacgcctgcgcaggtgcatgggcacccagcctagggggttgaaccgagtagcatgtcagatgcgccatagtccgtggacgatccgtgggtagtacatcacgtatctgcggagagttctacgttgcgtcagtgtgatgaacagtaccatagtgtaggacaaacttgggcagatcggaggcactagaagtgggtgctcacgagtttctgtcgacactgccaagaatgattcacttatgcacgtggttgagacccatacacgacgctgagcctcgcccgtgtctgtaaacggcttgcgtaggaccatattccggtgctgagnggcccacatngcccatgcgccgtgtttgaggtctaatctcacgttacacacattggacctgttccttacatgttgaacccaatcgcttccacaaactccgccgggttgcccctatgcgaacttc

SEQ ID NO: 97996 - DNA, 297 bp, Homo sapiens
aaaggatccagcatttggaggcatacatgaaactccatcctctccaatttcagggcaaccatgtggagatgatcaaaatgcttcaccttcaaaactttcaaaggaagagttaatacagagtatggatcgtgtaaatcgagaaattgcaaaagtacaacaccagatccttaaactgaaaaagaaacaagtaaatgtctttgcttaatatattctaagaatgtgtgtttttctccctacagaagatatttttgagttttccatattttgaaactttacataaaaggaatcatgccttat

SEQ ID NO: 97997 - DNA, 336 bp, Homo sapiens
aggatttctttggaaatgagatatcttcaaataaaagttacagagaagcattctcagaaactgcattgtgatgtgtgaatacaactcagacagttgaacacttctttagaaagagcagttttgaaacactctttctacaatttgcaagtgttcatttggagcactttgaggcctatgggggaaaaggaaatatcttcccataaaaactaggcagaagcattctcagaaacttgtttgtgaggtatgcattcaactcacggagttgaaccttccttttgagagagcagttttcaaacagtctttctgaagaaactgcaagtggatatttggagtgat

SEQ ID NO: 97998 - DNA, 187 bp, Homo sapiens
tggccactggcacacatggctattgagaacctagggtatggttaagccaaatgagttgtgtcatatacgtaaaatatgttctaaaatttgagagacttagtattaaaaaaaagaatgtaaactaccccactaatgatgttttaatattaactacatactcaagtaattttttttttttttttttgag

SEQ ID NO: 97999 - DNA, 405 bp, Homo sapiens
tctccccatgctcaggtgatcctcctgcctcacctcttgagtagcagggaccacaggtgcatgccacatgccaccatacccagctaattcctgtatattttttttgtgtgtgtgtagagatggggtctccctatcttgcccaggctggtctcgacctcctggactcaagcgatctgcctgcctcctcctcctagaatgctgcgacaatcagcgtgggacaccatgcctggcgtatttttaaaatctttctgaatttataaaactacctgctctggtctgaatgtttgtgtcccctgcccctaatccctatgttgaaatcctaatccccaagttgagggtgttaggaggtggcggctgtgggaggtgaagaggtcatgagtgtgacgtcctcccgaatgggattag

SEQ ID NO: 98000 - DNA, 269 bp, Homo sapiens
tgattgaaatttaaaaacaaaaggatgcctgtacctttggtgattgagacatttctgttggcttttgggaccccaactcacaggactgggcagaagtcaggctgcaacatacagagaacttaatggaagtgagcaggcagccgaagtaacccaggctttctcatctcaagaagctcttccattgccaagaacagagggcaagttgatgtcactacaaaagtgatttttaaagaaagtcaaaccgcttaaagactgcttcttatttaggc

SEQ ID NO: 98001 - DNA, 511 bp, Homo sapiens
ttgctgacagttccctaactatagcaatgcaagtgtgctgcattaatacaatattaacctcaaggatagaagatttcaagccatagtatattgatcaaaggattgaacacaaagaatacatttttattttgataatttcttgcctggagaggtctttgaaaaagtgacaaccagaagcagaaccacatgatagcattggtattaactaaaaacaaaactttttagtattgtggaatttcataagcctttgatgtatatctttatccatcttggctattttttaagctctttaggacacaaagcatcataggctctgtgtgtgtgtgtgtgtgtgtgtgtgtgtgtgtgtgtgtgtgttttaagtagatatgatattatccctcagagaccttacttttaaaaataggttaatgcatgagataccacaatctaaatgtgatcaaataaggttatcattaatatgttttctgagacatttagggttggggcagagaactgaagaggtgagttt

SEQ ID NO: 98002 - DNA, 483 bp, Homo sapiens
gatgaaccagttgtggaaatttgcatgatgctggaacaggtgatcaggttgcaaagatcaggtaaggtgggttttgtaggttattgttgagtcaggtaattaaataaaaatctgatgaaagaggaatcaaatagccattaacacccttcctattttttgaagagggaacagcattatgcatgttgggttttgaagctcatgtgatagaagactgaaattatgtcttgacagaaccccttttttcctaaattctttggcaatttattgagtgcacgaactcaatacaggtactatgagagcagaaagtgttcttgcctgtggcttgtagtagtggttagtggtgggctttatattaccttttagtgtctctgcttcatggcttaacttcactaagcaagaggtgctccagtgtaaatgagaataatagttactacatcctaacattactgtaagaattaaacaaaatgaatttatggatgtcac

SEQ ID NO: 98003 - DNA, 464 bp, Homo sapiens
  misc_feature (429)..(429): n is a, c, g, or t
gaagcagaggaaatgggaacagcaagggcttgctgatgggatggcctctttaagggaggaagaagtaaagaagtaagaaataagcctaggccgggcgcggtggctcacgcctgtaatcccagcactttgggaggccgaggtgggcggatcatgaggtcaggagatcgagaccatcctggctaacatagtgaaaccccatctctactaaaaatacaaaaaattagccaggcgtagtggcgggcgcctgtagtcccagctactcgggaggctgaggcagaaaatagattcgtgtctgtttaacagtaacccaaataagaagccatgttaaatagagacaacttttattacaatccttatagcataccttccttttaacattatttttatgatttagctccctccaataggaaatgttgggccagccactgntttggtgcttgatatacttatggcttgttccgctg

SEQ ID NO: 98004 - DNA, 719 bp, Homo sapiens
agcctttggctgagttggcagccaaggagaactcgccaacctcgctgtgctgccaagacctgacttgacactactgctcccctttgcccgttacccgtgaaagctttgctccacagcgccccctgcagggggctggcagggcagctggctgcctgcccttggcccgttccttggctgccccggcttctgcacttacccttggtcctggaccaactccaagaattcagtgactttacactggcttttcttagagcctcttggagacaacatcctaagatactgcagaccctgtgttttgtttttggttttgaaggccctctgagggccctcaaatggaccctgaggaaatggatacctgagcaggacaaggaccttggagtcacagaggttctcgataattagagaaaggggcctgatgatactgggggtgcacagatcacatttaggtccttgagggtcaatggaggcctctcttctgtcgtgcccaagtctgggcctctgcagagagacctccatgcccagaaatcagaagtcagattgaacaagaaatcccagcctttctaggtgagctcctgcccccaaaatgctgtctccagctcacacagcaccacaggaggtttcccgccactgaagaggaggagggggccagcctcattcctctcccggctgcccctccggagctcaaagacagtgagtgaggagggaccctggtctccctc

SEQ ID NO: 98005 - DNA, 520 bp, Homo sapiens
tactaacttagtcttctcctctcctctgtctacccttagcaatatataggtaaacatatccagcttgtctaacacatcacagattattagttaacaaggtgtagattaatgagcttatattgtattgctggatcttttgagttaataacaatggtaacttgtccagaaggcctatcatcattcctagtaggtgggcacagagtaagagatattaagaagcttcctgatgagtcatcatctagcgaaggccctgtgtagggctttattataggagttacattgacttctggggcattcaaaggtctcccctcttatccatatctctgtcattttgcttctccagccacgacaacacactttcctctccaactgctccctccccaccaaaaaagaagaccctctaaaaggcaaaggaataaatattcttagaagtaaattatcttcatcccatgctgcctttttcaaagaggtgttaggatatttatcctatttctgtatttcacagtagcttttcaggctg

SEQ ID NO: 98006 - DNA, 546 bp, Homo sapiens
cgtgtagatgctgtcctccatccctgagtgtcatccgtgtagatgctgtcctccatccctgagtgtcatccctgagtgtacaaaggtatcatgcctttgttatgtctgccctcagtgtagtaacttaattaatggcctttcacttttggtagtcaatgtggcattgattcaaccagagaagaaataagagaaaatgatagggaaatacagatctgatgtaccatacaatgataaatgttcaaattataactcctgtacataacacagttacatccctgactctacatatctttgggctagatggttttgttatttctgttgttactttttccattattattttcattatgactactagcacaattttactaacactttcctatggtaatgaccattagaattcttaatatttttcatagcatacctgtttgttttggttctagattttatcttaaggatatagtcaagtacataatctcactatttagttctaaaatcagaatacgacacattgtatgtgagtaccttgactttccccagtggtat

SEQ ID NO: 98007 - DNA, 430 bp, Homo sapiens
atggaagatactaagagcctcagtctggaagcatttacctaggaagcgcatatagacagagaagatcaaggactgaggcctgagacagtcagcacttaaagggtgagcaggagaagtgccaaggagacaaggtgagaacagcagaagagtagccaaggcccaggatgttgccacagaagccaggagaggtgagcatgaaaacagaggaggaccagctgctgggacagaagagccatatggaagagctagcagcgtggaagtgactttcaagagcatcttccatggcatcatggaacaggtacctgactggagaggttggaagggctaagggagctgagtgagcaggggcagtgggtacagaccactcggtggagaaattcagacatgaaggggaacaccaacttacaaagtccctggaagaagttccggg

SEQ ID NO: 98008 - DNA, 615 bp, Homo sapiens
atggggacattcaaacagccttatggagagggacacatgatatgaacttaaagcctcctgccagtggtcaatgccaaattaccaaggcactagtgagcagatccttcagccccaggtctgctggagtttgctggaggtccactccagaccctgtttccctgggtatcatcagcgggagctgcagaacagcgaagattgctgcctgctccttcctctggaagcttcatcccaaaggggcacctgccaagatgccagctggagctctcctgtatgaggtgtctttcaacccctgctgggagttgtctcccagacaggaggcatgggggtcagggacccacttgaggggcagtctgtcccttagcagagcctgagccctgtcctgggacatccgcctctctcctcagacctggcaggcaggaacgtttaagtctgatgaagctgcacccatagctgctccttcccccaggtgctctgtcccagggagatgggagttttatctgtaagaccctgactggggctgctgcctttctttcagaaatgccctgcccagagaggaggaatctagagaggcagtctggctacagcgactttgccacattgcagtgggttccacac

SEQ ID NO: 98009 - DNA, 2361 bp, Homo sapiens
actctagaggactcttcgcggtatcataatgtagaatctcgacgctgtactcgaggctcagcgttctcaagcagtccaagaccttgaaaattaggcaggcaccagagagaagcactgaaaaatcccattggatttgtggaaaaactccagaagaaggctgatattgggcttccatatccacagagagttgttcaattgcctgagatcgtatgggaccaatatacccatagccttgggaattttgaaagagaatttaaaaatcgtaaaagacatactagaagagttaagctagtttttgataaagtaggtttacctgctagaccaaaaagtcctttagatcctaagaaggatggagagtccctttcatattctatgttgcctttgagtgatggtccagaaggctcaagcagtcgtcctcagatgataagaggacgcttgtgtgatgataccaaacctgaaacatttaaccagttgtggactgttgaagaacagaaaaagctggaacagctactcatcaaataccctcctgaagaagtagaatctcgacgctggcagaagatagcagatgaattgggcaacaggacagcaaaacaggttgccagccgagtacagaagtatttcataaagctaactaaagctggcattccagtaccaggcagaacaccaaacttatatatatactccaaaaagtcttcaacaagcagacgacagcaccctcttaataagcatctctttaagccttccactttcatgacttcacatgaaccgccagtgtatatggatgaagatgatgaccgatcttgttttcatagccacatgaacactgctgttgaagatgcatcagatgacgaaagtattcctatcatgtataggaatttacctgaatataaagaactattacagtttaaaaagttaaagaagcagaaacttcagcaaatgcaagctgaaagtggatttgtgcaacatgtgggctttaagtgtgataactgtggcatagaacccatccagggtgttcggtggcattgccaggattgtcctccagaaatgtctttggatttctgtgattcttgttcagactgtctacatgaaacagatattcacaaggaagatcaccaattagaacctatttataggtcagagacattcttagacagagactactgtgtgtctcagggcaccagttacaattaccttgacccaaactactttccagcaaacagatgacatggaagagaacatcatttactagtcctcttcaacacatagcaatggtatcattgttaattatgtgcacagtttggaaagattctctgctttcccagaaatgacactcacagcatgagagcttcctgagtgttctcgtcaagtacagctctgcaccgttgtggctctagatcactgttcagcagctgaacattcctggtgagcaaaggtttccctggtgaatttttcaccactgcgttttaggtggtgatcttaaatgggtgagatggaacgagagcacacattaaagagagagtaaattccaaaggtttcaaagaacttggtcataaatatgataatgagaagacaaagtatttatattaaaacagtttagtagccttcagttttgtgaaaatagttttcagcacagaaactgacttctttagacaaagttttaaccaatgatggtgtttgcttctaggatatacactttaaaagaactcactgtcccagtggtggtcattgatggcctttagtaaattggagctgcttaatcatattgatatctaatttcttttaaccacaatgaattgtccttaattaccaacagtgaagcactacaggaggcaactgtggcattgcttccttaaccagctcatggtgtgtgaatgttataaaattgtcactcagatatattttttaaatgtaatgttatataagatgatcatgtgatgtgtacaaactatggtgaaaagtgccagtggtagtaactgtgtaaagtttctaattcacaacattaattcctttaaaatacacagccttctgcctctgtatttggagttgtcagtacaactcatcaaagaaaactgcctaatataaaaatcatatatatggtaataatttccctcttttgtagtctgcacaagatccataaaagattgtatttttattactatttaaacaagtgattaaatttagtctgcacagtgagcaagggttcacatgcattcttttatactgctggattttgttgtgcatcatttaaaacattttgtatgtttcttcttatctgtgtatacagtatgttcttgaatgatgttcatttgtcaggagaactgtgagaaataaactatgtggatactgtctgtttatattata

SEQ ID NO: 98010 - DNA, 2996 bp, Homo sapiens
ctgcttgcctgtggaacatgttaatcagctgactactgagccagctacagggcccttttctgaaactcagtcatctttaagggattctgaggaggaagtagatgtggtgggagatagcagtgcctcaaaagagcagtgtaaagaaaacaccaataacgaactggacacaagtcttgagagtatgccagcctccggagaacctgaaccatctcctgttctagactgtgtttcagctcaaatgatgtctttatcagaacctcaagaacatcgttatactctgagaacctcaccacgaagggcagcccctaccagaggtagtcccactaaaaacagttctccttacagagaaaatggacaatttgaggagaataatcttagtcctaatgaaacaaatgcaactgttagtgataatgtaagtcaatctcctacaaatcctggtgaaatttctcaaaatgaaaaagggatatgttgtgactctcaaaataatggaagtgaaggagtaagtaaaccaccctcagaggcaagactcaatattggacatttgccatctgccaaagagagtgccagtcagcacattacagaagaggaagatgatgatcctgatgtttattactttgaatcagatcatgtggcactgaaacacaacaaagagtatgtatcataatgtagaatctcgacgctgtactcgaggctcagcgttctcaagcagtccaagaccttgaaaattaggcaggcaccagagagaagcactgaaaaatcccattggatttgtggaaaaactccagaagaaggctgatattgggcttccatatccacagagagttgttcaattgcctgagatcgtatgggaccaatatacccatagccttgggaattttgaaagagaatttaaaaatcgtaaaagacatactagaagagttaagctagtttttgataaagtaggtttacctgctagaccaaaaagtcctttagatcctaagaaggatggagagtccctttcatattctatgttgcctttgagtgatggtccagaaggctcaagcagtcgtcctcagatgataagaggacgcttgtgtgatgataccaaacctgaaacatttaaccagttgtggactgttgaagaacagaaaaagctggaacagctactcatcaaataccctcctgaagaagtagaatctcgacgctggcagaagatagcagatgaattgggcaacaggacagcaaaacaggttgccagccgagtacagaagtatttcataaagctaactaaagctggcattccagtaccaggcagaacaccaaacttatatatatactccaaaaagtcttcaacaagcagacgacagcaccctcttaataagcatctctttaagccttccactttcatgacttcacatgaaccgccagtgtatatggatgaagatgatgaccgatcttgttttcatagccacatgaacactgctgttgaagatgcatcagatgacgaaagtattcctatcatgtataggaatttacctgaatataaagaactattacagtttaaaaagttaaagaagcagaaacttcagcaaatgcaagctgaaagtggatttgtgcaacatgtgggctttaagtgtgataactgtggcatagaacccatccagggtgttcggtggcattgccaggattgtcctccagaaatgtctttggatttctgtgattcttgttcagactgtctacatgaaacagatattcacaaggaagatcaccaattagaacctatttataggtcagagacattcttagacagagactactgtgtgtctcagggcaccagttacaattaccttgacccaaactactttccagcaaacagatgacatggaagagaacatcatttactagtcctcttcaacacatagcaatggtatcattgttaattatgtgcacagtttggaaagattctctgctttcccagaaatgacactcacagcatgagagcttcctgagtgttctcgtcaagtacagctctgcaccgttgtggctctagatcactgttcagcagctgaacattcctggtgagcaaaggtttccctggtgaatttttcaccactgcgttttaggtggtgatcttaaatgggtgagatggaacgagagcacacattaaagagagagtaaattccaaaggtttcaaagaacttggtcataaatatgataatgagaagacaaagtatttatattaaaacagtttagtagccttcagttttgtgaaaatagttttcagcacagaaactgacttctttagacaaagttttaaccaatgatggtgtttgcttctaggatatacactttaaaagaactcactgtcccagtggtggtcattgatggcctttagtaaattggagctgcttaatcatattgatatctaatttcttttaaccacaatgaattgtccttaattaccaacagtgaagcactacaggaggcaactgtggcattgcttccttaaccagctcatggtgtgtgaatgttataaaattgtcactcagatatattttttaaatgtaatgttatataagatgatcatgtgatgtgtacaaactatggtgaaaagtgccagtggtagtaactgtgtaaagtttctaattcacaacattaattcctttaaaatacacagccttctgcctctgtatttggagttgtcagtacaactcatcaaagaaaactgcctaatataaaaatcatatatatggtaataatttccctcttttgtagtctgcacaagatccataaaagattgtatttttattactatttaaacaagtgattaaatttagtctgcacagtgagcaagggttcacatgcattcttttatactgctggattttgttgtgcatcatttaaaacattttgtatgtttcttcttatctgtgtatacagtatgttcttgaatgatgttcatttgtcaggagaactgtgagaaataaactatgtggatactgtctgtttatattata

SEQ ID NO: 98011 - DNA, 2620 bp, Homo sapiens
caacagagtacaaccaagtgcctgaattgagtgattcctcctagtattaagattttatcattttaattatattttttttatctagcagtttcttaacgactttgattgttggaagatcaaaatgctcttttattttggtacttgttcaggttcaagaattaaaaacttaagatgggggaagaaggctttgctttctctaactcttattttctgtaggtacttcgtaactcaggaagacctcatttattcccagtaatatgttttactaaactctttcaggtatcataatgtagaatctcgacgctgtactcgaggctcagcgttctcaagcagtccaagaccttgaaaattaggcaggcaccagagagaagcactgaaaaatcccattggatttgtggaaaaactccagaagaaggctgatattgggcttccatatccacagagagttgttcaattgcctgagatcgtatgggaccaatatacccatagccttgggaattttgaaagagaatttaaaaatcgtaaaagacatactagaagagttaagctagtttttgataaagtaggtttacctgctagaccaaaaagtcctttagatcctaagaaggatggagagtccctttcatattctatgttgcctttgagtgatggtccagaaggctcaagcagtcgtcctcagatgataagaggacgcttgtgtgatgataccaaacctgaaacatttaaccagttgtggactgttgaagaacagaaaaagctggaacagctactcatcaaataccctcctgaagaagtagaatctcgacgctggcagaagatagcagatgaattgggcaacaggacagcaaaacaggttgccagccgagtacagaagtatttcataaagctaactaaagctggcattccagtaccaggcagaacaccaaacttatatatatactccaaaaagtcttcaacaagcagacgacagcaccctcttaataagcatctctttaagccttccactttcatgacttcacatgaaccgccagtgtatatggatgaagatgatgaccgatcttgttttcatagccacatgaacactgctgttgaagatgcatcagatgacgaaagtattcctatcatgtataggaatttacctgaatataaagaactattacagtttaaaaagttaaagaagcagaaacttcagcaaatgcaagctgaaagtggatttgtgcaacatgtgggctttaagtgtgataactgtggcatagaacccatccagggtgttcggtggcattgccaggattgtcctccagaaatgtctttggatttctgtgattcttgttcagactgtctacatgaaacagatattcacaaggaagatcaccaattagaacctatttataggtcagagacattcttagacagagactactgtgtgtctcagggcaccagttacaattaccttgacccaaactactttccagcaaacagatgacatggaagagaacatcatttactagtcctcttcaacacatagcaatggtatcattgttaattatgtgcacagtttggaaagattctctgctttcccagaaatgacactcacagcatgagagcttcctgagtgttctcgtcaagtacagctctgcaccgttgtggctctagatcactgttcagcagctgaacattcctggtgagcaaaggtttccctggtgaatttttcaccactgcgttttaggtggtgatcttaaatgggtgagatggaacgagagcacacattaaagagagagtaaattccaaaggtttcaaagaacttggtcataaatatgataatgagaagacaaagtatttatattaaaacagtttagtagccttcagttttgtgaaaatagttttcagcacagaaactgacttctttagacaaagttttaaccaatgatggtgtttgcttctaggatatacactttaaaagaactcactgtcccagtggtggtcattgatggcctttagtaaattggagctgcttaatcatattgatatctaatttcttttaaccacaatgaattgtccttaattaccaacagtgaagcactacaggaggcaactgtggcattgcttccttaaccagctcatggtgtgtgaatgttataaaattgtcactcagatatattttttaaatgtaatgttatataagatgatcatgtgatgtgtacaaactatggtgaaaagtgccagtggtagtaactgtgtaaagtttctaattcacaacattaattcctttaaaatacacagccttctgcctctgtatttggagttgtcagtacaactcatcaaagaaaactgcctaatataaaaatcatatatatggtaataatttccctcttttgtagtctgcacaagatccataaaagattgtatttttattactatttaaacaagtgattaaatttagtctgcacagtgagcaagggttcacatgcattcttttatactgctggattttgttgtgcatcatttaaaacattttgtatgtttcttcttatctgtgtatacagtatgttcttgaatgatgttcatttgtcaggagaactgtgagaaataaactatgtggatactgtctgtttatattata

SEQ ID NO: 98012 - DNA, 2265 bp, Homo sapiens
actctagaggactcttcgcggtatcataatgtagaatctcgacgctgtactcgaggctcagcgttctcaagcagtccaagaccttgaaaattaggcaggcaccagagagaagcactgaaaaatcccattggatttgtggaaaaactccagaagaaggctgatattgggcttccatatccacagagagttgttcaattgcctgagatcgtatgggaccaatatacccatagccttgggaattttgaaagagaatttaaaaatcgtaaaagacatactagaagagttaagctagtttttgataaagtaggtttacctgctagaccaaaaagtcctttagatcctaagaaggatggagagtccctttcatattctatgttgcctttgagtgatggtccagaaggctcaagcagtcgtcctcagatgataagaggacgcttgtgtgatgataccaaacctgaaacatttaaccagttgtggactgttgaagaacagaaaaagctggaacagctactcatcaaataccctcctgaagaagtagaatctcgacgctggcagaagatagcagatgaattgggcaacaggacagcaaaacagtcttcaacaagcagacgacagcaccctcttaataagcatctctttaagccttccactttcatgacttcacatgaaccgccagtgtatatggatgaagatgatgaccgatcttgttttcatagccacatgaacactgctgttgaagatgcatcagatgacgaaagtattcctatcatgtataggaatttacctgaatataaagaactattacagtttaaaaagttaaagaagcagaaacttcagcaaatgcaagctgaaagtggatttgtgcaacatgtgggctttaagtgtgataactgtggcatagaacccatccagggtgttcggtggcattgccaggattgtcctccagaaatgtctttggatttctgtgattcttgttcagactgtctacatgaaacagatattcacaaggaagatcaccaattagaacctatttataggtcagagacattcttagacagagactactgtgtgtctcagggcaccagttacaattaccttgacccaaactactttccagcaaacagatgacatggaagagaacatcatttactagtcctcttcaacacatagcaatggtatcattgttaattatgtgcacagtttggaaagattctctgctttcccagaaatgacactcacagcatgagagcttcctgagtgttctcgtcaagtacagctctgcaccgttgtggctctagatcactgttcagcagctgaacattcctggtgagcaaaggtttccctggtgaatttttcaccactgcgttttaggtggtgatcttaaatgggtgagatggaacgagagcacacattaaagagagagtaaattccaaaggtttcaaagaacttggtcataaatatgataatgagaagacaaagtatttatattaaaacagtttagtagccttcagttttgtgaaaatagttttcagcacagaaactgacttctttagacaaagttttaaccaatgatggtgtttgcttctaggatatacactttaaaagaactcactgtcccagtggtggtcattgatggcctttagtaaattggagctgcttaatcatattgatatctaatttcttttaaccacaatgaattgtccttaattaccaacagtgaagcactacaggaggcaactgtggcattgcttccttaaccagctcatggtgtgtgaatgttataaaattgtcactcagatatattttttaaatgtaatgttatataagatgatcatgtgatgtgtacaaactatggtgaaaagtgccagtggtagtaactgtgtaaagtttctaattcacaacattaattcctttaaaatacacagccttctgcctctgtatttggagttgtcagtacaactcatcaaagaaaactgcctaatataaaaatcatatatatggtaataatttccctcttttgtagtctgcacaagatccataaaagattgtatttttattactatttaaacaagtgattaaatttagtctgcacagtgagcaagggttcacatgcattcttttatactgctggattttgttgtgcatcatttaaaacattttgtatgtttcttcttatctgtgtatacagtatgttcttgaatgatgttcatttgtcaggagaactgtgagaaataaactatgtggatactgtctgtttatattata

SEQ ID NO: 98013 - DNA, 1863 bp, Homo sapiens
aaaaaaaattttttaaagctagttatgctttaaaaacgcagaaaacagaaaaagcaacaacataagagtatgctaaaggatagagtgaaattcttctgatagacttgttggaagtaacatttgtatttttatatttttgattcttgtaatgatttttcactgaaccaattaaaaatttgttttcttacttagtcttcaacaagcagacgacagcaccctcttaataagcatctctttaagccttccactttcatgacttcacatgaaccgccagtgtatatggatgaagatgatgaccgatcttgttttcatagccacatgaacactgctgttgaagatgcatcagatgacgaaagtattcctatcatgtataggaatttacctgaatataaagaactattacagtttaaaaagttaaagaagcagaaacttcagcaaatgcaagctgaaagtggatttgtgcaacatgtgggctttaagtgtgataactgtggcatagaacccatccagggtgttcggtggcattgccaggattgtcctccagaaatgtctttggatttctgtgattcttgttcagactgtctacatgaaacagatattcacaaggaagatcaccaattagaacctatttataggtcagagacattcttagacagagactactgtgtgtctcagggcaccagttacaattaccttgacccaaactactttccagcaaacagatgacatggaagagaacatcatttactagtcctcttcaacacatagcaatggtatcattgttaattatgtgcacagtttggaaagattctctgctttcccagaaatgacactcacagcatgagagcttcctgagtgttctcgtcaagtacagctctgcaccgttgtggctctagatcactgttcagcagctgaacattcctggtgagcaaaggtttccctggtgaatttttcaccactgcgttttaggtggtgatcttaaatgggtgagatggaacgagagcacacattaaagagagagtaaattccaaaggtttcaaagaacttggtcataaatatgataatgagaagacaaagtatttatattaaaacagtttagtagccttcagttttgtgaaaatagttttcagcacagaaactgacttctttagacaaagttttaaccaatgatggtgtttgcttctaggatatacactttaaaagaactcactgtcccagtggtggtcattgatggcctttagtaaattggagctgcttaatcatattgatatctaatttcttttaaccacaatgaattgtccttaattaccaacagtgaagcactacaggaggcaactgtggcattgcttccttaaccagctcatggtgtgtgaatgttataaaattgtcactcagatatattttttaaatgtaatgttatataagatgatcatgtgatgtgtacaaactatggtgaaaagtgccagtggtagtaactgtgtaaagtttctaattcacaacattaattcctttaaaatacacagccttctgcctctgtatttggagttgtcagtacaactcatcaaagaaaactgcctaatataaaaatcatatatatggtaataatttccctcttttgtagtctgcacaagatccataaaagattgtatttttattactatttaaacaagtgattaaatttagtctgcacagtgagcaagggttcacatgcattcttttatactgctggattttgttgtgcatcatttaaaacattttgtatgtttcttcttatctgtgtatacagtatgttcttgaatgatgttcatttgtcaggagaactgtgagaaataaactatgtggatactgtctgtttatattata

SEQ ID NO: 98014 - DNA, 2656 bp, Homo sapiens
actctagaggactcttcgcggtatcataatgtagaatctcgacgctgtactcgaggctcagcgttctcaagcagtccaagaccttgaaaattaggcaggcaccagagagaagcactgaaaaatcccattggatttgtggaaaaactccagaagaaggctgatattgggcttccatatccacagagagttgttcaattgcctgagatcgtatgggaccaatatacccatagccttgggaattttgaaagagaatttaaaaatcgtaaaagacatactagaagagttaagctagtttttgataaagtaggtttacctgctagaccaaaaagtcctttagatcctaagaaggatggagagtccctttcatattctatgttgcctttgagtgatggtccagaaggctcaagcagtcgtcctcagatgataagaggacgcttgtgtgatgataccaaacctgaaacatttaaccagttgtggactgttgaagaacagaaaaagctggaacagctactcatcaaataccctcctgaagaagtagaatctcgacgctggcagaagatagcagatgaattgggcaacaggacagcaaaacaggttgccagccgagtacagaagtatttcataaagctaactaaagctggcattccagtaccaggcagaacaccaaacttatatatatactccaaaaagtcttcaacaagcagacgacagcaccctcttaataagcatctctttaagccttccactttcatgacttcacatgaaccgccagtgtatatggatgaagatgatgaccgatcttgttttcatagccacatgaacactgctgttgaagatgcatcagatgacgaaagtattcctatcatgtataggaatttacctgaatataaagaactattacagtttaaaaagttaaagaagcagaaacttcagcaaatgcaagctgaaagtggatttgtgcaacatgtgggctttaagtgtgataactgtggcatagaacccatccagggtgttcggtggcattgccaggattgtcctccagaaatgtctttggatttctgtgattcttgttcagactgtctacatgaaacagatattcacaaggaagatcaccaattagaacctatttataggtcagagacattcttagacagagactactgtgtgtctcagggcaccagttacaattaccttgacccaaactactttccagcaaacagatgacatggaagagaacatcatttactagtcctcttcaacacatagcaatggtatcattgttaattatgtgcacagtttggaaagattctctgctttcccagaaatgacactcacagcatgagagcttcctgagtgttctcgtcaagtacagctctgcaccgttgtggctctagatcactgttcagcagctgaacattcctggtgagcaaaggtttccctggtgaatttttcaccactgcgttttaggtggtgatcttaaatgggtgagatggaacgagagcacacattaaagagagagtaaattccaaaggtttcaaagaacttggtcataaatatgataatgagaagacaaagtatttatattaaaacagtttagtagccttcagttttgtgaaaatagttttcagcacagaaactgacttctttagacaaagttttaaccaatgatggtgtttgcttctaggatatacactttaaaagaactcactgtcccagtggtggtcattgatggcctttagtaaattggagctgcttaatcatattgatatctaatttcttttaaccacaatgaattgtccttaattaccaacagtgaagcactacaggaggcaactgtggcattgcttccttaaccagctcatggtgtgtgaatgttataaaattgtcactcagatatattttttaaatgtaatgttatataagatgatcatgtgatgtgtacaaactatggtgaaaagtgccagtggtagtaactgtgtaaagtttctaattcacaacattaattcctttaaaatacacagccttctgcctctgtatttggagttgtcagtacaactcatcaaagaaaactgcctaatataaaaatcatatatatggtaataatttccctcttttgtagtctgcacaagatccataaaagattgtatttttattactatttaaacaagtgattaaatttagtctgcacagtgagcaagggttcacatgcattcttttatactgctggattttgttgtgcatcatttaaaacattttgtatgtttcttcttatctgtgtatacagtatgttcttgaatgatgttcatttgtcaggagaactgtgagaaataaactatgtggatactgtctgtttatattatagaatgcttgttgtgacttccttttggttagattttggatttttttttttaccagtgttaaaaccagaaattggtattttttaaaatggtttgcttcacatatttaagagttttctttctgtcatttatgaagaataaggaatgtattatggaaaagagggtgatcttaagcaaccctgtaaaaaatggtaaagatttttactcagtgtgtgctgaaacactaaattaaactagcttacaaaaaggaaacacggaccatggttaaagaaaaaggcaattattaatgctcaggtgtg

SEQ ID NO: 98015 - DNA, 294 bp, Homo sapiens
tgagagtataaaaccaaacaaaataaaataatgtgaaggcattttgtaaacagttaaaaaaaaaagcatatacattaaaaaacaaatttactcaaatattttgaaattaatttaaaaattccacaatttgcgtgttatttggctatatcaaaggataggtgttgttattttctctctgacaaaagccttgtcttatgtgcagatgataagaggacgcttgtgtgatgataccaaacctgaaacatttaaccagttgtggactgttgaagaacaggtaataaatatttcaaaatc

SEQ ID NO: 98016 - DNA, 3496 bp, Homo sapiens
cgcctaatgcttgctccacagtcgcgtgctagactccggacccgccagtggtatggctgagccgactagtgatttcgagactcctatcgggtggcatgcgtctcccgagctgactcccacgttagggcccctgagcgacactgccccgccgcgggacaggtggatgttctgggcaatgctgccgccaccgccaccaccacttacgtcctcgcttcccgcagccgggtcaaagccttcctctgagtcgcagccccccatggaggcccagtctctccccggggctccgccccccttcgacgcccagattcttcccggggcgcaaccccccttcgacgcccagtctccccttgattctcagcctcaacccagcggccagccttggaatttccatgcttccacatcgtggtattggagacagtcttctgataggtttcctcggcatcagaagtccttcaaccctgcagttaaaaattcttattatccacgaaagtatgatgcaaaattcacagacttcagcttacctcccagtagaaaacagaaaaaaaagaaaagaaaggaaccagtttttcactttttttgtgatacctgtgatcgtggttttaaaaatcaagaaaagtatgacaaacacatgtctgaacatacaaaatgccctgaattagattgctcttttactgcacacgagaagattgtccagttccattggagaaatatgcatgctcctggcatgaagaagatcaagttagacactccagaggaaattgcacggtggagggaagaaagaaggaaaaactatccaactctggccaatattgaaaggaagaagaagttaaaacttgaaaaggagaagagaggagcagtattgacaacaacacaatatggcaagatgaaggggatgtccagacattcacaaatggcaaagatcagaagtcctggcaagaatcacaaatggaaaaacgacaattctagacagagagcagtcactggatcaggcagtcacttgtgtgatttgaagctagaaggtccaccggaggcaaatgcagatcctcttggtgttttgataaacagtgattctgagtctgataaggaggagaaaccacaacattctgtgatacccaaggaagtgacaccagccctatgctcactaatgagtagctatggcagtctttcagggtcagagagtgagccagaagaaactcccatcaagactgaagcagacgttttggcagaaaaccaggttcttgatagcagtgctcctaagagtccaagtcaagatgttaaagcaactgttagaaatttttcagaagccaagagtgagaaccgaaagaaaagctttgaaaaaacaaaccctaagaggaaaaaagattatcacaactatcaaacgttattcgaaccaagaacacaccatccatatctcttggaaatgcttctagctccggacattcgacatgaaagaaatgtgattttgcagtgtgttcggtacatcatcaaaaaagacttttttggactggatactaattctgcgaaaagtaaagatgtataggcatctggtgtttcagcatacataactgaagcatgtgaaacagtatcatcctcgttagtagaggaaaaccaaaacccttttttccgtcaaaattggatttgtaattaaattgtaagcctcgtaggatgtatgttggaattttaagtctttcctttggttctatgcaaataaaaaaataactgattttttaagactgtgtctgtattgttgggattgaatctagtatttgctgggagaattttttctttgtatttattttaatgtattgttctcatgtaagaatgactgatgttgtgttagttaagaattgaagataggtttagcagtaaagaagaaagcttttaaaaggattgattcagctaagcaaagttgggcagagaaatacagccattttgtttttaatgcagaaaaggaagatgttctgtagcaagggggaatattttaaaaataaaccagatcaaattaatacaatcagaaggtttcgaaatgtaaatattccttatttaagacatgtttaaattcacctactagcacgacttacatagctcaaatattgaatgtttaaaatattaatacagatggggcctctttatgtttagataaaattgaagtacttaattgaagctttttaaaaattgtaaagtaaatgaaagctattgagatctttttgtctcctataataccagggaatttgagcttgtgttctagtcattgtactagctgtagctattggtctgtccttttgacatacagctaaaagggactaaatttgtaaaaaattagtttgttatagttgaagattaacttttcctaacattgtgattattgaagttcatgaatcttgctgtcaaggaagaaaggtaagaaagctgatagctcctccatgttggtaaaatcctctccagaatcttggaacacctggcatgtgaccctagtgacgtcacagacctgagatgaagattcatgtttagccagtgttttccagccttgtacccaccatacagatctgtttattctgtttcaccctactcctccagtgagccccatattttgggaaattatctgccttatacattaactaattcaattcatgtaacactgttgagtgcttactctttgtacctctattgtgcctatattaaaggtatacaaataaataaggccatgtctgacttcaaggaactcagtttaattttgatatattcaaagatgtgattcccaaccaactcaggatgaagtaactagtgttacaactgagttgatattctaaaatataacccagtttgtacttttattactagttagcatacacattttatggcttatgggttaataaatgaattcatggactcctggactactttcattgatgaccatatctccagggatgttgttgatccccacactgccttaaggtatattatagaaacagttttattttccatttttcttgtttcctgataataaatgtatttaggactgaaaatactcctgagtactcccttggctgtatgtctgacagtctttagctatggtgactattgtttatttttaatgggtatttcagattccaagtgtatttaaaatttctaaggagatataatatagcctgtatggtttctactttatggaattatatggtcaatatttgtaaatattctatgagttttgggtgggtagaggggtgctttgcctgttttgggtacaggtttttttggatttagcttgttaattgttcaaactttctgccttctacattcctatcttattgttcgtttaatcagtttctgaaatgtaagcattacatgactattggtgagttgtgccttttataactgaaatactttactttttctcatatcctctataattgacttctattttccttaatcaaaccagctctgggaaatttaatacatttatattaattgagattattaaaacatttggactatt

SEQ ID NO: 98017 - DNA, 706 bp, Homo sapiens
cgcctaatgcttgctccacagtcgcgtgctagactccggacccgccagtggtatggctgagccgactagtgatttcgagactcctatcgggtggcatgcgtctcccgagctgactcccacgttagggcccctgagcgacactgccccgccgcgggacaggtggatgttctgggcaatgctgccgccaccgccaccaccacttacgtcctcgcttcccgcagccgggtcaaagccttcctctgagtcgcagccccccatggaggcccagtctctccccggggctccgccccccttcgacgcccagattcttcccggggcgcaaccccccttcgacgcccagtctccccttgattctcagcctcaacccagcggccagccttggaatttccatgcttccacatcgtggtattggagacagtcttctgataggtttcctcggcatcagaagtccttcaaccctgcagttaaaaattcttattatccacgaaagtatgatgcaaaattcacagacttcagcttacctcccagtagaaaacagaaaaaaaagctaaaaccagagtgggtgcgtgcgcggagctgaaagctttccactggaggtccccgaggattatcgagaaaccccagggttatttggctaccatgtgggtccccccaattggtgcagtgggacactatacgctaggggctttgggcactgacgtttaca

SEQ ID NO: 98018 - DNA, 3682 bp, Homo sapiens
cgcctaatgcttgctccacagtcgcgtgctagactccggacccgccagtggtatggctgagccgactagtgatttcgagactcctatcgggtggcatgcgtctcccgagctgactcccacgttagggcccctgagcgacactgccccgccgcgggacaggtggatgttctgggcaatgctgccgccaccgccaccaccacttacgtcctcgcttcccgcagccgggtcaaagccttcctctgagtcgcagccccccatggaggcccagtctctccccggggctccgccccccttcgacgcccagattcttcccggggcgcaaccccccttcgacgcccagtctccccttgattctcagcctcaacccagcggccagccttggaatttccatgcttccacatcgtggtattggagacagtcttctgataggtttcctcggcatcagaagtccttcaaccctgcagttaaaaattcttattatccacgaaagtatgatgcaaaattcacagacttcagcttacctcccagtagaaaacagaaaaaaaagaaaagaaaggaaccagtttttcactttttttgtgatacctgtgatcgtggttttaaaaatcaagaaaagtatgacaaacacatgtctgaacatacaaaatgccctgaattagattgctcttttactgcacacgagaagattgtccagttccattggagaaatatgcatgctcctggcatgaagaagatcaagttagacactccagaggaaattgcacggtggagggaagaaagaaggaaaaactatccaactctggccaatattgaaaggaagaagaagttaaaacttgaaaaggagaagagaggagcagtattgacaacaacacaatatggcaagatgaaggggatgtccagacattcacaaatggcaaagatcagaagtcctggcaagaatcacaaatggaaaaacgacaattctagacagagagcagtcactggatcaggcagtcacttgtgtgatttgaagctagaaggtccaccggaggcaaatgcagatcctcttggtgttttgataaacagtgattctgagtctgataaggaggagaaaccacaacattctgtgatacccaaggaagtgacaccagccctatgctcactaatgagtagctatggcagtctttcagggtcagagagtgagccagaagaaactcccatcaagactgaagcagacgttttggcagaaaaccaggttcttgatagcagtgctcctaagagtccaagtcaagatgttaaagcaactgttagaaatttttcagaagccaagagtgagaaccgaaagaaaagctttgaaaaaacaaaccctaagaggaaaaaagattatcacaactatcaaacgttattcgaaccaagaacacaccatccatatctcttggaaatgcttctagctccggacattcgacatgaaagaaatgtgattttgcagtgtgttcggtacatcatcaaaaaagacttttttggactggatactaattctgcgaaaagtaaagatgtataggcatctggtgtttcagcatacataactgaagcatgtgaaacagtatcatcctcgttagtagaggaaaaccaaaacccttttttccgtcaaaattggatttgtaattaaattgtaagcctcgtaggatgtatgttggaattttaagtctttcctttggttctatgcaaataaaaaaataactgattttttaagactgtgtctgtattgttgggattgaatctagtatttgctgggagaattttttctttgtatttattttaatgtattgttctcatgtaagaatgactgatgttgtgttagttaagaattgaagataggtttagcagtaaagaagaaagcttttaaaaggattgattcagctaagcaaagttgggcagagaaatacagccattttgtttttaatgcagaaaaggaagatgttctgtagcaagggggaatattttaaaaataaaccagatcaaattaatacaatcagaaggtttcgaaatgtaaatattccttatttaagacatgtttaaattcacctactagcacgacttacatagctcaaatattgaatgtttaaaatattaatacagatggggcctctttatgtttagataaaattgaagtacttaattgaagctttttaaaaattgtaaagtaaatgaaagctattgagatctttttgtctcctataataccagggaatttgagcttgtgttctagtcattgtactagctgtagctattggtctgtccttttgacatacagctaaaagggactaaatttgtaaaaaattagtttgttatagttgaagattaacttttcctaacattgtgattattgaagttcatgaatcttgctgtcaaggaagaaaggtaagaaagctgatagctcctccatgttggtaaaatcctctccagaatcttggaacacctggcatgtgaccctagtgacgtcacagacctgagatgaagattcatgtttagccagtgttttccagccttgtacccaccatacagatctgtttattctgtttcaccctactcctccagtgagccccatattttgggaaattatctgccttatacattaactaattcaattcatgtaacactgttgagtgcttactctttgtacctctattgtgcctatattaaaggtatacaaataaataaggccatgtctgacttcaaggaactcagtttaattttgatatattcaaagatgtgattcccaaccaactcaggatgaagtaactagtgttacaactgagttgatattctaaaatataacccagtttgtacttttattactagttagcatacacattttatggcttatgggttaataaatgaattcatggactcctggactactttcattgatgaccatatctccagggatgttgttgatccccacactgccttaaggtatattatagaaacagttttattttccatttttcttgtttcctgataataaatgtatttaggactgaaaatactcctgagtactcccttggctgtatgtctgacagtctttagctatggtgactattgtttatttttaatgggtatttcagattccaagtgtatttaaaatttctaaggagatataatatagcctgtatggtttctactttatggaattatatggtcaatatttgtaaatattctatgagttttgggtgggtagaggggtgctttgcctgttttgggtacaggtttttttggatttagcttgttaattgttcaaactttctgccttctacattcctatcttattgttcgtttaatcagtttctgaaatgtaagcattacatgactattggtgagttgtgccttttataactgaaatactttactttttctcatatcctctataattgacttctattttccttaatcaaaccagctctgggaaatttaatacatttatattaattgagattattaaaacatttggactattcctggctgtcttactttgtattttctatatatcatgctctcttgtttttattttgtcatcttactggcttgttatttttttctccttgttattcctccagtggtttggaagtaattaaacctattgctatttctttagtgattaccttttttctttaagtttagagttaattagtagccacatctt

SEQ ID NO: 98019 - DNA, 3271 bp, Homo sapiens
aggaaggcagctgtacggctttcatgagttgtttcaacagagggagaagaagccaggagagccaatttctgacggcaagtgttgaagaaggttcatatgcttgctaccttccaaacagctcttcaggcagaagcaggtacacagacagtgctggcggaaaaacctgagaagcagctatcagtattagaccacatacgaaagcctcttcgggacatttgcaagcatccagagcagagatgttaaaaattcttattatccacgaaagtatgatgcaaaattcacagacttcagcttacctcccagtagaaaacagaaaaaaaagaaaagaaaggaaccagtttttcactttttttgtgatacctgtgatcgtggttttaaaaatcaagaaaagtatgacaaacacatgtctgaacatacaaaatgccctgaattagattgctcttttactgcacacgagaagattgtccagttccattggagaaatatgcatgctcctggcatgaagaagatcaagttagacactccagaggaaattgcacggtggagggaagaaagaaggaaaaactatccaactctggccaatattgaaaggaagaagaagttaaaacttgaaaaggagaagagaggagcagtattgacaacaacacaatatggcaagatgaaggggatgtccagacattcacaaatggcaaagatcagaagtcctggcaagaatcacaaatggaaaaacgacaattctagacagagagcagtcactggatcaggcagtcacttgtgtgatttgaagctagaaggtccaccggaggcaaatgcagatcctcttggtgttttgataaacagtgattctgagtctgataaggaggagaaaccacaacattctgtgatacccaaggaagtgacaccagccctatgctcactaatgagtagctatggcagtctttcagggtcagagagtgagccagaagaaactcccatcaagactgaagcagacgttttggcagaaaaccaggttcttgatagcagtgctcctaagagtccaagtcaagatgttaaagcaactgttagaaatttttcagaagccaagagtgagaaccgaaagaaaagctttgaaaaaacaaaccctaagaggaaaaaagattatcacaactatcaaacgttattcgaaccaagaacacaccatccatatctcttggaaatgcttctagctccggacattcgacatgaaagaaatgtgattttgcagtgtgttcggtacatcatcaaaaaagacttttttggactggatactaattctgcgaaaagtaaagatgtataggcatctggtgtttcagcatacataactgaagcatgtgaaacagtatcatcctcgttagtagaggaaaaccaaaacccttttttccgtcaaaattggatttgtaattaaattgtaagcctcgtaggatgtatgttggaattttaagtctttcctttggttctatgcaaataaaaaaataactgattttttaagactgtgtctgtattgttgggattgaatctagtatttgctgggagaattttttctttgtatttattttaatgtattgttctcatgtaagaatgactgatgttgtgttagttaagaattgaagataggtttagcagtaaagaagaaagcttttaaaaggattgattcagctaagcaaagttgggcagagaaatacagccattttgtttttaatgcagaaaaggaagatgttctgtagcaagggggaatattttaaaaataaaccagatcaaattaatacaatcagaaggtttcgaaatgtaaatattccttatttaagacatgtttaaattcacctactagcacgacttacatagctcaaatattgaatgtttaaaatattaatacagatggggcctctttatgtttagataaaattgaagtacttaattgaagctttttaaaaattgtaaagtaaatgaaagctattgagatctttttgtctcctataataccagggaatttgagcttgtgttctagtcattgtactagctgtagctattggtctgtccttttgacatacagctaaaagggactaaatttgtaaaaaattagtttgttatagttgaagattaacttttcctaacattgtgattattgaagttcatgaatcttgctgtcaaggaagaaaggtaagaaagctgatagctcctccatgttggtaaaatcctctccagaatcttggaacacctggcatgtgaccctagtgacgtcacagacctgagatgaagattcatgtttagccagtgttttccagccttgtacccaccatacagatctgtttattctgtttcaccctactcctccagtgagccccatattttgggaaattatctgccttatacattaactaattcaattcatgtaacactgttgagtgcttactctttgtacctctattgtgcctatattaaaggtatacaaataaataaggccatgtctgacttcaaggaactcagtttaattttgatatattcaaagatgtgattcccaaccaactcaggatgaagtaactagtgttacaactgagttgatattctaaaatataacccagtttgtacttttattactagttagcatacacattttatggcttatgggttaataaatgaattcatggactcctggactactttcattgatgaccatatctccagggatgttgttgatccccacactgccttaaggtatattatagaaacagttttattttccatttttcttgtttcctgataataaatgtatttaggactgaaaatactcctgagtactcccttggctgtatgtctgacagtctttagctatggtgactattgtttatttttaatgggtatttcagattccaagtgtatttaaaatttctaaggagatataatatagcctgtatggtttctactttatggaattatatggtcaatatttgtaaatattctatgagttttgggtgggtagaggggtgctttgcctgttttgggtacaggtttttttggatttagcttgttaattgttcaaactttctgccttctacattcctatcttattgttcgtttaatcagtttctgaaatgtaagcattacatgactattggtgagttgtgccttttataactgaaatactttactttttctcatatcctctataattgacttctattttccttaatcaaaccagctctgggaaatttaatacatttatattaattgagattattaaaacatttggactatt

SEQ ID NO: 98020 - DNA, 324 bp, Homo sapiens
ggcccatgaagatgtctaaaccaaggggaagtgtttctggccccctagaattagtcttttggaaagattaaggaaatgatcagaaattacttaattttcactaacaaatgagggaatgggggatggacagcttttttatggtggtagatgttttgaatctgacttcttttcccttcagagtctgataaggaggagaaaccacaacattctgtgatacccaaggaagtgacaccagccctatgctcactaatgagtagctatggcagtctttcagggtcagagagtgagccagaaggtaagtcatggtgtgtgttgttacagggt

SEQ ID NO: 98021 - DNA, 176 bp, Homo sapiens
agtgcatgcattctccttgcattttcaactgagaaataggtctgatactttggtatgaaattcacagagaatcccactgaaattttctctgtgcatatccttatcctttatgtatggatcacctagagcaagttcatttattcacatttaaacatagatttctgaaactcctcctc

SEQ ID NO: 98022 - DNA, 425 bp, Homo sapiens
attgcaggttgtgataggccaacttggattctgacaaagtaacttcttattaaggcctctctatgaataagtttctgttccttagtttgaaaacattaccatgataatagtaatggtaatagctgacatttattggattcgttctctttttcttaggcattatgcacattatttgaaattatgaattccataattctatagagacatcttaatgattgatttctttttgaaaacctattttaacaaactggataatattgttgactaggaggtttcttttgggtagaaccacagtaatgatggtaacgctgtttggagtttgataatgaatatgtatactttttatgaaacaccactctggtaaatgtgatgaaatgtacatgacagccctctgtttacattctttaattttgagggtggactct

SEQ ID NO: 98023 - DNA, 675 bp, Homo sapiens
agtattttatggtgaggagcaagcaagcaagaaaggttattagcaagcaggaagcacagaggaagtgccttctggatctcaaacctggttgctggctaccagaggaaggaagaggagcagtttcgccattgccaaccacagagcagccgaccggtgcatcaccgaggccggctccgtcagctcggtcagctcgggtgggcttatttctttgagtggaggcaccactcagttctcagttcagaggaaaaagaatgagtggacaatgttgctgttgttgtctgcacagaatgctaggggagtgaaaggtgtttaaatagaggaagggaaagttcagaacagctgccaggccagagcagatgctgggagggcgggaagcggtgagaaggctggggtacaggattgctcccgagacccgcccaggcactggatgcacctgcagcctgagagcagcagggggcggggtgccgggaggagagggatttcagatcccctgtgccctgtggacgtcagaaagcaggactttctcttctgaaacctgggctagttctcaggtgcaacaggccctgggtgtgatgctctgaccaggcgccccgggtgtaagtactcaggcttctcgtgcttcctcttcatactacaccttttggaacccaagaacctcgcggctgctccttctgg

SEQ ID NO: 98024 - DNA, 361 bp, Homo sapiens
actaccatgagaacagtatggagtaaaccacctccatgattcaaattatctcccaccgggtccctcccacaacatgtgggaattatgggagtacagttcaggatgagatttgggtggggaacgcggaggcaaaccatatcagtaggtgtatgtctaacttcataaaatattgcaaaatggcttcccaaagtaaatcccaattttattagcatttttctctcaagaggataaggaatttatttttactatagccttttaaaataggtttgtgtcattagctccaatgtacagatctgaaaaacaaagtggcttcctgattcactaatggtcaatgtgtctctagtttgagaccgttaatata

SEQ ID NO: 98025 - DNA, 651 bp, Homo sapiens
aggcagaagggcagccaggaccatcagctcggtgccagccatagcaatagtttcagacccgtggagtcagctgtgctgttgccaacctccatcacctgtccgcctttatcctgggctctgttcctgtggatttgaacaaatagatgagcggcatcggaagaaagctttagctgcatgtgtttgggtgaccacgagagggcagcacgtaagagaccagtgtcggccccgctgccttcttgaacacaccggaagcctcctaggaaaactgcagattttgtcagactgtgaagtagaagagtcaaagagccttcattgcttccttttaaatgaccagcctactaaggaatttagaatgcccaagtaaggactgctggtcagactggacttcaaaattcctggatccttaagacccaatgcatcagacaaatgtcctgctggatcctcccaccgtcagctaagggacagtgctagctctctggtgagggagatccgtgtggaggtctctggcattcctgggtcagtggatggctgggagaactgctcagctccaggttccagggcctctgatcaaagccaaccctgggggccagccagagatatcgcaaacctaaggactaacgtggaatctacacctgccttgggagtaaagaa

SEQ ID NO: 98026 - DNA, 522 bp, Homo sapiens
atgttccaaacaaatgatgacgccatattatcagagatcagttacaaaccaaggttgcatactacctatgaatttccagtggtttgctttgtgaagaggcttaaattcccctctgtgatgcattttggaatgagtgggtttgatgcccacaccttgaaagaaatccctcaaaaaacaaaaggacaagagtcaccaactcccacacaaagtaaaacatggacacttaattttaacagtgttaataaggagcaactatccaagaagtcactgtatcaataatgcctgtgttataacaccctctcctccctaaagcaagggaacaagtgatacatcttgtctgaaaaccagtttcatcaatactgttgatgtgtctgtacaaagatgagtagcaacatctgttaccagtttcactacattttggagttttgaataacatatctataccatgatatttatactttttaatgagttaattttaagtgaaattgccattctaactctgaaatcaagctcatacataat

SEQ ID NO: 98027 - DNA, 467 bp, Homo sapiens
ttcatggtgctttcatccacctcagatggatccagtcacagctcctctccaagggctcttctaaaccattttcacatgctcacaacccaaaaacgaacaattcaagaaggaaaaacttagtctctgaagcataaacaacttcaacctgtcaagcatctgagcaggggacacacaggacactggggaacaatttttgacctccacgcagagagaacaaatgagcctctacaggaacctgagccgcaccttccgcgtttccatgttgctgggacctcaggaagtctgagcacagcagtgttctcccagaaatgaggaccagcaccgcgctcgcctattttcatcccaaacatctacaaaacaattcctagacaaactcccctggggaaaggaagggcaacgaagcaagcaagaggaaaaacaacccagaaacttctcatagtaacctgaagtttttgtttctgtttctg

SEQ ID NO: 98028 - DNA, 487 bp, Homo sapiens
cactgaccaggcagcactaacaagcaatggggaaactgagtcatttttatggacgtgtctagtctccagtatgttatatgttcctggggcacttgataaaccccttcctcttttccttctctgctattttgttctgttcctcagagtagtgggagagcgctctgcctgaacacttgatcgtgtgttgtggaccattccctgctgagtaatgacgtgcatcttttcgtgaacttgctgatcacttctgtatcttcttttctggagtgtctgttcaaattttttgctgatttttctttacttgaagacagagagaaacagggagattaagagagaccaaattttcctcccagtgtatgatttccttaataatttgatgatagtgtatcttgacgagcagtaatttttaattttttgaggttcatttgatcactttttattattacacctgcttttgtgctgcttaagatatcattgcttattccaattg

SEQ ID NO: 98029 - DNA, 729 bp, Homo sapiens
agcagtggcaacccactcgggtccccttacgcactgtggaagctttgttctttcgctctttgcaataaatcttggtgctgctcactcttcgggtccacactgcctttatgagctgtaacactcaccccgaaggtctgaagcttcactcctgaagccagcgagaccgcgaacccactgggaggaatgaacaactccagatgtgccgccttaaaagctgtaacactcactgcgaaggtctgcagcttcactcgtgagccagcgagaccacgaacccaccagaagtaagaaactctgaacacatccgaacatcagaaggaacaaactctggacatgctgcctttaagaactgtaatacttaccgcaagggtccgcggcttcattcttgaagtcagtgagaccaagaacccaccaattccagacacaaaaagacaatacctgccaatgccaagacgacactggtgctggcactacctgacaaacattttaaagcagccacgacaaaatgcttcaaggagcaatgacaagcacccttaaaacaaatgaaccaagtctcagccaaaaacagtatttaaaaatggaaattttaggccaggcgtggtggctcacacctgtaatcctagcactttgggaggctgaggcaggcggatcacttgaggtcaggagttcaaaaccagcctggccaacatggtgaaaccccatctctactaaaaatacaaaaaaattagttgg

SEQ ID NO: 98030 - DNA, 457 bp, Homo sapiens
tctgtcattttcgttttacccccgccgactttgtgctgttgggcattccgctcgccgttcatgaaagcgttccctcttgcttcatcctgatttgctgcttttagtttcatggtcttggaaacccaagcaatacactagtcaggactgtgccctgcatgggagcgaggccctgctgggaatgcaaccaaagagttagagtgtggcagccaccgtgactttggtacacttctctacctggattctgggctgggttcggagtgtttgctggaaagtggtctctgaataagcagggtgttcctccgtttaccatcaacaaggtgcacagatgactcaaagctcagaggtccttacaactgaaaacccagcccactggactccagggagcaatgaaaaaccacttgctaccctttaggggaggcctttgaggacccttcccagtccccacacatcccttctc

SEQ ID NO: 98031 - DNA, 710 bp, Homo sapiens
agcactactttgttgttcttcacaattagttggagctttctttggtcaacagcagatgtgactaagaaaatcacgctgtttcacttagagcagtggtcaccaagtgtggtccttaggccacacaggtcagcatcacctaggaactaggaaatgcaagttcttaagcaatcccacccagacctactgaattggaagtgctgaggatggggtccagcaatctgtggttgaacaagctctgcaggcatccaggagcagagctgtggggcagcagaatctgtgatgacagagaatgatgatgtatttttgccagcagatgcttttgctcctgttttgataccccaatattcggatgcagaaaaggactctgagcattgctgacgggtgtgctctgcacacctatctcttcaggatctgaataatttggtggaaagacaatgccttttctggaaaagggtgtcaggtcagtcatattggaggatgcaaatttccttatgtgatgggagtgagggttggggtagggcacttcacggagcattcagcagtctgcaattaagcatcactccaaggctttctgcataggtgatggctgtttctgcatcatggggcaaaccaggtgctagaacttcaaatgccaattaccaaaggcgcttcctgcggaggaaacctctctacaactcacctgacccagaaggcacacatttttttctggg

SEQ ID NO: 98032 - DNA, 817 bp, Homo sapiens
tggcatgatctccactcactgcaacctctgcctcctgggctcaagcaattctcttgcttcagcctcccaagtagctggaattacaggcatgtgccaccatgcctggccaaagacacttttttatagctctgcctgctgctataacaagtgttcctaaatacccatgtacatcctatattattagatttcctcaactctggttagctatgactgaaacattcatgccattgcagccagtgccctggaaagctataagcaagtcttaagacctgtgataagggctgacttgcaagctagctgccgatccatcttaatatctgacgagcccagtcatgttggctgtgtttaattgatccatttcctacttgcttcctcaacccagaggccaagggcagcacaaaaggatagtgaatctaaatgtctccagttttttgaggtataggaatctcctatgaagtggcagacctttgagaaatagtattatgagctgttctgttttgctgtggctttggaaaacctttggattcctctactgaaaatttgtttgaaaaaaaaatctttttaatgaaacagtgtgagtcataaagcagccaccaccccttctcataatagcatttctcaccaggggaatttttggtagctgttgggggagggatttgagtaggttgtggatgataaatcccttgaggggaacataaccaaaggctgccatatcagaacgctggtgctttccatgctgacaccaagccctgaattcaaagtgcaggacagcagaatagaacagagaagcctgtgctcagtgaattgctgcagtagc

SEQ ID NO: 98033 - DNA, 452 bp, Homo sapiens
ctgaagtcaagtcgcctctccctgatgtccagctgcttctcttctctgctcgctgagtctggggtcttcatgggcacaggatgggaggtgctgtaggtagttttggaaaaggcaacattcgattggtaaaaagacactcagaaagaaccattcaggagagagcagacaaacagggatggaaattctcactttgggccacaggtttcaggctttttggctcgaaggtggggttttgctgggcacctgtccctgtctgcctagaatttctctgcctcctgtctctatcaaaactatcatagaaaatatgcttccctctcacctttttcctccaaccacccagttcctgaaaccagacacaactattgttacggaaggaaagagttgaagtattctctttgaagtaaatagcttagtaatcagcttcaaatattttatgtgtagaatttttggtg

SEQ ID NO: 98034 - DNA, 675 bp, Homo sapiens
tcccgggttcacgctcctgcctcagcctcccgagtagctggaactacaggcgcccgccaccacgcccagctaatttttgtattttcagtagagacaggatttcattgtgttagccgggatggtctcgatctcctgacctcgtgatccacccgcctcggcctcccaaagtgctgggattacaggcgtgagccaccacaccccgccacttcaaatactctttaactttacacttaagcaaagaaatattacatatttcagtcctgaaaatattatgataaatcaaatagaccctatgacataggatatattaaatatttaagttttggaaatgtcctttatatacaaaatatttccattgttaacaagtgcttttcaaaaaatatttttattataccttagaaagagccaatttagggtctacactatctttgttcatctcgttttcttttttgcacatattcctttactaatgtagattagcactacaagataaaaagtatccagcatcataacattgtaattaattcccccatatcaaattatatgaaaaatcccacctcagacactctgccaaagggtatggaacatttaatcaagatgaagtgcttcaattgaagcagtatatgctcacctctatcagtaattttgtctcactttatttcaaagtattattat

SEQ ID NO: 98035 - DNA, 462 bp, Homo sapiens
agatttccctctcaaatgtgtcccaccattgtctgtctgctctctttaaacaaatggcacctctatttacctaagcacttggacaaaaaccctggtgatttcagttccttttcctcttccttccacacctcacttaccagcatacctggtaggtcctatctctaaattacaccccaaacccatctcttcattctctactgtcatcactgaagacaagcccacaacagtctctagatgggattacaccctgtttccaactcttgtctccatatctataatctgttcttcagccagttgcaaaagtcaagtaaacacacacacacacacacacacacacgcacgcgtgtgcgcaaaacccctcattttatttctggctcccagccctcaacaatcctccacccaccaactaaatcccaaagtcaaaagcttcagccagtatatctcagagaaccagggagcctt

SEQ ID NO: 98036 - DNA, 274 bp, Homo sapiens
tccattatcctctcacccatccatccatcatccactcatccatcatccacacactcacacatccttcatcagcacacccatccatccctcattgtggtatggatcctcccacccatccatctatctatccatcattcacccaccatccatccatcatccacccacccctccgtccatcatgctcccactcatccctcatccacccaccacacactcatccctcatcccccaccacacactcatccctcatccacccaccacgcactcatccctc

SEQ ID NO: 98037 - DNA, 610 bp, Homo sapiens
tttggtaatcactaaagaacatatctaggtattaattctttagttgaaacattttgaatttatgacattaccatatcttaagcaattatttattgaatatatacagtgtcctgtttctttttgttcttctatttcttcttatccagttcaatattcaaccatgttccagttacaataacagaaggcttactgtaatgagaattgaaattcaaattctgagagtctgtattcgtaactaattatgtatgtgtcatagtttctcagaaaggtatgatattcatgaaaatggggattcagtttttcttcaaagataagttctatcatagtagaaaatagtgttattttcaaagcagcattactctaacttctgaagttattcatagttgaaggagaacattctttatttttaaacaaacatacatacacatccagtccatgcttattttggttgacttgataaattgtgggcaatatatgtgtatatatgggtcattaatgatgataggctaatataatatatttggggcacagacaaagtttcataatatattgttaaatggaaatcaaatagaccaaacatgcatgcagcataattgtatttttggtaaaa

SEQ ID NO: 98038 - DNA, 258 bp, Homo sapiens
cttttgcagactcctcgctctcctgggtaaaatgaacccatattagcttgatagaggataagaaaccatttgaagagttgaggcatgatatctgttggtcagccaagccctaggagaaggacctctaagccagcctgcatttaattaacctcaaatgcatgaagtagctaagcccaataaaaggacccagttgaacccagtttaaattcccatgataatacaaattattaccaaaataaatatattttgttttaagct

SEQ ID NO: 98039 - DNA, 264 bp, Homo sapiens
tcaaatgtgggcaaagttttatgcgaagaaggatgttctttgtagcataatttatatgaggaattagaaacaccctgaggtccatcagctagggaaagacagcagaggggacagggcagcaccaggagggcttggcagccacagcaggggctgggctggcatctggcaagatccaggtctttgtgggacaaagaatcttagagaagcaacggggacacaggctgtccagtgcagcaccagtgaattcaccaagatgaagagttg

SEQ ID NO: 98040 - DNA, 235 bp, Homo sapiens
agggctaggaggggcatgagagctggatcacagccagaatttgggcctctctagatcggggaggaacaaaggggaaagtacccagaaggttcaataagactctctcgctgcacgccatgccccagccccagggttgggctgggcgggtgcccttctctagccattaggttacacagcctcactcctcactggaccaagctcagcccactgggtgccttgactcacgaccttcccc

SEQ ID NO: 98041 - DNA, 413 bp, Homo sapiens
ccaacgtgcgatgctatgaggctcacaggtacaaaccggaagcaggcagactctgcagctgttggaggtgacttggaggctgagcagacggacctgggcccgccctgcagctggtcgggtgctgagcccaccccagagaggcagacacacaaggcacactaactataaagaaggcagtgggcaggtgctgagcaggagcagagagccatcatcaggggcttgcaaggcggcggggcggggtgggggaaggaagcctgtctttaactcatgagggcagacaggggtgacaccaggtctgtggtggggcacagcagggtctcaatgccagagcctctgctgggaggtcatgagatcacgttctgttccatatttcctcacttctggccacttccctgacccagtgaacatgcatt

SEQ ID NO: 98042 - DNA, 895 bp, Homo sapiens
ggccttgggtgggaacaaccgttttttcccccctctcccctccccgaccccatcaacatcgtgcgacagtccgggcagttgagaaggccaccccgcttcgtgcctgcagcccaggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactaaagttgcctgattattataccattataaaaaacccaatggatttaaatacaattaagaagcgcttggagaataaatattatgcgaaggcttcagaatgtatagaagacttcaatacaatgttctcaaattgttatttatataacaagcctggagatgacattgttcttatggcacaagctctagagaagctgtattcataatttcataagacggatccagaccaaaattaaagatcttctgcagcaaatggaagaagggctgaagacagctgatccccatgactgctctgcttatactggctggacaggcatagcccttttgtacctgcagttgtaccgggtcacatgtgaccaaacctacctgctccgatccctggattacgtaaaaagaacacttcggaatctgaatggccgcagggtcaccttcctctgtgggggatgctggccccctggctgttggagctgtgattttatcacaaactcagaagtgactgtgagtccaggaatgtgtcacaaaacttttgcagctccagagatcggatgtctgccaagaatcagacc

SEQ ID NO: 98043 - DNA, 712 bp, Homo sapiens
atggattgactgtagaatctttttcaaataaaatacaaaacaagtgctctggagaagagcagaaagaacatcagcagtcatcagaagctcaagataaatccaaactctggcttctcaaagaccgtgatttagcaaggcagaaagaacaagagaggaggaggagagaagcaatggtgggtaccattgatatgacccttcaaagtgacattatgacaatgtttgaaaacaactttgattaaaactcagtttttaaattaaccatcaacttaaaatgaatggtaaaagatcaaaatgcatatggtaaaatgattgctttcagataacaagataccaatcttatattgtattttgactgctctaaaatgattaaacagttttcacttacatttttaatagctatatgcttattttttaaacgacataattcaaaggaaatttaataattttggatccctaaaaattggacaaattcccagatattcgttcattctataaataatctgtctatatattataggccctgtactaatgcaatgaaaatccaagaagatagcgtcctgcttgtgtttaacaatgacagagtatgtttactaagttcaataagtgaaaaataatgaagaagtatatgacaggtgtataaaagacatagttcctgttgagtatttaaagttttagaagcagataatcgtcgtggctttagaaatatttagat

SEQ ID NO: 98044 - DNA, 3399 bp, Homo sapiens
  misc_feature (933)..(933): n is a, c, g, or t
aaccagaagagcattttaagaatcataatagttcagtgcagatgttcctgggaggtcaagttaagagtcaaaaataattcattagatttaacaatttagcatggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactaaagttgcctgattattataccattataaaaaacccaatggatttaaatacaattaagaagcgcttggagaataaatattatgcgaaggcttcagaatgtatagaagacttcaatacaatgttctcaaattgttatttatataacaagcctggagatgacattgttcttatggcacaagctctagagaagctgtttatgcagaaattatctcagatgccacaagaagagcaagttgtgggtgttaaggaaagaatcaagaaaggcactcaacagaatatagctgtttcttctgctaaagaaaaatcatcacccagcgcaacagaaaaagtatttaagcagcaagaaattccttctgtatttcctaagacatctatttctcccttgaacgtggtacagggagcttcagtcaactccagttcacaaactgcggcccaagttacaaaaggtgtgaagaggaaagcagatacaacaactcctgcaacttcagcagttaaagcaagtagtgaattttctccaacattcacagaaaaatcagtggcactgccacctataaaagaaaatatgccaaagaatgttttgccagattctcagcaacaatataatgttgtgnagactgttaaagtaactgaacaattaaggcactgtagtgagattcttaaagaaatgcttgcaaagaaacatttttcatatgcatggcccttttataatcctgttgacgttaatgctttgggactccataactactatgacgttgtcaaaaatccgatggatcttggaactattaaggagaaaatggataaccaagaatataaggatgcatacaaatttgcggcagatgttagattaatgttcatgaattgctacaagtacaatcctccagatcacgaagttgtgacaatggcaagaatgcttcaggatgttttcgaaacgcatttttcaaagatcccgattgaacctgttgagagtatgcctttatgttacatcaaaacagatatcacagaaaccactggtagagagaacactaatgaagcctcctctgaagggaactcttctgatgattctgaagatgagcgagttaagcgtcttgcaaagcttcaggagcagcttaaagctgtacatcaacagctccaggttttgtcccaagtacctttccgtaagctaaataaaaagaaagagaagtctaaaaaggaaaagaaaaaagaaaaggttaataacagcaatgaaaatccaagaaaaatgtgtgagcaaatgaggctaaaggaaaagtccaagagaaatcagccaaagaaaaggaaacaacagttcattggtctaaaatctgaagatgaagataatgctaaacctatgaactatgatgagaaaaggcagttaagtctgaatataaacaaactccctggagataaacttgggcgagtagttcacataatacaatcaagagagccttctctgagcaattccaatcctgatgagatagagatagactttgaaacactgaaagcatcaacactaagagaattagaaaaatatgtttcggcatgtctaagaaagagaccattaaaacctcctgctaagaaaataatgatgtccaaagaagaacttcactcacagaaaaaacaggaattggaaaagcggttactggatgttaataatcagttaaattctagaaaacgtcaaacaaaatctgataaaacgcaaccatccaaagctgttgaaaatgtttcccgactgagtgagagcagcagcagcagcagcagctcatcagagtctgaaagtagcagcagtgacttaagctcttcagacagcagtgattctgaatcagaaatgttccctaagtttacagaagtaaaaccaaatgattctccttctaaagagcatgtaaagaaaatgaagaatgaatgcatactgcctgaaggaagaacaggcgtcacacagataggatattgtgtgcaagacacaacctctgccaatactacccttgttcatcagaccacaccttcacatgtaatgccaccaaatcaccaccaattagcatttaattatcaagaattagaacatttacagactgtgaaaaacatttcacctttacaaattctgcctccctcaggtgattctgaacagctctcaaatggcataactgtgatgcatccatctggtgatagtgacacaacgatgttagaatctgaatgtcaagctcctgtacagaaggatataaagattaagaatgcagattcatggaaaagtttaggcaaaccagtgaaaccatcaggtgtaatgaaatcctcagatgagctcttcaaccaatttagaaaagcagccatagaaaaggaagtaaaagctcggacacaggaactcatacggaagcatttggaacaaaatacaaaggaactaaaagcatctcaagaaaatcagagggatcttgggaatggattgactgtagaatctttttcaaataaaatacaaaacaagtgctctggagaagagcagaaagaacatcagcagtcatcagaagctcaagataaatccaaactctggcttctcaaagaccgtgatttagcaaggcagaaagaacaagagaggaggaggagagaagcaatggtgggtaccattgatatgacccttcaaagtgacattatgacaatgtttgaaaacaactttgattaaaactcagtttttaaattaaccatcaacttaaaatgaatggtaaaagatcaaaatgcatatggtaaaatgattgctttcagataacaagataccaatcttatattgtattttgactgctctaaaatgattaaacagttttcacttacatttttaaaaaaaaaaaaaaaaaaaaaaaaaaaaaaaaaaaaaaaaaaaaaaaaaaaaaggggggggagcaacacaaaaaataacccagaaggggcaacaagaaaaagagacaccacgaaaatatgatagaaaaaagagaggccccccaaaagagagagaacaaaaaaaaacagagaagcacaagagagcacataaaaaaaaagaagacaacgggaaaaacagtagaaaagaagaaacaacagagaagagaaacaaaaacagaaggaga

SEQ ID NO: 98045 - DNA, 3410 bp, Homo sapiens
  misc_feature (944)..(944): n is a, c, g, or t
ggccttgggtgggaacaaccgttttttcccccctctcccctccccgaccccatcaacatcgtgcgacagtccgggcagttgagaaggccaccccgcttcgtgcctgcagcccaggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactaaagttgcctgattattataccattataaaaaacccaatggatttaaatacaattaagaagcgcttggagaataaatattatgcgaaggcttcagaatgtatagaagacttcaatacaatgttctcaaattgttatttatataacaagcctggagatgacattgttcttatggcacaagctctagagaagctgtttatgcagaaattatctcagatgccacaagaagagcaagttgtgggtgttaaggaaagaatcaagaaaggcactcaacagaatatagctgtttcttctgctaaagaaaaatcatcacccagcgcaacagaaaaagtatttaagcagcaagaaattccttctgtatttcctaagacatctatttctcccttgaacgtggtacagggagcttcagtcaactccagttcacaaactgcggcccaagttacaaaaggtgtgaagaggaaagcagatacaacaactcctgcaacttcagcagttaaagcaagtagtgaattttctccaacattcacagaaaaatcagtggcactgccacctataaaagaaaatatgccaaagaatgttttgccagattctcagcaacaatataatgttgtgnagactgttaaagtaactgaacaattaaggcactgtagtgagattcttaaagaaatgcttgcaaagaaacatttttcatatgcatggcccttttataatcctgttgacgttaatgctttgggactccataactactatgacgttgtcaaaaatccgatggatcttggaactattaaggagaaaatggataaccaagaatataaggatgcatacaaatttgcggcagatgttagattaatgttcatgaattgctacaagtacaatcctccagatcacgaagttgtgacaatggcaagaatgcttcaggatgttttcgaaacgcatttttcaaagatcccgattgaacctgttgagagtatgcctttatgttacatcaaaacagatatcacagaaaccactggtagagagaacactaatgaagcctcctctgaagggaactcttctgatgattctgaagatgagcgagttaagcgtcttgcaaagcttcaggagcagcttaaagctgtacatcaacagctccaggttttgtcccaagtacctttccgtaagctaaataaaaagaaagagaagtctaaaaaggaaaagaaaaaagaaaaggttaataacagcaatgaaaatccaagaaaaatgtgtgagcaaatgaggctaaaggaaaagtccaagagaaatcagccaaagaaaaggaaacaacagttcattggtctaaaatctgaagatgaagataatgctaaacctatgaactatgatgagaaaaggcagttaagtctgaatataaacaaactccctggagataaacttgggcgagtagttcacataatacaatcaagagagccttctctgagcaattccaatcctgatgagatagagatagactttgaaacactgaaagcatcaacactaagagaattagaaaaatatgtttcggcatgtctaagaaagagaccattaaaacctcctgctaagaaaataatgatgtccaaagaagaacttcactcacagaaaaaacaggaattggaaaagcggttactggatgttaataatcagttaaattctagaaaacgtcaaacaaaatctgataaaacgcaaccatccaaagctgttgaaaatgtttcccgactgagtgagagcagcagcagcagcagcagctcatcagagtctgaaagtagcagcagtgacttaagctcttcagacagcagtgattctgaatcagaaatgttccctaagtttacagaagtaaaaccaaatgattctccttctaaagagcatgtaaagaaaatgaagaatgaatgcatactgcctgaaggaagaacaggcgtcacacagataggatattgtgtgcaagacacaacctctgccaatactacccttgttcatcagaccacaccttcacatgtaatgccaccaaatcaccaccaattagcatttaattatcaagaattagaacatttacagactgtgaaaaacatttcacctttacaaattctgcctccctcaggtgattctgaacagctctcaaatggcataactgtgatgcatccatctggtgatagtgacacaacgatgttagaatctgaatgtcaagctcctgtacagaaggatataaagattaagaatgcagattcatggaaaagtttaggcaaaccagtgaaaccatcaggtgtaatgaaatcctcagatgagctcttcaaccaatttagaaaagcagccatagaaaaggaagtaaaagctcggacacaggaactcatacggaagcatttggaacaaaatacaaaggaactaaaagcatctcaagaaaatcagagggatcttgggaatggattgactgtagaatctttttcaaataaaatacaaaacaagtgctctggagaagagcagaaagaacatcagcagtcatcagaagctcaagataaatccaaactctggcttctcaaagaccgtgatttagcaaggcagaaagaacaagagaggaggaggagagaagcaatggtgggtaccattgatatgacccttcaaagtgacattatgacaatgtttgaaaacaactttgattaaaactcagtttttaaattaaccatcaacttaaaatgaatggtaaaagatcaaaatgcatatggtaaaatgattgctttcagataacaagataccaatcttatattgtattttgactgctctaaaatgattaaacagttttcacttacatttttaaaaaaaaaaaaaaaaaaaaaaaaaaaaaaaaaaaaaaaaaaaaaaaaaaaaaggggggggagcaacacaaaaaataacccagaaggggcaacaagaaaaagagacaccacgaaaatatgatagaaaaaagagaggccccccaaaagagagagaacaaaaaaaaacagagaagcacaagagagcacataaaaaaaaagaagacaacgggaaaaacagtagaaaagaagaaacaacagagaagagaaacaaaaacagaaggaga

SEQ ID NO: 98046 - DNA, 3460 bp, Homo sapiens
  misc_feature (994)..(994): n is a, c, g, or t
acaacaaaaactggcggcgaggaactgcggagaactgttgccctgcaccgcttcattttgtgcagcctgaaaggggcaatcacataaggtcggttttgtaatatacaggtaacatacagtccgggcagttgagaaggccaccccgcttcgtgcctgcagcccaggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactaaagttgcctgattattataccattataaaaaacccaatggatttaaatacaattaagaagcgcttggagaataaatattatgcgaaggcttcagaatgtatagaagacttcaatacaatgttctcaaattgttatttatataacaagcctggagatgacattgttcttatggcacaagctctagagaagctgtttatgcagaaattatctcagatgccacaagaagagcaagttgtgggtgttaaggaaagaatcaagaaaggcactcaacagaatatagctgtttcttctgctaaagaaaaatcatcacccagcgcaacagaaaaagtatttaagcagcaagaaattccttctgtatttcctaagacatctatttctcccttgaacgtggtacagggagcttcagtcaactccagttcacaaactgcggcccaagttacaaaaggtgtgaagaggaaagcagatacaacaactcctgcaacttcagcagttaaagcaagtagtgaattttctccaacattcacagaaaaatcagtggcactgccacctataaaagaaaatatgccaaagaatgttttgccagattctcagcaacaatataatgttgtgnagactgttaaagtaactgaacaattaaggcactgtagtgagattcttaaagaaatgcttgcaaagaaacatttttcatatgcatggcccttttataatcctgttgacgttaatgctttgggactccataactactatgacgttgtcaaaaatccgatggatcttggaactattaaggagaaaatggataaccaagaatataaggatgcatacaaatttgcggcagatgttagattaatgttcatgaattgctacaagtacaatcctccagatcacgaagttgtgacaatggcaagaatgcttcaggatgttttcgaaacgcatttttcaaagatcccgattgaacctgttgagagtatgcctttatgttacatcaaaacagatatcacagaaaccactggtagagagaacactaatgaagcctcctctgaagggaactcttctgatgattctgaagatgagcgagttaagcgtcttgcaaagcttcaggagcagcttaaagctgtacatcaacagctccaggttttgtcccaagtacctttccgtaagctaaataaaaagaaagagaagtctaaaaaggaaaagaaaaaagaaaaggttaataacagcaatgaaaatccaagaaaaatgtgtgagcaaatgaggctaaaggaaaagtccaagagaaatcagccaaagaaaaggaaacaacagttcattggtctaaaatctgaagatgaagataatgctaaacctatgaactatgatgagaaaaggcagttaagtctgaatataaacaaactccctggagataaacttgggcgagtagttcacataatacaatcaagagagccttctctgagcaattccaatcctgatgagatagagatagactttgaaacactgaaagcatcaacactaagagaattagaaaaatatgtttcggcatgtctaagaaagagaccattaaaacctcctgctaagaaaataatgatgtccaaagaagaacttcactcacagaaaaaacaggaattggaaaagcggttactggatgttaataatcagttaaattctagaaaacgtcaaacaaaatctgataaaacgcaaccatccaaagctgttgaaaatgtttcccgactgagtgagagcagcagcagcagcagcagctcatcagagtctgaaagtagcagcagtgacttaagctcttcagacagcagtgattctgaatcagaaatgttccctaagtttacagaagtaaaaccaaatgattctccttctaaagagcatgtaaagaaaatgaagaatgaatgcatactgcctgaaggaagaacaggcgtcacacagataggatattgtgtgcaagacacaacctctgccaatactacccttgttcatcagaccacaccttcacatgtaatgccaccaaatcaccaccaattagcatttaattatcaagaattagaacatttacagactgtgaaaaacatttcacctttacaaattctgcctccctcaggtgattctgaacagctctcaaatggcataactgtgatgcatccatctggtgatagtgacacaacgatgttagaatctgaatgtcaagctcctgtacagaaggatataaagattaagaatgcagattcatggaaaagtttaggcaaaccagtgaaaccatcaggtgtaatgaaatcctcagatgagctcttcaaccaatttagaaaagcagccatagaaaaggaagtaaaagctcggacacaggaactcatacggaagcatttggaacaaaatacaaaggaactaaaagcatctcaagaaaatcagagggatcttgggaatggattgactgtagaatctttttcaaataaaatacaaaacaagtgctctggagaagagcagaaagaacatcagcagtcatcagaagctcaagataaatccaaactctggcttctcaaagaccgtgatttagcaaggcagaaagaacaagagaggaggaggagagaagcaatggtgggtaccattgatatgacccttcaaagtgacattatgacaatgtttgaaaacaactttgattaaaactcagtttttaaattaaccatcaacttaaaatgaatggtaaaagatcaaaatgcatatggtaaaatgattgctttcagataacaagataccaatcttatattgtattttgactgctctaaaatgattaaacagttttcacttacatttttaaaaaaaaaaaaaaaaaaaaaaaaaaaaaaaaaaaaaaaaaaaaaaaaaaaaaggggggggagcaacacaaaaaataacccagaaggggcaacaagaaaaagagacaccacgaaaatatgatagaaaaaagagaggccccccaaaagagagagaacaaaaaaaaacagagaagcacaagagagcacataaaaaaaaagaagacaacgggaaaaacagtagaaaagaagaaacaacagagaagagaaacaaaaacagaaggaga

SEQ ID NO: 98047 - DNA, 1517 bp, Homo sapiens
  misc_feature (944)..(944): n is a, c, g, or t
ggccttgggtgggaacaaccgttttttcccccctctcccctccccgaccccatcaacatcgtgcgacagtccgggcagttgagaaggccaccccgcttcgtgcctgcagcccaggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactaaagttgcctgattattataccattataaaaaacccaatggatttaaatacaattaagaagcgcttggagaataaatattatgcgaaggcttcagaatgtatagaagacttcaatacaatgttctcaaattgttatttatataacaagcctggagatgacattgttcttatggcacaagctctagagaagctgtttatgcagaaattatctcagatgccacaagaagagcaagttgtgggtgttaaggaaagaatcaagaaaggcactcaacagaatatagctgtttcttctgctaaagaaaaatcatcacccagcgcaacagaaaaagtatttaagcagcaagaaattccttctgtatttcctaagacatctatttctcccttgaacgtggtacagggagcttcagtcaactccagttcacaaactgcggcccaagttacaaaaggtgtgaagaggaaagcagatacaacaactcctgcaacttcagcagttaaagcaagtagtgaattttctccaacattcacagaaaaatcagtggcactgccacctataaaagaaaatatgccaaagaatgttttgccagattctcagcaacaatataatgttgtgnagactgttaaagtaactgaacaattaaggcactgtagtgagattcttaaagaaatgcttgcaaagaaacatttttcatatgcatggcccttttataatcctgttgacgttaatgctttgggactccataactactatgacgttgtcaaaaatccgatggatcttggaactattaaggagaaaatggataaccaagaatataaggatgcatacaaatttgcggcagatgttagattaatgttcatgaattgctacaagtacaatcctccagatcacgaagttgtgacaatggcaagaatgcttcaggatgttttcgaaacgcatttttcaaagatcccgattgaacctgttgagagtatgcctttatgttacatcaaaacagatatcacagaaaccactggtagagagaacactaatgaagcctcctctgaagggaactcttctgatgattctgaagatgagcgagttaagcgtcttgcaaagcttcaggagcagcttaaagctgtacatcaacagctccaggttttgtcccaagtacctttccgtaagctaaataaaaagaaagagaagtcta

SEQ ID NO: 98048 - DNA, 4035 bp, Homo sapiens
  misc_feature (1569)..(1569): n is a, c, g, or t
acaacaaaaactggcggcgaggaactgcggagaactgttgccctgcaccgcttcattttgtgcagcctgaaaggggcaatcacataaggtcggttttgtaatatacaggtaacatacagtccgggcagttgagaaggccaccccgcttcgtgcctgcagcccaggtcttggactggtgtggatcgctgctgcctgtactgtaattttggaaatgcaggagaaagtacggagcgtttagctttagctggcattttgtgtttattctgcaagtggtcatttgggacggggaagttcgggttcttgcttcatttatttattcaattaactttattaagcccctggaacgtctgaaccctcttttgggtactgcaggattgtggtgggctttacttcaaggcgcgctggcctgtattaagaattaagatagaggaggccgggtgcagtggctcgcccctgtaatctcagcactttcggaggccgaggcaagtggatcacctgaggtcaggagttcaagaccagcctggccaacataatgaaatgcccatctctaccaaaaatacaaaaattagctgggtgtgatggcaggcgcctgtagtcccagctactcgggaggctgaggcaggagaatcgcttgaacccaggaggcggaagttgcagtgcgccgagatcacgccagtgcactccagcctgggcgacagagtgagactccgtctccccgctccccccaaaaaagaaagaggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactaaagttgcctgattattataccattataaaaaacccaatggatttaaatacaattaagaagcgcttggagaataaatattatgcgaaggcttcagaatgtatagaagacttcaatacaatgttctcaaattgttatttatataacaagcctggagatgacattgttcttatggcacaagctctagagaagctgtttatgcagaaattatctcagatgccacaagaagagcaagttgtgggtgttaaggaaagaatcaagaaaggcactcaacagaatatagctgtttcttctgctaaagaaaaatcatcacccagcgcaacagaaaaagtatttaagcagcaagaaattccttctgtatttcctaagacatctatttctcccttgaacgtggtacagggagcttcagtcaactccagttcacaaactgcggcccaagttacaaaaggtgtgaagaggaaagcagatacaacaactcctgcaacttcagcagttaaagcaagtagtgaattttctccaacattcacagaaaaatcagtggcactgccacctataaaagaaaatatgccaaagaatgttttgccagattctcagcaacaatataatgttgtgnagactgttaaagtaactgaacaattaaggcactgtagtgagattcttaaagaaatgcttgcaaagaaacatttttcatatgcatggcccttttataatcctgttgacgttaatgctttgggactccataactactatgacgttgtcaaaaatccgatggatcttggaactattaaggagaaaatggataaccaagaatataaggatgcatacaaatttgcggcagatgttagattaatgttcatgaattgctacaagtacaatcctccagatcacgaagttgtgacaatggcaagaatgcttcaggatgttttcgaaacgcatttttcaaagatcccgattgaacctgttgagagtatgcctttatgttacatcaaaacagatatcacagaaaccactggtagagagaacactaatgaagcctcctctgaagggaactcttctgatgattctgaagatgagcgagttaagcgtcttgcaaagcttcaggagcagcttaaagctgtacatcaacagctccaggttttgtcccaagtacctttccgtaagctaaataaaaagaaagagaagtctaaaaaggaaaagaaaaaagaaaaggttaataacagcaatgaaaatccaagaaaaatgtgtgagcaaatgaggctaaaggaaaagtccaagagaaatcagccaaagaaaaggaaacaacagttcattggtctaaaatctgaagatgaagataatgctaaacctatgaactatgatgagaaaaggcagttaagtctgaatataaacaaactccctggagataaacttgggcgagtagttcacataatacaatcaagagagccttctctgagcaattccaatcctgatgagatagagatagactttgaaacactgaaagcatcaacactaagagaattagaaaaatatgtttcggcatgtctaagaaagagaccattaaaacctcctgctaagaaaataatgatgtccaaagaagaacttcactcacagaaaaaacaggaattggaaaagcggttactggatgttaataatcagttaaattctagaaaacgtcaaacaaaatctgataaaacgcaaccatccaaagctgttgaaaatgtttcccgactgagtgagagcagcagcagcagcagcagctcatcagagtctgaaagtagcagcagtgacttaagctcttcagacagcagtgattctgaatcagaaatgttccctaagtttacagaagtaaaaccaaatgattctccttctaaagagcatgtaaagaaaatgaagaatgaatgcatactgcctgaaggaagaacaggcgtcacacagataggatattgtgtgcaagacacaacctctgccaatactacccttgttcatcagaccacaccttcacatgtaatgccaccaaatcaccaccaattagcatttaattatcaagaattagaacatttacagactgtgaaaaacatttcacctttacaaattctgcctccctcaggtgattctgaacagctctcaaatggcataactgtgatgcatccatctggtgatagtgacacaacgatgttagaatctgaatgtcaagctcctgtacagaaggatataaagattaagaatgcagattcatggaaaagtttaggcaaaccagtgaaaccatcaggtgtaatgaaatcctcagatgagctcttcaaccaatttagaaaagcagccatagaaaaggaagtaaaagctcggacacaggaactcatacggaagcatttggaacaaaatacaaaggaactaaaagcatctcaagaaaatcagagggatcttgggaatggattgactgtagaatctttttcaaataaaatacaaaacaagtgctctggagaagagcagaaagaacatcagcagtcatcagaagctcaagataaatccaaactctggcttctcaaagaccgtgatttagcaaggcagaaagaacaagagaggaggaggagagaagcaatggtgggtaccattgatatgacccttcaaagtgacattatgacaatgtttgaaaacaactttgattaaaactcagtttttaaattaaccatcaacttaaaatgaatggtaaaagatcaaaatgcatatggtaaaatgattgctttcagataacaagataccaatcttatattgtattttgactgctctaaaatgattaaacagttttcacttacatttttaaaaaaaaaaaaaaaaaaaaaaaaaaaaaaaaaaaaaaaaaaaaaaaaaaaaaggggggggagcaacacaaaaaataacccagaaggggcaacaagaaaaagagacaccacgaaaatatgatagaaaaaagagaggccccccaaaagagagagaacaaaaaaaaacagagaagcacaagagagcacataaaaaaaaagaagacaacgggaaaaacagtagaaaagaagaaacaacagagaagagaaacaaaaacagaaggaga

SEQ ID NO: 98049 - DNA, 3526 bp, Homo sapiens
  misc_feature (933)..(933): n is a, c, g, or t
aaccagaagagcattttaagaatcataatagttcagtgcagatgttcctgggaggtcaagttaagagtcaaaaataattcattagatttaacaatttagcatggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactaaagttgcctgattattataccattataaaaaacccaatggatttaaatacaattaagaagcgcttggagaataaatattatgcgaaggcttcagaatgtatagaagacttcaatacaatgttctcaaattgttatttatataacaagcctggagatgacattgttcttatggcacaagctctagagaagctgtttatgcagaaattatctcagatgccacaagaagagcaagttgtgggtgttaaggaaagaatcaagaaaggcactcaacagaatatagctgtttcttctgctaaagaaaaatcatcacccagcgcaacagaaaaagtatttaagcagcaagaaattccttctgtatttcctaagacatctatttctcccttgaacgtggtacagggagcttcagtcaactccagttcacaaactgcggcccaagttacaaaaggtgtgaagaggaaagcagatacaacaactcctgcaacttcagcagttaaagcaagtagtgaattttctccaacattcacagaaaaatcagtggcactgccacctataaaagaaaatatgccaaagaatgttttgccagattctcagcaacaatataatgttgtgnagactgttaaagtaactgaacaattaaggcactgtagtgagattcttaaagaaatgcttgcaaagaaacatttttcatatgcatggcccttttataatcctgttgacgttaatgctttgggactccataactactatgacgttgtcaaaaatccgatggatcttggaactattaaggtaaatgttgccttaaaaggaagaacttctttttcttgattataaaagtaattcatcattgcaaagaaatcttaaaatctagaaaaagatgaaggaaattaagatcatccaagtcacactatctggagagaaaatggataaccaagaatataaggatgcatacaaatttgcggcagatgttagattaatgttcatgaattgctacaagtacaatcctccagatcacgaagttgtgacaatggcaagaatgcttcaggatgttttcgaaacgcatttttcaaagatcccgattgaacctgttgagagtatgcctttatgttacatcaaaacagatatcacagaaaccactggtagagagaacactaatgaagcctcctctgaagggaactcttctgatgattctgaagatgagcgagttaagcgtcttgcaaagcttcaggagcagcttaaagctgtacatcaacagctccaggttttgtcccaagtacctttccgtaagctaaataaaaagaaagagaagtctaaaaaggaaaagaaaaaagaaaaggttaataacagcaatgaaaatccaagaaaaatgtgtgagcaaatgaggctaaaggaaaagtccaagagaaatcagccaaagaaaaggaaacaacagttcattggtctaaaatctgaagatgaagataatgctaaacctatgaactatgatgagaaaaggcagttaagtctgaatataaacaaactccctggagataaacttgggcgagtagttcacataatacaatcaagagagccttctctgagcaattccaatcctgatgagatagagatagactttgaaacactgaaagcatcaacactaagagaattagaaaaatatgtttcggcatgtctaagaaagagaccattaaaacctcctgctaagaaaataatgatgtccaaagaagaacttcactcacagaaaaaacaggaattggaaaagcggttactggatgttaataatcagttaaattctagaaaacgtcaaacaaaatctgataaaacgcaaccatccaaagctgttgaaaatgtttcccgactgagtgagagcagcagcagcagcagcagctcatcagagtctgaaagtagcagcagtgacttaagctcttcagacagcagtgattctgaatcagaaatgttccctaagtttacagaagtaaaaccaaatgattctccttctaaagagcatgtaaagaaaatgaagaatgaatgcatactgcctgaaggaagaacaggcgtcacacagataggatattgtgtgcaagacacaacctctgccaatactacccttgttcatcagaccacaccttcacatgtaatgccaccaaatcaccaccaattagcatttaattatcaagaattagaacatttacagactgtgaaaaacatttcacctttacaaattctgcctccctcaggtgattctgaacagctctcaaatggcataactgtgatgcatccatctggtgatagtgacacaacgatgttagaatctgaatgtcaagctcctgtacagaaggatataaagattaagaatgcagattcatggaaaagtttaggcaaaccagtgaaaccatcaggtgtaatgaaatcctcagatgagctcttcaaccaatttagaaaagcagccatagaaaaggaagtaaaagctcggacacaggaactcatacggaagcatttggaacaaaatacaaaggaactaaaagcatctcaagaaaatcagagggatcttgggaatggattgactgtagaatctttttcaaataaaatacaaaacaagtgctctggagaagagcagaaagaacatcagcagtcatcagaagctcaagataaatccaaactctggcttctcaaagaccgtgatttagcaaggcagaaagaacaagagaggaggaggagagaagcaatggtgggtaccattgatatgacccttcaaagtgacattatgacaatgtttgaaaacaactttgattaaaactcagtttttaaattaaccatcaacttaaaatgaatggtaaaagatcaaaatgcatatggtaaaatgattgctttcagataacaagataccaatcttatattgtattttgactgctctaaaatgattaaacagttttcacttacatttttaaaaaaaaaaaaaaaaaaaaaaaaaaaaaaaaaaaaaaaaaaaaaaaaaaaaaggggggggagcaacacaaaaaataacccagaaggggcaacaagaaaaagagacaccacgaaaatatgatagaaaaaagagaggccccccaaaagagagagaacaaaaaaaaacagagaagcacaagagagcacataaaaaaaaagaagacaacgggaaaaacagtagaaaagaagaaacaacagagaagagaaacaaaaacagaaggaga

SEQ ID NO: 98050 - DNA, 854 bp, Homo sapiens
atggattgactgtagaatctttttcaaataaaatacaaaacaagtgctctggagaagagcagaaagaacatcagcagtcatcagaagctcaagataaatccaaactctggcttctcaaagaccgtgatttagcaaggcagaaagaacaagagaggaggaggagagaagcagtggagtttcgctcttgtcgcccagcctggaatgcaatggtgcaatctcagctcactgcaacctccacctccctggttcaagtgattctcctgcctcagcctcccaagtagctgggattccaggcacccaccaccacgcctgatggtgggtaccattgatatgacccttcaaagtgacattatgacaatgtttgaaaacaactttgattaaaactcagtttttaaattaaccatcaacttaaaatgaatggtaaaagatcaaaatgcatatggtaaaatgattgctttcagataacaagataccaatcttatattgtattttgactgctctaaaatgattaaacagttttcacttacatttttaatagctatatgcttattttttaaacgacataattcaaaggaaatttaataattttggatccctaaaaattggacaaattcccagatattcgttcattctataaataatctgtctatatattataggccctgtactaatgcaatgaaaatccaagaagatagcgtcctgcttgtgtttaacaatgacagagtatgtttactaagttcaataagtgaaaaataatgaagaagtatatgacaggtgtataaaagacatagttcctgttgagtatttaaagttttagaagcagataatcgtcgtggctttagaaatatttagat

SEQ ID NO: 98051 - DNA, 666 bp, Homo sapiens
  misc_feature (14)..(14): n is a, c, g, or t
ggctgttctagagnatcccagtcgcttgaaaatgcccacccagtcagaagaagagaagttatctcctagcccaactacagaggtacagtagtctttttagtgttgaaaaatggcatgtttttaaatgggttgattattccttggaaacagaagtacagtataggataattaaaaaatgaagaaagctacctttatagctaaacgtagcactacaatattcagggtaggtgtggagagaagcagagagaaattaaattttatcaggtattcagaataatggtctcagacaaaaaaacaatgagtgtgggagatgttagcataagtagagagcttacaaattaaatgtttaattgcttttgaaaacagtttgtaacctttacattctgttgaaggcgtgtcttactacataaagtcataaatgcaaattaagcattttttctccccatggctgttttggagggacaagaagtatggacttaatcttgaggtgaacaacagtttaaatgtgattttggtaaaatcctcataggctgaagatgccaagcgcctgtgtttaccagtgggcgactaccctttttcagtgctgacgggctatcaggactccttaatttaaaaaaaagtgtagttaacccccttggcattttcataccacttactgtgaatgtg

SEQ ID NO: 98052 - DNA, 901 bp, Homo sapiens
cggacgcgtgggtcgacccacgcgtccggcccagtttccatctctcagggcccacccaggaaaatggatttcaagtgggggttttcatccagagatttgtttaacacaaaacaagaaaagctgagaggcaaaacaggggagtgaggggcaacccagaggtggggaacaacaacagcaagccgcccccatcctgagactggctgggcaccaggggaggacgcgtcaccagagcctggggccaaggccactgggggacctgccacactgtggacctgtctggtgggggctggagcctcgagaagccatgattcttgtcagaaacatttccccaggcagagagagggggccccagcctctcccctcctcttggcctccagagtcctgcaggtgcctcacagtagtgaaacccagttggaagcagctgccctgggagcctgggacaggcgacccaccgggtcagtcccctgccactcagagcagagcagggggctgagggcaagcaggtggggctgtgcgtggcctcagtgcactcggtgtcatgtctgagcctggtgtttatgccccactgctgtcctaagtccctggcgaggggaggtggaggagctgccccgtgggtgtttggagattctgttttactctgcctagagaggaaacggctttggggagggagggggaagcctttattctttactgttgtccctgttttcctttgggggaatttactcagttagcagcccctcctcaccattccccccaggaaggccatgtcccagttttctgtccacccctcctgttcctctgcactatgtctctgatttcgcgtccgggagttacccaagaggcccgtgtctcgagtttcccgagaaatcgttgcggtgtcccacccggggatgcgcgagag

SEQ ID NO: 98053 - DNA, 713 bp, Homo sapiens
tagcgcgcctggaccctctcgagatgctgcccttagagtgggatgaaagtctggggaggaacgccttgtcaccggcaaaaacagcctttctcttggtcttcgtctgcatcctccttttcaaaatatcttgatttcccccgcgcacccctgacccggctgcagcaccggccctccgagcgggaagagccccgtgaaggctccgcagagcgatctaccccgcgctcttgtccgtgcccagaaagcgggttccacttggcagggattattttaaactgctaccagcaattcattcacctgacacccgacaccggcagcccagcccgccggaggcgagacaggtgagttgtaaggcgaaccgtgttagatgcaaaacaaatactagaagaaaaaaataagggtggggtagggtgagatgcggtcatctgaccacagggtaacctggctggttaaagggaagagtttttcattgccctctacttttcgtaattttgtaggattgtccggtgcccgctagaggtcgccaaacggagtccttttgcgctggttcttaagtggattcctagtgaaaaggcagacaactgaaaatgtgagtgctgtcttttaagtaaaatcactctcggtggcttcttaaagaatgaaaatctctgtgagttgtttatccccagacttggataatttatcttaagagcactaaatgtgattaaaagctcaaa

SEQ ID NO: 98054 - DNA, 212 bp, Homo sapiens
cgggccagttgtggtgctggtgcagctggagcgagaggaggaagtcacaggcctctgaagctagcttatttgaagaggcactggaaaaatatggcaaagacttcaatgacatacggcaagattttgtaagtagaaaattatgagtaaaataaaatgttgagatgggaatattctgttttagaaatctggtaaaccttacagtattcatttag

SEQ ID NO: 98055 - DNA, 5874 bp, Homo sapiens
tttgtatctgtgagagtaggaaggccgtgaaaacagaggttgtttagagaattggcctgggacaataaccatttagaagctttaggcacgtaaccagttaagtgtccatcgacatgaaactgattgaatacaatctcctctgtttgggggtggtggtgattgtgaactgtagggccctgttcccccatggacaaaggaagcccctcactcctaaaggtcccttttcccagcagaacaggccctgcatatacagtgcccgtctagagccagggcctccatctgggtgttggacagttggttctgctcagcccagttttggggtaaacgatgacgcagttagggtggcctaggaagggagtttttctacctctgtccccagctgggtctctggcgaggcgggaagcacccggaatcttcctggccctagagcctgcaggctccaggccggccccttgaatctcaccgcgaggaaggcaccctgctgcctgcacttatttgcatccaagagtttgcattgagactggcgcttgcctactagggcagccacaggggggttccccagggacagagattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggatgaactcacgtgctgtgtgtcagactgagctttccctgattcattctacaatccaagacttgctgcactgtcctgctgatgttcacagccgtgcctgggaagaaggcagccccactcccagtacatttcagtgggagacctctgcgtgcatccatggagacgcaatggggcggggaaggaactgtgggagtgcacgttccaaatcctgtgtctccacgtgtggatcagcagcacctcgctttcttgtcagagacctcgctgttacggagcgagacctgctgagaattgaggggctgagggaacccctccacctcctcccttctgcagcgccctgcgccccacccagcaacagcggccacttggcagtggggctgctgcaagctcagagccgctgccaccctgcatgtgtccgctcagctcggtcttatgctgtatagttactaaatatgtacaggagggccatggcatctttctgaatggatttttcttaagaaatgcgccagtgtttatgaggttcaaggtatttccctgtccttgctgttaccgtcactcagctttttctcgataggcttcatccttgtttttttgaaatgggggaatttgctgtttaccctctgcattcctatatgtgaccctccctcctactcctccaaggaacagaattaccgaggttctgacaaaagataagcctgtaaactcatcatctgtgttttgtggttggagagaaactggtgttctgcccggctctgcttggtcacagacagctccagcaagagcagttgttaaaagtgccaagcgtgtgtatcactgtgacaagccgtttgcttactgccctgttcccttgcagccaaaccagctgatgaagaactgctgccaggtgggtcctacagcaggtcacaaatgacctagtttcattttaagcagacagactctgtttggcctagaggtgtggagtgagagaactgtgtttgtgggtatgagtctgtgtggccaaccccatgacccccacccctccagcccaacatcttgtgagcacatgtgacctaggccccgggggacctgcctgctcctttggcttgggctcttcgtgtttcccacctgccctcggcacgagcccttggtggcatcacagttggccactcagctgtgctgagtagctgtgctacttgtgctggcagctgcaaggataggaatagctcagcgcccgatgagctccctgagcagatgtgaggctggcaactcccctgccctctgtttgcaggcacagggtcacagtcccaagaaagacaactggagtctgatctcccagccatctctggggttactaggaggcagctggatggcagatacgagaggcccaaatagccaagctgttgcaagacagagtggctacaattgaattgacaccctgggaagcacgaggtaacttggtaaggataatgatgctgtagatgtctgtgtcctcggaggctgagctccgcttggcagagagagcgtgctgtgtgaggtggagggcggttttgcagacatctcagcttcttttctgaggaggagttggttctcatcttaggcttctgcaagggcgagcatgggatgtctccaccaccacccactcttggagctgtgctgggtcttggcttggggcgctgagggtggggcctgtgtcagaagcatttggtgagaggggtggaggtggcaggcaggggttctcctcagggttcccactgaggggtcccttcagcaaagacctgggaggaggtgccgcatcacgtggatgtttcttccctaaagaaaaagacacaggaaagctgtctgtctgtaccctgctctggatttattgtcgtacttggacccagaaggggaaatgattccctcaccctttcactttctctctgaacccctactaagtggtgactgcagattctggaaacaattagctgcccgtgactcagctgccagcttcattttctctgccttttgggagaggccctctcacccaggcccaagagatttggagacaggagtcaggccaggtctgaagcaggagaagggaggcccctcctatctacccagttgacatttggctttgggaaaagcgcagcttgttcgagccacgtgtgccaagcaggcttttccttcctcttgtaagtaaagctcgtggttctgtagtccagtcatcctaggagggtgatgttgactgagacttcacgctctccctttgtctctggaaactgccccctcgttctgacagaatcccccaggcaatggaggaagggtgccgaggcgcctctagtctgtgcctttgccgttggaagcatttggtgctgagagggtttcccagccacccgctccctttctggggccatggtgtccctgctgtgtgtcagtggcatgtcactgtggttcagtgagcacatgggtggacgtgcagagactgtctgcgcagcccccagcagacatgcccctggggtgaggacacaggctctgcaggccatctccccctctggctcagtcatcgcctgcccacccttcacttcttaaaggtgcgcaagagaggagggccgactggagggtgtcgccggaaggtttcagcctgcccttcacaattccccttgtgcacagcccagtttccatctctcagggcccacccaggaaaatggatttcaagtgggggttttcatccagagatttgtttaacacaaaacaagaaaagctgagaggcaaaacaggggagtgaggggcaacccagaggtggggaacaacaacagcaagccgcccccatcctgagactggctgggcaccaggggaggacgcgtcaccagagcctggggccaaggccactgggggacctgccacactgtggacctgtctggtgggggctggagcctcgagaagccatgattcttgtcagaaacatttccccaggcagagagagggggccccagcctctcccctcctcttggcctccagagtcctgcaggtgcctcacagtagtgaaacccagttggaagcagctgccctgggagcctgggacaggcgacccaccgggtcagtcccctgccactcagagcagagcagggggctgagggcaagcaggtggggctgtgcgtggcctcagtgcactcggtgtcatgtctgagcctggtgtttatgccccactgctgtcctaagtccctggcgaggggaggtggaggagctgccccgtgggtgtttggagattctgttttactctgcctagagaggaaacggctttggggagggagggggaagcctttattctttactgttgtccctgttttcctttgggggaatttactcagttagcagcccctcctcaccattccccccaggaaggccatgtcccagttttctgtccacccctcctgttcctctgcactatgtctctgattttccctgccagggaagctaacccagagcacgcacctgtgctcatgagtgtttccgcaggataattcgttctgagcatgataccacagtgtggattgtctgtctgtaaggagatgccatctactaaccaatttgtattgtgtttccaataaattcctggaaatttt

SEQ ID NO: 98056 - DNA, 5375 bp, Homo sapiens
tgactctatagtgaccccaaccgtcagtcacctcctgtggatatggcggtcaacatgtaccgggtcggtatattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggatgaactcacgtgctgtgtgtcagactgagctttccctgattcattctacaatccaagacttgctgcactgtcctgctgatgttcacagccgtgcctgggaagaaggcagccccactcccagtacatttcagtgggagacctctgcgtgcatccatggagacgcaatggggcggggaaggaactgtgggagtgcacgttccaaatcctgtgtctccacgtgtggatcagcagcacctcgctttcttgtcagagacctcgctgttacggagcgagacctgctgagaattgaggggctgagggaacccctccacctcctcccttctgcagcgccctgcgccccacccagcaacagcggccacttggcagtggggctgctgcaagctcagagccgctgccaccctgcatgtgtccgctcagctcggtcttatgctgtatagttactaaatatgtacaggagggccatggcatctttctgaatggatttttcttaagaaatgcgccagtgtttatgaggttcaaggtatttccctgtccttgctgttaccgtcactcagctttttctcgataggcttcatccttgtttttttgaaatgggggaatttgctgtttaccctctgcattcctatatgtgaccctccctcctactcctccaaggaacagaattaccgaggttctgacaaaagataagcctgtaaactcatcatctgtgttttgtggttggagagaaactggtgttctgcccggctctgcttggtcacagacagctccagcaagagcagttgttaaaagtgccaagcgtgtgtatcactgtgacaagccgtttgcttactgccctgttcccttgcagccaaaccagctgatgaagaactgctgccaggtgggtcctacagcaggtcacaaatgacctagtttcattttaagcagacagactctgtttggcctagaggtgtggagtgagagaactgtgtttgtgggtatgagtctgtgtggccaaccccatgacccccacccctccagcccaacatcttgtgagcacatgtgacctaggccccgggggacctgcctgctcctttggcttgggctcttcgtgtttcccacctgccctcggcacgagcccttggtggcatcacagttggccactcagctgtgctgagtagctgtgctacttgtgctggcagctgcaaggataggaatagctcagcgcccgatgagctccctgagcagatgtgaggctggcaactcccctgccctctgtttgcaggcacagggtcacagtcccaagaaagacaactggagtctgatctcccagccatctctggggttactaggaggcagctggatggcagatacgagaggcccaaatagccaagctgttgcaagacagagtggctacaattgaattgacaccctgggaagcacgaggtaacttggtaaggataatgatgctgtagatgtctgtgtcctcggaggctgagctccgcttggcagagagagcgtgctgtgtgaggtggagggcggttttgcagacatctcagcttcttttctgaggaggagttggttctcatcttaggcttctgcaagggcgagcatgggatgtctccaccaccacccactcttggagctgtgctgggtcttggcttggggcgctgagggtggggcctgtgtcagaagcatttggtgagaggggtggaggtggcaggcaggggttctcctcagggttcccactgaggggtcccttcagcaaagacctgggaggaggtgccgcatcacgtggatgtttcttccctaaagaaaaagacacaggaaagctgtctgtctgtaccctgctctggatttattgtcgtacttggacccagaaggggaaatgattccctcaccctttcactttctctctgaacccctactaagtggtgactgcagattctggaaacaattagctgcccgtgactcagctgccagcttcattttctctgccttttgggagaggccctctcacccaggcccaagagatttggagacaggagtcaggccaggtctgaagcaggagaagggaggcccctcctatctacccagttgacatttggctttgggaaaagcgcagcttgttcgagccacgtgtgccaagcaggcttttccttcctcttgtaagtaaagctcgtggttctgtagtccagtcatcctaggagggtgatgttgactgagacttcacgctctccctttgtctctggaaactgccccctcgttctgacagaatcccccaggcaatggaggaagggtgccgaggcgcctctagtctgtgcctttgccgttggaagcatttggtgctgagagggtttcccagccacccgctccctttctggggccatggtgtccctgctgtgtgtcagtggcatgtcactgtggttcagtgagcacatgggtggacgtgcagagactgtctgcgcagcccccagcagacatgcccctggggtgaggacacaggctctgcaggccatctccccctctggctcagtcatcgcctgcccacccttcacttcttaaaggtgcgcaagagaggagggccgactggagggtgtcgccggaaggtttcagcctgcccttcacaattccccttgtgcacagcccagtttccatctctcagggcccacccaggaaaatggatttcaagtgggggttttcatccagagatttgtttaacacaaaacaagaaaagctgagaggcaaaacaggggagtgaggggcaacccagaggtggggaacaacaacagcaagccgcccccatcctgagactggctgggcaccaggggaggacgcgtcaccagagcctggggccaaggccactgggggacctgccacactgtggacctgtctggtgggggctggagcctcgagaagccatgattcttgtcagaaacatttccccaggcagagagagggggccccagcctctcccctcctcttggcctccagagtcctgcaggtgcctcacagtagtgaaacccagttggaagcagctgccctgggagcctgggacaggcgacccaccgggtcagtcccctgccactcagagcagagcagggggctgagggcaagcaggtggggctgtgcgtggcctcagtgcactcggtgtcatgtctgagcctggtgtttatgccccactgctgtcctaagtccctggcgaggggaggtggaggagctgccccgtgggtgtttggagattctgttttactctgcctagagaggaaacggctttggggagggagggggaagcctttattctttactgttgtccctgttttcctttgggggaatttactcagttagcagcccctcctcaccattccccccaggaaggccatgtcccagttttctgtccacccctcctgttcctctgcactatgtctctgattttccctgccagggaagctaacccagagcacgcacctgtgctcatgagtgtttccgcaggataattcgttctgagcatgataccacagtgtggattgtctgtctgtaaggagatgccatctactaaccaatttgtattgtgtttccaataaattcctggaaatttt

SEQ ID NO: 98057 - DNA, 5890 bp, Homo sapiens
tagcgcgcctggaccctctcgagatgctgcccttagagtgggatgaaagtctggggaggaacgccttgtcaccggcaaaaacagcctttctcttggtcttcgtctgcatcctccttttcaaaatatcttgatttcccccgcgcacccctgacccggctgcagcaccggccctccgagcgggaagagccccgtgaaggctccgcagagcgatctaccccgcgctcttgtccgtgcccagaaagcgggttccacttggcagggattattttaaactgctaccagcaattcattcacctgacacccgacaccggcagcccagcccgccggaggcgagacaggtgagttgtaaggcgaaccgtgttagatgcaaaacaaatactagaagaaaaaaataagggtggggtagggtgagatgcggtcatctgaccacagggtaacctggctggttaaagggaagagtttttcattgccctctacttttcgtaattttgtaggattgtccggtgcccgctagaggtcgccaaacggagtccttttgcgctggttcttaagtggattcctagtgaaaaggcagacaactgaaaatattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggatgaactcacgtgctgtgtgtcagactgagctttccctgattcattctacaatccaagacttgctgcactgtcctgctgatgttcacagccgtgcctgggaagaaggcagccccactcccagtacatttcagtgggagacctctgcgtgcatccatggagacgcaatggggcggggaaggaactgtgggagtgcacgttccaaatcctgtgtctccacgtgtggatcagcagcacctcgctttcttgtcagagacctcgctgttacggagcgagacctgctgagaattgaggggctgagggaacccctccacctcctcccttctgcagcgccctgcgccccacccagcaacagcggccacttggcagtggggctgctgcaagctcagagccgctgccaccctgcatgtgtccgctcagctcggtcttatgctgtatagttactaaatatgtacaggagggccatggcatctttctgaatggatttttcttaagaaatgcgccagtgtttatgaggttcaaggtatttccctgtccttgctgttaccgtcactcagctttttctcgataggcttcatccttgtttttttgaaatgggggaatttgctgtttaccctctgcattcctatatgtgaccctccctcctactcctccaaggaacagaattaccgaggttctgacaaaagataagcctgtaaactcatcatctgtgttttgtggttggagagaaactggtgttctgcccggctctgcttggtcacagacagctccagcaagagcagttgttaaaagtgccaagcgtgtgtatcactgtgacaagccgtttgcttactgccctgttcccttgcagccaaaccagctgatgaagaactgctgccaggtgggtcctacagcaggtcacaaatgacctagtttcattttaagcagacagactctgtttggcctagaggtgtggagtgagagaactgtgtttgtgggtatgagtctgtgtggccaaccccatgacccccacccctccagcccaacatcttgtgagcacatgtgacctaggccccgggggacctgcctgctcctttggcttgggctcttcgtgtttcccacctgccctcggcacgagcccttggtggcatcacagttggccactcagctgtgctgagtagctgtgctacttgtgctggcagctgcaaggataggaatagctcagcgcccgatgagctccctgagcagatgtgaggctggcaactcccctgccctctgtttgcaggcacagggtcacagtcccaagaaagacaactggagtctgatctcccagccatctctggggttactaggaggcagctggatggcagatacgagaggcccaaatagccaagctgttgcaagacagagtggctacaattgaattgacaccctgggaagcacgaggtaacttggtaaggataatgatgctgtagatgtctgtgtcctcggaggctgagctccgcttggcagagagagcgtgctgtgtgaggtggagggcggttttgcagacatctcagcttcttttctgaggaggagttggttctcatcttaggcttctgcaagggcgagcatgggatgtctccaccaccacccactcttggagctgtgctgggtcttggcttggggcgctgagggtggggcctgtgtcagaagcatttggtgagaggggtggaggtggcaggcaggggttctcctcagggttcccactgaggggtcccttcagcaaagacctgggaggaggtgccgcatcacgtggatgtttcttccctaaagaaaaagacacaggaaagctgtctgtctgtaccctgctctggatttattgtcgtacttggacccagaaggggaaatgattccctcaccctttcactttctctctgaacccctactaagtggtgactgcagattctggaaacaattagctgcccgtgactcagctgccagcttcattttctctgccttttgggagaggccctctcacccaggcccaagagatttggagacaggagtcaggccaggtctgaagcaggagaagggaggcccctcctatctacccagttgacatttggctttgggaaaagcgcagcttgttcgagccacgtgtgccaagcaggcttttccttcctcttgtaagtaaagctcgtggttctgtagtccagtcatcctaggagggtgatgttgactgagacttcacgctctccctttgtctctggaaactgccccctcgttctgacagaatcccccaggcaatggaggaagggtgccgaggcgcctctagtctgtgcctttgccgttggaagcatttggtgctgagagggtttcccagccacccgctccctttctggggccatggtgtccctgctgtgtgtcagtggcatgtcactgtggttcagtgagcacatgggtggacgtgcagagactgtctgcgcagcccccagcagacatgcccctggggtgaggacacaggctctgcaggccatctccccctctggctcagtcatcgcctgcccacccttcacttcttaaaggtgcgcaagagaggagggccgactggagggtgtcgccggaaggtttcagcctgcccttcacaattccccttgtgcacagcccagtttccatctctcagggcccacccaggaaaatggatttcaagtgggggttttcatccagagatttgtttaacacaaaacaagaaaagctgagaggcaaaacaggggagtgaggggcaacccagaggtggggaacaacaacagcaagccgcccccatcctgagactggctgggcaccaggggaggacgcgtcaccagagcctggggccaaggccactgggggacctgccacactgtggacctgtctggtgggggctggagcctcgagaagccatgattcttgtcagaaacatttccccaggcagagagagggggccccagcctctcccctcctcttggcctccagagtcctgcaggtgcctcacagtagtgaaacccagttggaagcagctgccctgggagcctgggacaggcgacccaccgggtcagtcccctgccactcagagcagagcagggggctgagggcaagcaggtggggctgtgcgtggcctcagtgcactcggtgtcatgtctgagcctggtgtttatgccccactgctgtcctaagtccctggcgaggggaggtggaggagctgccccgtgggtgtttggagattctgttttactctgcctagagaggaaacggctttggggagggagggggaagcctttattctttactgttgtccctgttttcctttgggggaatttactcagttagcagcccctcctcaccattccccccaggaaggccatgtcccagttttctgtccacccctcctgttcctctgcactatgtctctgattttccctgccagggaagctaacccagagcacgcacctgtgctcatgagtgtttccgcaggataattcgttctgagcatgataccacagtgtggattgtctgtctgtaaggagatgccatctactaaccaatttgtattgtgtttccaataaattcctggaaatttt

SEQ ID NO: 98058 - DNA, 5640 bp, Homo sapiens
tagcgcgcctggaccctctcgagatgctgcccttagagtgggatgaaagtctggggaggaacgccttgtcaccggcaaaaacagcctttctcttggtcttcgtctgcatcctccttttcaaaatatcttgatttcccccgcgcacccctgacccggctgcagcaccggccctccgagcgggaagagccccgtgaaggctccgcagagcgatctaccccgcgctcttgtccgtgcccagaaagcgggttccacttggcagggattattttaaactgctaccagcaattcattcacctgacacccgacaccggcagcccagcccgccggaggcgagacaggattgtccggtgcccgctagaggtcgccaaacggagtccttttgcgctggttcttaagtggattcctagtgaaaaggcagacaactgaaaatattatgtctactttgagaattcctccagcaacccatacctaataagaaggatagaagaactcaacaagaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggatgaactcacgtgctgtgtgtcagactgagctttccctgattcattctacaatccaagacttgctgcactgtcctgctgatgttcacagccgtgcctgggaagaaggcagccccactcccagtacatttcagtgggagacctctgcgtgcatccatggagacgcaatggggcggggaaggaactgtgggagtgcacgttccaaatcctgtgtctccacgtgtggatcagcagcacctcgctttcttgtcagagacctcgctgttacggagcgagacctgctgagaattgaggggctgagggaacccctccacctcctcccttctgcagcgccctgcgccccacccagcaacagcggccacttggcagtggggctgctgcaagctcagagccgctgccaccctgcatgtgtccgctcagctcggtcttatgctgtatagttactaaatatgtacaggagggccatggcatctttctgaatggatttttcttaagaaatgcgccagtgtttatgaggttcaaggtatttccctgtccttgctgttaccgtcactcagctttttctcgataggcttcatccttgtttttttgaaatgggggaatttgctgtttaccctctgcattcctatatgtgaccctccctcctactcctccaaggaacagaattaccgaggttctgacaaaagataagcctgtaaactcatcatctgtgttttgtggttggagagaaactggtgttctgcccggctctgcttggtcacagacagctccagcaagagcagttgttaaaagtgccaagcgtgtgtatcactgtgacaagccgtttgcttactgccctgttcccttgcagccaaaccagctgatgaagaactgctgccaggtgggtcctacagcaggtcacaaatgacctagtttcattttaagcagacagactctgtttggcctagaggtgtggagtgagagaactgtgtttgtgggtatgagtctgtgtggccaaccccatgacccccacccctccagcccaacatcttgtgagcacatgtgacctaggccccgggggacctgcctgctcctttggcttgggctcttcgtgtttcccacctgccctcggcacgagcccttggtggcatcacagttggccactcagctgtgctgagtagctgtgctacttgtgctggcagctgcaaggataggaatagctcagcgcccgatgagctccctgagcagatgtgaggctggcaactcccctgccctctgtttgcaggcacagggtcacagtcccaagaaagacaactggagtctgatctcccagccatctctggggttactaggaggcagctggatggcagatacgagaggcccaaatagccaagctgttgcaagacagagtggctacaattgaattgacaccctgggaagcacgaggtaacttggtaaggataatgatgctgtagatgtctgtgtcctcggaggctgagctccgcttggcagagagagcgtgctgtgtgaggtggagggcggttttgcagacatctcagcttcttttctgaggaggagttggttctcatcttaggcttctgcaagggcgagcatgggatgtctccaccaccacccactcttggagctgtgctgggtcttggcttggggcgctgagggtggggcctgtgtcagaagcatttggtgagaggggtggaggtggcaggcaggggttctcctcagggttcccactgaggggtcccttcagcaaagacctgggaggaggtgccgcatcacgtggatgtttcttccctaaagaaaaagacacaggaaagctgtctgtctgtaccctgctctggatttattgtcgtacttggacccagaaggggaaatgattccctcaccctttcactttctctctgaacccctactaagtggtgactgcagattctggaaacaattagctgcccgtgactcagctgccagcttcattttctctgccttttgggagaggccctctcacccaggcccaagagatttggagacaggagtcaggccaggtctgaagcaggagaagggaggcccctcctatctacccagttgacatttggctttgggaaaagcgcagcttgttcgagccacgtgtgccaagcaggcttttccttcctcttgtaagtaaagctcgtggttctgtagtccagtcatcctaggagggtgatgttgactgagacttcacgctctccctttgtctctggaaactgccccctcgttctgacagaatcccccaggcaatggaggaagggtgccgaggcgcctctagtctgtgcctttgccgttggaagcatttggtgctgagagggtttcccagccacccgctccctttctggggccatggtgtccctgctgtgtgtcagtggcatgtcactgtggttcagtgagcacatgggtggacgtgcagagactgtctgcgcagcccccagcagacatgcccctggggtgaggacacaggctctgcaggccatctccccctctggctcagtcatcgcctgcccacccttcacttcttaaaggtgcgcaagagaggagggccgactggagggtgtcgccggaaggtttcagcctgcccttcacaattccccttgtgcacagcccagtttccatctctcagggcccacccaggaaaatggatttcaagtgggggttttcatccagagatttgtttaacacaaaacaagaaaagctgagaggcaaaacaggggagtgaggggcaacccagaggtggggaacaacaacagcaagccgcccccatcctgagactggctgggcaccaggggaggacgcgtcaccagagcctggggccaaggccactgggggacctgccacactgtggacctgtctggtgggggctggagcctcgagaagccatgattcttgtcagaaacatttccccaggcagagagagggggccccagcctctcccctcctcttggcctccagagtcctgcaggtgcctcacagtagtgaaacccagttggaagcagctgccctgggagcctgggacaggcgacccaccgggtcagtcccctgccactcagagcagagcagggggctgagggcaagcaggtggggctgtgcgtggcctcagtgcactcggtgtcatgtctgagcctggtgtttatgccccactgctgtcctaagtccctggcgaggggaggtggaggagctgccccgtgggtgtttggagattctgttttactctgcctagagaggaaacggctttggggagggagggggaagcctttattctttactgttgtccctgttttcctttgggggaatttactcagttagcagcccctcctcaccattccccccaggaaggccatgtcccagttttctgtccacccctcctgttcctctgcactatgtctctgattttccctgccagggaagctaacccagagcacgcacctgtgctcatgagtgtttccgcaggataattcgttctgagcatgataccacagtgtggattgtctgtctgtaaggagatgccatctactaaccaatttgtattgtgtttccaataaattcctggaaatttt

SEQ ID NO: 98059 - DNA, 2018 bp, Homo sapiens
tgactctatagtgaccccaaccgtcagtcacctcctgtggatatggcggtcaacatgtaccgggtcggtatattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatgtaagatgcttttaaattcttaaccttatatgttgtgcttctgaccattttctcttttcctctctttccttttttttttgtttgtttgtttgcaataaacataagttcttgtgtacagccttttatttggtttattttttaacattgtttttgtgtgctgccatttgtatcatgccaacctggaaaaaaaaaaatcaaaacattgaaacttctgtactctttaccagagagtagtgcttagcaaaagattggtgggaggtgatcctattccatggggttttgtgatggaattgcctgcagagcccttattgcagcacttttaccttttaggtagtgccacaatgtaacccctaaggatgctgttataatgagactccataatcgagacagtacagtccagtcttacatggattcattaggtttaaataaaatttgccaatttacactaaa

SEQ ID NO: 98060 - DNA, 5148 bp, Homo sapiens
gccaggtagcgaggctgggtggtgccgggtcggattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgcttccttggaaatcattgactagcatcattgaatattattacatgtggaaaactactgacagatatgtgcaacagaaacgtctaaaagcagcagaagctgagagtaaactgaaacaagtatatatcccaacctacagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggatgaactcacgtgctgtgtgtcagactgagctttccctgattcattctacaatccaagacttgctgcactgtcctgctgatgttcacagccgtgcctgggaagaaggcagccccactcccagtacatttcagtgggagacctctgcgtgcatccatggagacgcaatggggcggggaaggaactgtgggagtgcacgttccaaatcctgtgtctccacgtgtggatcagcagcacctcgctttcttgtcagagacctcgctgttacggagcgagacctgctgagaattgaggggctgagggaacccctccacctcctcccttctgcagcgccctgcgccccacccagcaacagcggccacttggcagtggggctgctgcaagctcagagccgctgccaccctgcatgtgtccgctcagctcggtcttatgctgtatagttactaaatatgtacaggagggccatggcatctttctgaatggatttttcttaagaaatgcgccagtgtttatgaggttcaaggtatttccctgtccttgctgttaccgtcactcagctttttctcgataggcttcatccttgtttttttgaaatgggggaatttgctgtttaccctctgcattcctatatgtgaccctccctcctactcctccaaggaacagaattaccgaggttctgacaaaagataagcctgtaaactcatcatctgtgttttgtggttggagagaaactggtgttctgcccggctctgcttggtcacagacagctccagcaagagcagttgttaaaagtgccaagcgtgtgtatcactgtgacaagccgtttgcttactgccctgttcccttgcagccaaaccagctgatgaagaactgctgccaggtgggtcctacagcaggtcacaaatgacctagtttcattttaagcagacagactctgtttggcctagaggtgtggagtgagagaactgtgtttgtgggtatgagtctgtgtggccaaccccatgacccccacccctccagcccaacatcttgtgagcacatgtgacctaggccccgggggacctgcctgctcctttggcttgggctcttcgtgtttcccacctgccctcggcacgagcccttggtggcatcacagttggccactcagctgtgctgagtagctgtgctacttgtgctggcagctgcaaggataggaatagctcagcgcccgatgagctccctgagcagatgtgaggctggcaactcccctgccctctgtttgcaggcacagggtcacagtcccaagaaagacaactggagtctgatctcccagccatctctggggttactaggaggcagctggatggcagatacgagaggcccaaatagccaagctgttgcaagacagagtggctacaattgaattgacaccctgggaagcacgaggtaacttggtaaggataatgatgctgtagatgtctgtgtcctcggaggctgagctccgcttggcagagagagcgtgctgtgtgaggtggagggcggttttgcagacatctcagcttcttttctgaggaggagttggttctcatcttaggcttctgcaagggcgagcatgggatgtctccaccaccacccactcttggagctgtgctgggtcttggcttggggcgctgagggtggggcctgtgtcagaagcatttggtgagaggggtggaggtggcaggcaggggttctcctcagggttcccactgaggggtcccttcagcaaagacctgggaggaggtgccgcatcacgtggatgtttcttccctaaagaaaaagacacaggaaagctgtctgtctgtaccctgctctggatttattgtcgtacttggacccagaaggggaaatgattccctcaccctttcactttctctctgaacccctactaagtggtgactgcagattctggaaacaattagctgcccgtgactcagctgccagcttcattttctctgccttttgggagaggccctctcacccaggcccaagagatttggagacaggagtcaggccaggtctgaagcaggagaagggaggcccctcctatctacccagttgacatttggctttgggaaaagcgcagcttgttcgagccacgtgtgccaagcaggcttttccttcctcttgtaagtaaagctcgtggttctgtagtccagtcatcctaggagggtgatgttgactgagacttcacgctctccctttgtctctggaaactgccccctcgttctgacagaatcccccaggcaatggaggaagggtgccgaggcgcctctagtctgtgcctttgccgttggaagcatttggtgctgagagggtttcccagccacccgctccctttctggggccatggtgtccctgctgtgtgtcagtggcatgtcactgtggttcagtgagcacatgggtggacgtgcagagactgtctgcgcagcccccagcagacatgcccctggggtgaggacacaggctctgcaggccatctccccctctggctcagtcatcgcctgcccacccttcacttcttaaaggtgcgcaagagaggagggccgactggagggtgtcgccggaaggtttcagcctgcccttcacaattccccttgtgcacagcccagtttccatctctcagggcccacccaggaaaatggatttcaagtgggggttttcatccagagatttgtttaacacaaaacaagaaaagctgagaggcaaaacaggggagtgaggggcaacccagaggtggggaacaacaacagcaagccgcccccatcctgagactggctgggcaccaggggaggacgcgtcaccagagcctggggccaaggccactgggggacctgccacactgtggacctgtctggtgggggctggagcctcgagaagccatgattcttgtcagaaacatttccccaggcagagagagggggccccagcctctcccctcctcttggcctccagagtcctgcaggtgcctcacagtagtgaaacccagttggaagcagctgccctgggagcctgggacaggcgacccaccgggtcagtcccctgccactcagagcagagcagggggctgagggcaagcaggtggggctgtgcgtggcctcagtgcactcggtgtcatgtctgagcctggtgtttatgccccactgctgtcctaagtccctggcgaggggaggtggaggagctgccccgtgggtgtttggagattctgttttactctgcctagagaggaaacggctttggggagggagggggaagcctttattctttactgttgtccctgttttcctttgggggaatttactcagttagcagcccctcctcaccattccccccaggaaggccatgtcccagttttctgtccacccctcctgttcctctgcactatgtctctgattttccctgccagggaagctaacccagagcacgcacctgtgctcatgagtgtttccgcaggataattcgttctgagcatgataccacagtgtggattgtctgtctgtaaggagatgccatctactaaccaatttgtattgtgtttccaataaattcctggaaatttt

SEQ ID NO: 98061 - DNA, 5455 bp, Homo sapiens
tgactctatagtgaccccaaccgtcagtcacctcctgtggatatggcggtcaacatgtaccgggtcggtatattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctagctgagcatggtagttcacgcctataatcccagcactttggggaacctcgtttctgcaaaaaatttaaaagaaatataagcagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggatgaactcacgtgctgtgtgtcagactgagctttccctgattcattctacaatccaagacttgctgcactgtcctgctgatgttcacagccgtgcctgggaagaaggcagccccactcccagtacatttcagtgggagacctctgcgtgcatccatggagacgcaatggggcggggaaggaactgtgggagtgcacgttccaaatcctgtgtctccacgtgtggatcagcagcacctcgctttcttgtcagagacctcgctgttacggagcgagacctgctgagaattgaggggctgagggaacccctccacctcctcccttctgcagcgccctgcgccccacccagcaacagcggccacttggcagtggggctgctgcaagctcagagccgctgccaccctgcatgtgtccgctcagctcggtcttatgctgtatagttactaaatatgtacaggagggccatggcatctttctgaatggatttttcttaagaaatgcgccagtgtttatgaggttcaaggtatttccctgtccttgctgttaccgtcactcagctttttctcgataggcttcatccttgtttttttgaaatgggggaatttgctgtttaccctctgcattcctatatgtgaccctccctcctactcctccaaggaacagaattaccgaggttctgacaaaagataagcctgtaaactcatcatctgtgttttgtggttggagagaaactggtgttctgcccggctctgcttggtcacagacagctccagcaagagcagttgttaaaagtgccaagcgtgtgtatcactgtgacaagccgtttgcttactgccctgttcccttgcagccaaaccagctgatgaagaactgctgccaggtgggtcctacagcaggtcacaaatgacctagtttcattttaagcagacagactctgtttggcctagaggtgtggagtgagagaactgtgtttgtgggtatgagtctgtgtggccaaccccatgacccccacccctccagcccaacatcttgtgagcacatgtgacctaggccccgggggacctgcctgctcctttggcttgggctcttcgtgtttcccacctgccctcggcacgagcccttggtggcatcacagttggccactcagctgtgctgagtagctgtgctacttgtgctggcagctgcaaggataggaatagctcagcgcccgatgagctccctgagcagatgtgaggctggcaactcccctgccctctgtttgcaggcacagggtcacagtcccaagaaagacaactggagtctgatctcccagccatctctggggttactaggaggcagctggatggcagatacgagaggcccaaatagccaagctgttgcaagacagagtggctacaattgaattgacaccctgggaagcacgaggtaacttggtaaggataatgatgctgtagatgtctgtgtcctcggaggctgagctccgcttggcagagagagcgtgctgtgtgaggtggagggcggttttgcagacatctcagcttcttttctgaggaggagttggttctcatcttaggcttctgcaagggcgagcatgggatgtctccaccaccacccactcttggagctgtgctgggtcttggcttggggcgctgagggtggggcctgtgtcagaagcatttggtgagaggggtggaggtggcaggcaggggttctcctcagggttcccactgaggggtcccttcagcaaagacctgggaggaggtgccgcatcacgtggatgtttcttccctaaagaaaaagacacaggaaagctgtctgtctgtaccctgctctggatttattgtcgtacttggacccagaaggggaaatgattccctcaccctttcactttctctctgaacccctactaagtggtgactgcagattctggaaacaattagctgcccgtgactcagctgccagcttcattttctctgccttttgggagaggccctctcacccaggcccaagagatttggagacaggagtcaggccaggtctgaagcaggagaagggaggcccctcctatctacccagttgacatttggctttgggaaaagcgcagcttgttcgagccacgtgtgccaagcaggcttttccttcctcttgtaagtaaagctcgtggttctgtagtccagtcatcctaggagggtgatgttgactgagacttcacgctctccctttgtctctggaaactgccccctcgttctgacagaatcccccaggcaatggaggaagggtgccgaggcgcctctagtctgtgcctttgccgttggaagcatttggtgctgagagggtttcccagccacccgctccctttctggggccatggtgtccctgctgtgtgtcagtggcatgtcactgtggttcagtgagcacatgggtggacgtgcagagactgtctgcgcagcccccagcagacatgcccctggggtgaggacacaggctctgcaggccatctccccctctggctcagtcatcgcctgcccacccttcacttcttaaaggtgcgcaagagaggagggccgactggagggtgtcgccggaaggtttcagcctgcccttcacaattccccttgtgcacagcccagtttccatctctcagggcccacccaggaaaatggatttcaagtgggggttttcatccagagatttgtttaacacaaaacaagaaaagctgagaggcaaaacaggggagtgaggggcaacccagaggtggggaacaacaacagcaagccgcccccatcctgagactggctgggcaccaggggaggacgcgtcaccagagcctggggccaaggccactgggggacctgccacactgtggacctgtctggtgggggctggagcctcgagaagccatgattcttgtcagaaacatttccccaggcagagagagggggccccagcctctcccctcctcttggcctccagagtcctgcaggtgcctcacagtagtgaaacccagttggaagcagctgccctgggagcctgggacaggcgacccaccgggtcagtcccctgccactcagagcagagcagggggctgagggcaagcaggtggggctgtgcgtggcctcagtgcactcggtgtcatgtctgagcctggtgtttatgccccactgctgtcctaagtccctggcgaggggaggtggaggagctgccccgtgggtgtttggagattctgttttactctgcctagagaggaaacggctttggggagggagggggaagcctttattctttactgttgtccctgttttcctttgggggaatttactcagttagcagcccctcctcaccattccccccaggaaggccatgtcccagttttctgtccacccctcctgttcctctgcactatgtctctgattttccctgccagggaagctaacccagagcacgcacctgtgctcatgagtgtttccgcaggataattcgttctgagcatgataccacagtgtggattgtctgtctgtaaggagatgccatctactaaccaatttgtattgtgtttccaataaattcctggaaatttt

SEQ ID NO: 98062 - DNA, 5228 bp, Homo sapiens
gccaggtagcgaggctgggtggtgccgggtcggattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgcttccttggaaatcattgactagcatcattgaatattattacatgtggaaaactactgacagatatgtgcaacagaaacgtctaaaagcagcagaagctgagagtaaactgaaacaagtatatatcccaacctagctgagcatggtagttcacgcctataatcccagcactttggggaacctcgtttctgcaaaaaatttaaaagaaatataagcagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggatgaactcacgtgctgtgtgtcagactgagctttccctgattcattctacaatccaagacttgctgcactgtcctgctgatgttcacagccgtgcctgggaagaaggcagccccactcccagtacatttcagtgggagacctctgcgtgcatccatggagacgcaatggggcggggaaggaactgtgggagtgcacgttccaaatcctgtgtctccacgtgtggatcagcagcacctcgctttcttgtcagagacctcgctgttacggagcgagacctgctgagaattgaggggctgagggaacccctccacctcctcccttctgcagcgccctgcgccccacccagcaacagcggccacttggcagtggggctgctgcaagctcagagccgctgccaccctgcatgtgtccgctcagctcggtcttatgctgtatagttactaaatatgtacaggagggccatggcatctttctgaatggatttttcttaagaaatgcgccagtgtttatgaggttcaaggtatttccctgtccttgctgttaccgtcactcagctttttctcgataggcttcatccttgtttttttgaaatgggggaatttgctgtttaccctctgcattcctatatgtgaccctccctcctactcctccaaggaacagaattaccgaggttctgacaaaagataagcctgtaaactcatcatctgtgttttgtggttggagagaaactggtgttctgcccggctctgcttggtcacagacagctccagcaagagcagttgttaaaagtgccaagcgtgtgtatcactgtgacaagccgtttgcttactgccctgttcccttgcagccaaaccagctgatgaagaactgctgccaggtgggtcctacagcaggtcacaaatgacctagtttcattttaagcagacagactctgtttggcctagaggtgtggagtgagagaactgtgtttgtgggtatgagtctgtgtggccaaccccatgacccccacccctccagcccaacatcttgtgagcacatgtgacctaggccccgggggacctgcctgctcctttggcttgggctcttcgtgtttcccacctgccctcggcacgagcccttggtggcatcacagttggccactcagctgtgctgagtagctgtgctacttgtgctggcagctgcaaggataggaatagctcagcgcccgatgagctccctgagcagatgtgaggctggcaactcccctgccctctgtttgcaggcacagggtcacagtcccaagaaagacaactggagtctgatctcccagccatctctggggttactaggaggcagctggatggcagatacgagaggcccaaatagccaagctgttgcaagacagagtggctacaattgaattgacaccctgggaagcacgaggtaacttggtaaggataatgatgctgtagatgtctgtgtcctcggaggctgagctccgcttggcagagagagcgtgctgtgtgaggtggagggcggttttgcagacatctcagcttcttttctgaggaggagttggttctcatcttaggcttctgcaagggcgagcatgggatgtctccaccaccacccactcttggagctgtgctgggtcttggcttggggcgctgagggtggggcctgtgtcagaagcatttggtgagaggggtggaggtggcaggcaggggttctcctcagggttcccactgaggggtcccttcagcaaagacctgggaggaggtgccgcatcacgtggatgtttcttccctaaagaaaaagacacaggaaagctgtctgtctgtaccctgctctggatttattgtcgtacttggacccagaaggggaaatgattccctcaccctttcactttctctctgaacccctactaagtggtgactgcagattctggaaacaattagctgcccgtgactcagctgccagcttcattttctctgccttttgggagaggccctctcacccaggcccaagagatttggagacaggagtcaggccaggtctgaagcaggagaagggaggcccctcctatctacccagttgacatttggctttgggaaaagcgcagcttgttcgagccacgtgtgccaagcaggcttttccttcctcttgtaagtaaagctcgtggttctgtagtccagtcatcctaggagggtgatgttgactgagacttcacgctctccctttgtctctggaaactgccccctcgttctgacagaatcccccaggcaatggaggaagggtgccgaggcgcctctagtctgtgcctttgccgttggaagcatttggtgctgagagggtttcccagccacccgctccctttctggggccatggtgtccctgctgtgtgtcagtggcatgtcactgtggttcagtgagcacatgggtggacgtgcagagactgtctgcgcagcccccagcagacatgcccctggggtgaggacacaggctctgcaggccatctccccctctggctcagtcatcgcctgcccacccttcacttcttaaaggtgcgcaagagaggagggccgactggagggtgtcgccggaaggtttcagcctgcccttcacaattccccttgtgcacagcccagtttccatctctcagggcccacccaggaaaatggatttcaagtgggggttttcatccagagatttgtttaacacaaaacaagaaaagctgagaggcaaaacaggggagtgaggggcaacccagaggtggggaacaacaacagcaagccgcccccatcctgagactggctgggcaccaggggaggacgcgtcaccagagcctggggccaaggccactgggggacctgccacactgtggacctgtctggtgggggctggagcctcgagaagccatgattcttgtcagaaacatttccccaggcagagagagggggccccagcctctcccctcctcttggcctccagagtcctgcaggtgcctcacagtagtgaaacccagttggaagcagctgccctgggagcctgggacaggcgacccaccgggtcagtcccctgccactcagagcagagcagggggctgagggcaagcaggtggggctgtgcgtggcctcagtgcactcggtgtcatgtctgagcctggtgtttatgccccactgctgtcctaagtccctggcgaggggaggtggaggagctgccccgtgggtgtttggagattctgttttactctgcctagagaggaaacggctttggggagggagggggaagcctttattctttactgttgtccctgttttcctttgggggaatttactcagttagcagcccctcctcaccattccccccaggaaggccatgtcccagttttctgtccacccctcctgttcctctgcactatgtctctgattttccctgccagggaagctaacccagagcacgcacctgtgctcatgagtgtttccgcaggataattcgttctgagcatgataccacagtgtggattgtctgtctgtaaggagatgccatctactaaccaatttgtattgtgtttccaataaattcctggaaatttt

SEQ ID NO: 98063 - DNA, 1709 bp, Homo sapiens
tgactctatagtgaccccaaccgtcagtcacctcctgtggatatggcggtcaacatgtaccgggtcggtatattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatgtaagatgcttttaaattcttaaccttatatgttgtgcttctgaccattttctcttttcctctctttccttttttttttgtttgtttgtttgcaataaacataagttcttgtgtaaaaaaaaacatattaatttcataaaa

SEQ ID NO: 98064 - DNA, 5760 bp, Homo sapiens
  misc_feature (5690)..(5690): n is a, c, g, or t
tgactctatagtgaccccaaccgtcagtcacctcctgtggatatggcggtcaacatgtaccgggtcggtatattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggatgaactcacgtgctgtgtgtcagactgagctttccctgattcattctacaatccaagacttgctgcactgtcctgctgatgttcacagccgtgcctgggaagaaggcagccccactcccagtacatttcagtgggagacctctgcgtgcatccatggagacgcaatggggcggggaaggaactgtgggagtgcacgttccaaatcctgtgtctccacgtgtggatcagcagcacctcgctttcttgtcagagacctcgctgttacggagcgagacctgctgagaattgaggggctgagggaacccctccacctcctcccttctgcagcgccctgcgccccacccagcaacagcggccacttggcagtggggctgctgcaagctcagagccgctgccaccctgcatgtgtccgctcagctcggtcttatgctgtatagttactaaatatgtacaggagggccatggcatctttctgaatggatttttcttaagaaatgcgccagtgtttatgaggttcaaggtatttccctgtccttgctgttaccgtcactcagctttttctcgataggcttcatccttgtttttttgaaatgggggaatttgctgtttaccctctgcattcctatatgtgaccctccctcctactcctccaaggaacagaattaccgaggttctgacaaaagataagcctgtaaactcatcatctgtgttttgtggttggagagaaactggtgttctgcccggctctgcttggtcacagacagctccagcaagagcagttgttaaaagtgccaagcgtgtgtatcactgtgacaagccgtttgcttactgccctgttcccttgcagccaaaccagctgatgaagaactgctgccaggtgggtcctacagcaggtcacaaatgacctagtttcattttaagcagacagactctgtttggcctagaggtgtggagtgagagaactgtgtttgtgggtatgagtctgtgtggccaaccccatgacccccacccctccagcccaacatcttgtgagcacatgtgacctaggccccgggggacctgcctgctcctttggcttgggctcttcgtgtttcccacctgccctcggcacgagcccttggtggcatcacagttggccactcagctgtgctgagtagctgtgctacttgtgctggcagctgcaaggataggaatagctcagcgcccgatgagctccctgagcagatgtgaggctggcaactcccctgccctctgtttgcaggcacagggtcacagtcccaagaaagacaactggagtctgatctcccagccatctctggggttactaggaggcagctggatggcagatacgagaggcccaaatagccaagctgttgcaagacagagtggctacaattgaattgacaccctgggaagcacgaggtaacttggtaaggataatgatgctgtagatgtctgtgtcctcggaggctgagctccgcttggcagagagagcgtgctgtgtgaggtggagggcggttttgcagacatctcagcttcttttctgaggaggagttggttctcatcttaggcttctgcaagggcgagcatgggatgtctccaccaccacccactcttggagctgtgctgggtcttggcttggggcgctgagggtggggcctgtgtcagaagcatttggtgagaggggtggaggtggcaggcaggggttctcctcagggttcccactgaggggtcccttcagcaaagacctgggaggaggtgccgcatcacgtggatgtttcttccctaaagaaaaagacacaggaaagctgtctgtctgtaccctgctctggatttattgtcgtacttggacccagaaggggaaatgattccctcaccctttcactttctctctgaacccctactaagtggtgactgcagattctggaaacaattagctgcccgtgactcagctgccagcttcattttctctgccttttgggagaggccctctcacccaggcccaagagatttggagacaggagtcaggccaggtctgaagcaggagaagggaggcccctcctatctacccagttgacatttggctttgggaaaagcgcagcttgttcgagccacgtgtgccaagcaggcttttccttcctcttgtaagtaaagctcgtggttctgtagtccagtcatcctaggagggtgatgttgactgagacttcacgctctccctttgtctctggaaactgccccctcgttctgacagaatcccccaggcaatggaggaagggtgccgaggcgcctctagtctgtgcctttgccgttggaagcatttggtgctgagagggtttcccagccacccgctccctttctggggccatggtgtccctgctgtgtgtcagtggcatgtcactgtggttcagtgagcacatgggtggacgtgcagagactgtctgcgcagcccccagcagacatgcccctggggtgaggacacaggctctgcaggccatctccccctctggctcagtcatcgcctgcccacccttcacttcttaaaggtgcgcaagagaggagggccgactggagggtgtcgccggaaggtttcagcctgcccttcacaattccccttgtgcacagcccagtttccatctctcagggcccacccaggaaaatggatttcaagtgggggttttcatccagagatttgtttaacacaaaacaagaaaagctgagaggcaaaacaggggagtgaggggcaacccagaggtggggaacaacaacagcaagccgcccccatcctgagactggctgggcaccaggggaggacgcgtcaccagagcctggggccaaggccactgggggacctgccacactgtggacctgtctggtgggggctggagcctcgagaagccatgattcttgtcagaaacatttccccaggcagagagagggggccccagcctctcccctcctcttggcctccagagtcctgcaggtgcctcacagtagtgaaacccagttggaagcagctgccctgggagcctgggacaggcgacccaccgggtcagtcccctgccactcagagcagagcagggggctgagggcaagcaggtggggctgtgcgtggcctcagtgcactcggtgtcatgtctgagcctggtgtttatgccccactgctgtcctaagtccctggcgaggggaggtggaggagctgccccgtgggtgtttggagattctgttttactctgcctagagaggaaacggctttggggagggagggggaagcctttattctttactgttgtccctgttttcctttgggggaatttactcagttagcagcccctcctcaccattccccccaggaaggccatgtcccagttttctgtccacccctcctgttcctctgcactatgtctctgattttccctgccagggaagctaacccagagcacgcacctgtgctcatgagtgtttccgcaggataattcgttctgagcatgataccacagtgtggattgtctgtctgtaaggagatgccatctactaaccaatttgtattgtgtttccaataaattcctggaaattttaaaaaaaaaaaaaaaaaactcgagtttttttttttttttttttgaaatttaaagaaaaaatttattgaagatctgaaaaacaattcctaaaagattgacttttccagaaaactagctacacaatgcattgcgtctatcatgttaaaacgtgcattagacacaaatacaaaaaccatgaaacaagccaccattcttcaacaatttgagccaagataaaatgcctaagtaacaacatggatgacttgcaaaggatgggctctttactttaagcaccataaaaaaaaacaaaagcacaaatggatgagtgtgttcagntatatacacttgattgaaccttggcactaggaatcagagcattttgtcatatagcattaacatgtattat

SEQ ID NO: 98065 - DNA, 4592 bp, Homo sapiens
tgactctatagtgaccccaaccgtcagtcacctcctgtggatatggcggtcaacatgtaccgggtcggtatattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggatgaactcacgtgctgtgtgtcagactgagctttccctgattcattctacaatccaagacttgctgcactgtcctgctgatgttcacagccgtgcctgggaagaaggcagccccactcccagtacatttcagtgggagacctctgcgtgcatccatggagacgcaatggggcggggaaggaactgtgggagtgcacgttccaaatcctgtgtctccacgtgtggatcagcagcacctcgctttcttgtcagagacctcgctgttacggagcgagacctgctgagaattgaggggctgagggaacccctccacctcctcccttctgcagcgccctgcgccccacccagcaacagcggccacttggcagtggggctgctgcaagctcagagccgctgccaccctgcatgtgtccgctcagctcggtcttatgctgtatagttactaaatatgtacaggagggccatggcatctttctgaatggatttttcttaagaaatgcgccagtgtttatgaggttcaaggtatttccctgtccttgctgttaccgtcactcagctttttctcgataggcttcatccttgtttttttgaaatgggggaatttgctgtttaccctctgcattcctatatgtgaccctccctcctactcctccaaggaacagaattaccgaggttctgacaaaagataagcctgtaaactcatcatctgtgttttgtggttggagagaaactggtgttctgcccggctctgcttggtcacagacagctccagcaagagcagttgttaaaagtgccaagcgtgtgtatcactgtgacaagccgtttgcttactgccctgttcccttgcagccaaaccagctgatgaagaactgctgccaggtgggtcctacagcaggtcacaaatgacctagtttcattttaagcagacagactctgtttggcctagaggtgtggagtgagagaactgtgtttgtgggtatgagtctgtgtggccaaccccatgacccccacccctccagcccaacatcttgtgagcacatgtgacctaggccccgggggacctgcctgctcctttggcttgggctcttcgtgtttcccacctgccctcggcacgagcccttggtggcatcacagttggccactcagctgtgctgagtagctgtgctacttgtgctggcagctgcaaggataggaatagctcagcgcccgatgagctccctgagcagatgtgaggctggcaactcccctgccctctgtttgcaggcacagggtcacagtcccaagaaagacaactggagtctgatctcccagccatctctggggttactaggaggcagctggatggcagatacgagaggcccaaatagccaagctgttgcaagacagagtggctacaattgaattgacaccctgggaagcacgaggtaacttggtaaggataatgatgctgtagatgtctgtgtcctcggaggctgagctccgcttggcagagagagcgtgctgtgtgaggtggagggcggttttgcagacatctcagcttcttttctgaggaggagttggttctcatcttaggcttctgcaagggcgagcatgggatgtctccaccaccacccactcttggagctgtgctgggtcttggcttggggcgctgagggtggggcctgtgtcagaagcatttggtgagaggggtggaggtggcaggcaggggttctcctcagggttcccactgaggggtcccttcagcaaagacctgggaggaggtgccgcatcacgtggatgtttcttccctaaagaaaaagacacaggaaagctgtctgtctgtaccctgctctggatttattgtcgtacttggacccagaaggggaaatgattccctcaccctttcactttctctctgaacccctactaagtggtgactgcagattctggaaacaattagctgcccgtgactcagctgccagcttcattttctctgccttttgggagaggccctctcacccaggcccaagagatttggagacaggagtcaggccaggtctgaagcaggagaagggaggcccctcctatctacccagttgacatttggctttgggaaaagcgcagcttgttcgagccacgtgtgccaagcaggcttttccttcctcttgtaagtaaagctcgtggttctgtagtccagtcatcctaggagggtgatgttgactgagacttcacgctctccctttgtctctggaaactgccccctcgttctgacagaatcccccaggcaatggaggaagggtgccgaggcgcctctagtctgtgcctttgccgttggaagcatttggtgctgagagggtttcccagccacccgctccctttctggggccatggtgtccctgctgtgtgtcagtggcatgtcactgtggttcagtgagcacatgggtggacgtgcagagactgtctgcgcagcccccagcagacatgcccctggggtgaggacacaggctctgcaggccatctccccctctggctcagtcatcgcctgcccacccttcacttcttaaaggtgcgcaagagaggagggccgactggagggtgtcgccggaaggtttcagcctgcccttcacaattccccttgtgcacagcccagtttccatctctcagggcccacccagagcacgcacctgtgctcatgagtgtttccgcaggataattcgttctgagcatgataccacagtgtggattgtctgtctgtaaggagatgccatctactaaccaatttgtattgtgtttccaataaattcctggaaatttt

SEQ ID NO: 98066 - DNA, 3789 bp, Homo sapiens
tgactctatagtgaccccaaccgtcagtcacctcctgtggatatggcggtcaacatgtaccgggtcggtatattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggatgaactcacgtgctgtgtgtcagactgagctttccctgattcattctacaatccaagacttgctgcactgtcctgctgatgttcacagccgtgcctgggaagaaggcagccccactcccagtacatttcagtgggagacctctgcgtgcatccatggagacgcaatggggcggggaaggaactgtgggagtgcacgttccaaatcctgtgtctccacgtgtggatcagcagcacctcgctttcttgtcagagacctcgctgttacggagcgagacctgctgagaattgaggggctgagggaacccctccacctcctcccttctgcagcgccctgcgccccacccagcaacagcggccacttggcagtggggctgctgcaagctcagagccgctgccaccctgcatgtgtccgctcagctcggtcttatgctgtatagttactaaatatgtacaggagggccatggcatctttctgaatggatttttcttaagaaatgcgccagtgtttatgaggttcaaggtatttccctgtccttgctgttaccgtcactcagctttttctcgataggcttcatccttgtttttttgaaatgggggaatttgctgtttaccctctgcattcctatatgtgaccctccctcctactcctccaaggaacagaattaccgaggttctgacaaaagataagcctgtaaactcatcatctgtgttttgtggttggagagaaactggtgttctgcccggctctgcttggtcacagacagctccagcaagagcagttgttaaaagtgccaagcgtgtgtatcactgtgacaagccgtttgcttactgccctgttcccttgcagccaaaccagctgatgaagaactgctgccaggtgggtcctacagcaggtcacaaatgacctagtttcattttaagcagacagactctgtttggcctagaggtgtggagtgagagaactgtgtttgtgggtatgagtctgtgtggccaaccccatgacccccacccctccagcccaacatcttgtgagcacatgtgacctaggccccgggggacctgcctgctcctttggcttgggctcttcgtgtttcccacctgccctcggcacgagcccttggtggcatcacagttggccactcagctgtgctgagtagctgtgctacttgtgctggcagctgcaaggataggaatagctcagcgcccgatgagctccctgagcagatgtgaggctggcaactcccctgccctctgtttgcaggcacagggtcacagtcccaagaaagacaactggagtctgatctcccagccatctctggggttactaggaggcagctggatggcagatacgagaggcccaaatagccaagctgttgcaagacagagtggctacaattgaattgacaccctgggaagcacgaggtaacttggtaaggataatgatgctgtagatgtctgtgtcctcggaggctgagctccgcttggcagagagagcgtgctgtgtgaggtggagggcggttttgcagacatctcagcttcttttctgaggaggagttggttctcatcttaggcttctgcaagggcgagcatgggatgtctccaccaccacccactcttggagctgtgctgggtcttggcttggggcgctgagggtggggcctgtgtcagaagcatttggtgagaggggtggaggtggcaggcaggggttctcctcagggttcccactgaggggtcccttcagcaaagacctgggaggaggtgccgcatcacgtggatgtttcttccctaaagaaaaagacacaggaaagctgtctgtctgtaccctgctctggatttattgtcgtacttggacccagaaggggaaatgattccctcaccctttcactttctctctgaacccctactaagtggtgactgcagattctggaaacaattagctgcccgtcttccgcagcctaggggatcctctacatcgtgcctggagcgttc

SEQ ID NO: 98067 - DNA, 5293 bp, Homo sapiens
tgactctatagtgaccccaaccgtcagtcacctcctgtggatatggcggtcaacatgtaccgggtcggtatattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcagatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggatgaactcacgtgctgtgtgtcagactgagctttccctgattcattctacaatccaagacttgctgcactgtcctgctgatgttcacagccgtgcctgggaagaaggcagccccactcccagtacatttcagtgggagacctctgcgtgcatccatggagacgcaatggggcggggaaggaactgtgggagtgcacgttccaaatcctgtgtctccacgtgtggatcagcagcacctcgctttcttgtcagagacctcgctgttacggagcgagacctgctgagaattgaggggctgagggaacccctccacctcctcccttctgcagcgccctgcgccccacccagcaacagcggccacttggcagtggggctgctgcaagctcagagccgctgccaccctgcatgtgtccgctcagctcggtcttatgctgtatagttactaaatatgtacaggagggccatggcatctttctgaatggatttttcttaagaaatgcgccagtgtttatgaggttcaaggtatttccctgtccttgctgttaccgtcactcagctttttctcgataggcttcatccttgtttttttgaaatgggggaatttgctgtttaccctctgcattcctatatgtgaccctccctcctactcctccaaggaacagaattaccgaggttctgacaaaagataagcctgtaaactcatcatctgtgttttgtggttggagagaaactggtgttctgcccggctctgcttggtcacagacagctccagcaagagcagttgttaaaagtgccaagcgtgtgtatcactgtgacaagccgtttgcttactgccctgttcccttgcagccaaaccagctgatgaagaactgctgccaggtgggtcctacagcaggtcacaaatgacctagtttcattttaagcagacagactctgtttggcctagaggtgtggagtgagagaactgtgtttgtgggtatgagtctgtgtggccaaccccatgacccccacccctccagcccaacatcttgtgagcacatgtgacctaggccccgggggacctgcctgctcctttggcttgggctcttcgtgtttcccacctgccctcggcacgagcccttggtggcatcacagttggccactcagctgtgctgagtagctgtgctacttgtgctggcagctgcaaggataggaatagctcagcgcccgatgagctccctgagcagatgtgaggctggcaactcccctgccctctgtttgcaggcacagggtcacagtcccaagaaagacaactggagtctgatctcccagccatctctggggttactaggaggcagctggatggcagatacgagaggcccaaatagccaagctgttgcaagacagagtggctacaattgaattgacaccctgggaagcacgaggtaacttggtaaggataatgatgctgtagatgtctgtgtcctcggaggctgagctccgcttggcagagagagcgtgctgtgtgaggtggagggcggttttgcagacatctcagcttcttttctgaggaggagttggttctcatcttaggcttctgcaagggcgagcatgggatgtctccaccaccacccactcttggagctgtgctgggtcttggcttggggcgctgagggtggggcctgtgtcagaagcatttggtgagaggggtggaggtggcaggcaggggttctcctcagggttcccactgaggggtcccttcagcaaagacctgggaggaggtgccgcatcacgtggatgtttcttccctaaagaaaaagacacaggaaagctgtctgtctgtaccctgctctggatttattgtcgtacttggacccagaaggggaaatgattccctcaccctttcactttctctctgaacccctactaagtggtgactgcagattctggaaacaattagctgcccgtgactcagctgccagcttcattttctctgccttttgggagaggccctctcacccaggcccaagagatttggagacaggagtcaggccaggtctgaagcaggagaagggaggcccctcctatctacccagttgacatttggctttgggaaaagcgcagcttgttcgagccacgtgtgccaagcaggcttttccttcctcttgtaagtaaagctcgtggttctgtagtccagtcatcctaggagggtgatgttgactgagacttcacgctctccctttgtctctggaaactgccccctcgttctgacagaatcccccaggcaatggaggaagggtgccgaggcgcctctagtctgtgcctttgccgttggaagcatttggtgctgagagggtttcccagccacccgctccctttctggggccatggtgtccctgctgtgtgtcagtggcatgtcactgtggttcagtgagcacatgggtggacgtgcagagactgtctgcgcagcccccagcagacatgcccctggggtgaggacacaggctctgcaggccatctccccctctggctcagtcatcgcctgcccacccttcacttcttaaaggtgcgcaagagaggagggccgactggagggtgtcgccggaaggtttcagcctgcccttcacaattccccttgtgcacagcccagtttccatctctcagggcccacccaggaaaatggatttcaagtgggggttttcatccagagatttgtttaacacaaaacaagaaaagctgagaggcaaaacaggggagtgaggggcaacccagaggtggggaacaacaacagcaagccgcccccatcctgagactggctgggcaccaggggaggacgcgtcaccagagcctggggccaaggccactgggggacctgccacactgtggacctgtctggtgggggctggagcctcgagaagccatgattcttgtcagaaacatttccccaggcagagagagggggccccagcctctcccctcctcttggcctccagagtcctgcaggtgcctcacagtagtgaaacccagttggaagcagctgccctgggagcctgggacaggcgacccaccgggtcagtcccctgccactcagagcagagcagggggctgagggcaagcaggtggggctgtgcgtggcctcagtgcactcggtgtcatgtctgagcctggtgtttatgccccactgctgtcctaagtccctggcgaggggaggtggaggagctgccccgtgggtgtttggagattctgttttactctgcctagagaggaaacggctttggggagggagggggaagcctttattctttactgttgtccctgttttcctttgggggaatttactcagttagcagcccctcctcaccattccccccaggaaggccatgtcccagttttctgtccacccctcctgttcctctgcactatgtctctgattttccctgccagggaagctaacccagagcacgcacctgtgctcatgagtgtttccgcaggataattcgttctgagcatgataccacagtgtggattgtctgtctgtaaggagatgccatctactaaccaatttgtattgtgtttccaataaattcctggaaatttt

SEQ ID NO: 98068 - DNA, 1929 bp, Homo sapiens
tgactctatagtgaccccaaccgtcagtcacctcctgtggatatggcggtcaacatgtaccgggtcggtatattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggtacagtagtctttttagtgttgaaaaatggcatgtttttaaatgggttgattattccttggaaacagaagtacagtataggataattaaaaaatgaagaaagctacctttatagctaaacgtagcactacaatattcagggtaggtgtggagagaagcagagagaaattaaattttatcaggtattcagaataatggtctcagacaaaaaaacaatgagtgtgggagatgttagcataagtagagagcttacaaattaaatgtttaattgcttttgaaaacagtttgtaacctttacattctgttgaaggcgtgtcttactacataaagtcataaatgcaaattaagcattttttctccccatggctgttttggagggacaagaagtatggacttaatcttgaggtgaacaacagtttaaatgtgattttggtaaaatcctcataggctgaagatgccaagcgcctgtgtttaccagtgggcgactaccctttttcagtgctgacgggctatcaggactccttaatttaaaaaaaagtgtagttaacccccttggcattttcataccacttactgtgaatgtg

SEQ ID NO: 98069 - DNA, 1584 bp, Homo sapiens
tgactctatagtgaccccaaccgtcagtcacctcctgtggatatggcggtcaacatgtaccgggtcggtatattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctactacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatgtaagatgcttttaaattcttaaccttatatgttgtgcttctgaccattttctcttttcctctctttccttttttttttgtttgtttgtttgcaataaacataagttcttgtgtaaaaaaaaacatattaatttcataaaa

SEQ ID NO: 98070 - DNA, 3134 bp, Homo sapiens
gcggccgcctactactactaaattcgcggccgcgtcgacatttttcttaagaaatgcgccagtgtttatgaggttcaaggtatttccctgtccttgctgttaccgtcactcagctttttctcgataggcttcatccttgtttttttgaaatgggggaatttgctgtttaccctctgcattcctatatgtgaccctccctcctactcctccaaggaacagaattaccgaggttctgacaaaagataagcctgtaaactcatcatctgtgttttgtggttggagagaaactggtgttctgcccggctctgcttggtcacagacagctccagcaagagcagttgttaaaagtgccaagcgtgtgtatcactgtgacaagccgtttgcttactgccctgttcccttgcagccaaaccagctgatgaagaactgctgccaggtgggtcctacagcaggtcacaaatgacctagtttcattttaagcagacagactctgtttggcctagaggtgtggagtgagagaactgtgtttgtgggtatgagtctgtgtggccaaccccatgacccccacccctccagcccaacatcttgtgagcacatgtgacctaggccccgggggacctgcctgctcctttggcttgggctcttcgtgtttcccacctgccctcggcacgagcccttggtggcatcacagttggccactcagctgtgctgagtagctgtgctacttgtgctggcagctgcaaggataggaatagctcagcgcccgatgagctccctgagcagatgtgaggctggcaactcccctgccctctgtttgcaggcacagggtcacagtcccaagaaagacaactggagtctgatctcccagccatctctggggttactaggaggcagctggatggcagatacgagaggcccaaatagccaagctgttgcaagacagagtggctacaattgaattgacaccctgggaagcacgaggtaacttggtaaggataatgatgctgtagatgtctgtgtcctcggaggctgagctccgcttggcagagagagcgtgctgtgtgaggtggagggcggttttgcagacatctcagcttcttttctgaggaggagttggttctcatcttaggcttctgcaagggcgagcatgggatgtctccaccaccacccactcttggagctgtgctgggtcttggcttggggcgctgagggtggggcctgtgtcagaagcatttggtgagaggggtggaggtggcaggcaggggttctcctcagggttcccactgaggggtcccttcagcaaagacctgggaggaggtgccgcatcacgtggatgtttcttccctaaagaaaaagacacaggaaagctgtctgtctgtaccctgctctggatttattgtcgtacttggacccagaaggggaaatgattccctcaccctttcactttctctctgaacccctactaagtggtgactgcagattctggaaacaattagctgcccgtgactcagctgccagcttcattttctctgccttttgggagaggccctctcacccaggcccaagagatttggagacaggagtcaggccaggtctgaagcaggagaagggaggcccctcctatctacccagttgacatttggctttgggaaaagcgcagcttgttcgagccacgtgtgccaagcaggcttttccttcctcttgtaagtaaagctcgtggttctgtagtccagtcatcctaggagggtgatgttgactgagacttcacgctctccctttgtctctggaaactgccccctcgttctgacagaatcccccaggcaatggaggaagggtgccgaggcgcctctagtctgtgcctttgccgttggaagcatttggtgctgagagggtttcccagccacccgctccctttctggggccatggtgtccctgctgtgtgtcagtggcatgtcactgtggttcagtgagcacatgggtggacgtgcagagactgtctgcgcagcccccagcagacatgcccctggggtgaggacacaggctctgcaggccatctccccctctggctcagtcatcgcctgcccacccttcacttcttaaaggtgcgcaagagaggagggccgactggagggtgtcgccggaaggtttcagcctgcccttcacaattccccttgtgcacagcccagtttccatctctcagggcccacccaggaaaatggatttcaagtgggggttttcatccagagatttgtttaacacaaaacaagaaaagctgagaggcaaaacaggggagtgaggggcaacccagaggtggggaacaacaacagcaagccgcccccatcctgagactggctgggcaccaggggaggacgcgtcaccagagcctggggccaaggccactgggggacctgccacactgtggacctgtctggtgggggctggagcctcgagaagccatgattcttgtcagaaacatttccccaggcagagagagggggccccagcctctcccctcctcttggcctccagagtcctgcaggtgcctcacagtagtgaaacccagttggaagcagctgccctgggagcctgggacaggcgacccaccgggtcagtcccctgccactcagagcagagcagggggctgagggcaagcaggtggggctgtgcgtggcctcagtgcactcggtgtcatgtctgagcctggtgtttatgccccactgctgtcctaagtccctggcgaggggaggtggaggagctgccccgtgggtgtttggagattctgttttactctgcctagagaggaaacggctttggggagggagggggaagcctttattctttactgttgtccctgttttcctttgggggaatttactcagttagcagcccctcctcaccattccccccaggaaggccatgtcccagttttctgtccacccctcctgttcctctgcactatgtctctgattttccctgccagggaagctaacccagagcacgcacctgtgctcatgagtgtttccgcaggataattcgttctgagcatgataccacagtgtggattgtctgtctgtaaggagatgccatctactaaccaatttgtattgtgtttccaataaattcctggaaatttt

SEQ ID NO: 98071 - DNA, 1717 bp, Homo sapiens
tgactctatagtgaccccaaccgtcagtcacctcctgtggatatggcggtcaacatgtaccgggtcggtatattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacatgagacttactattataccactacaataaaaaggagccagtgagagaaacctcaaatagactaacctgaagactagaggaagaaatgtactatgtactatacttttattaaatcaaagctgcagggaaagcgtcagaaaacctatgaaatgctgtattatttgaagcaaatgtgtttcagaaagctagcagcttttcaaactatagattttgtttgggtaatgcatactgctctttggaggtttgttgtttatttggttgaggattttacattgttttcttggttccaatggcaattagaaccatatttggtaaatgtgtgataaataatggagaggttttgattattttgtttgtctagtgttctatcattattatcctttgaattcagaaatcattgtcatctcaaaatgaatgccaattttttttttttttccatttgctttgttttaaatgaggctgagcatggtagttcacgcctataatcccagcactttggggaacctcgtttctgcaaaaaatttaaaagaaatataaggtactatatccttttgttgagattttcagagtttgcttattcatttgttcaggaagaattggtttattaagcaccacgtgtatattgttctatcctagtttcttttagga

SEQ ID NO: 98072 - DNA, 661 bp, Homo sapiens
gatgcaacctaaattatacccagaatcttagatgcaagggagtctgggaaatgtggatcttaaccctgcagactgccccttaggtcatggttgttgaagggccagtcttgaagggccagtccatattagatttgttgtattttggagactggaattggctacttgtgtcaaacccttaaaataaacaggatagaatgtcagagtgttaactgctcaaagggttttgtgttttttgtggtagttgttgtttttaaattatcatcccctctttccctccatacttataaaagtaatgtataaacctagtagaaaataaaatgcaaataatgttatttcctataatgccatcacaggtacatgatgttgttggggcaatgtatttcttatgacatgaagttttaagaagtgtccttttagaaactgtcaggtagtgtatgcaacaaaaagtctcctgggcctcctctgcttaaatactagacctttacctgagcactgagcaactgtgtcataatggtgagttttttaaagtggtttcatcccactacccaaaagtgatcattgattattttctgcttccagtgtcttagttttcccaagtgaatgcatatattattgtgtgtttgtacatttaagaacaaattgtgtagaaggcacatatttg

SEQ ID NO: 98073 - DNA, 5281 bp, Homo sapiens
tagcgttctagagtatcccagtaaatcggaaactgggagtcattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggatgaactcacgtgctgtgtgtcagactgagctttccctgattcattctacaatccaagacttgctgcactgtcctgctgatgttcacagccgtgcctgggaagaaggcagccccactcccagtacatttcagtgggagacctctgcgtgcatccatggagacgcaatggggcggggaaggaactgtgggagtgcacgttccaaatcctgtgtctccacgtgtggatcagcagcacctcgctttcttgtcagagacctcgctgttacggagcgagacctgctgagaattgaggggctgagggaacccctccacctcctcccttctgcagcgccctgcgccccacccagcaacagcggccacttggcagtggggctgctgcaagctcagagccgctgccaccctgcatgtgtccgctcagctcggtcttatgctgtatagttactaaatatgtacaggagggccatggcatctttctgaatggatttttcttaagaaatgcgccagtgtttatgaggttcaaggtatttccctgtccttgctgttaccgtcactcagctttttctcgataggcttcatccttgtttttttgaaatgggggaatttgctgtttaccctctgcattcctatatgtgaccctccctcctactcctccaaggaacagaattaccgaggttctgacaaaagataagcctgtaaactcatcatctgtgttttgtggttggagagaaactggtgttctgcccggctctgcttggtcacagacagctccagcaagagcagttgttaaaagtgccaagcgtgtgtatcactgtgacaagccgtttgcttactgccctgttcccttgcagccaaaccagctgatgaagaactgctgccaggtgggtcctacagcaggtcacaaatgacctagtttcattttaagcagacagactctgtttggcctagaggtgtggagtgagagaactgtgtttgtgggtatgagtctgtgtggccaaccccatgacccccacccctccagcccaacatcttgtgagcacatgtgacctaggccccgggggacctgcctgctcctttggcttgggctcttcgtgtttcccacctgccctcggcacgagcccttggtggcatcacagttggccactcagctgtgctgagtagctgtgctacttgtgctggcagctgcaaggataggaatagctcagcgcccgatgagctccctgagcagatgtgaggctggcaactcccctgccctctgtttgcaggcacagggtcacagtcccaagaaagacaactggagtctgatctcccagccatctctggggttactaggaggcagctggatggcagatacgagaggcccaaatagccaagctgttgcaagacagagtggctacaattgaattgacaccctgggaagcacgaggtaacttggtaaggataatgatgctgtagatgtctgtgtcctcggaggctgagctccgcttggcagagagagcgtgctgtgtgaggtggagggcggttttgcagacatctcagcttcttttctgaggaggagttggttctcatcttaggcttctgcaagggcgagcatgggatgtctccaccaccacccactcttggagctgtgctgggtcttggcttggggcgctgagggtggggcctgtgtcagaagcatttggtgagaggggtggaggtggcaggcaggggttctcctcagggttcccactgaggggtcccttcagcaaagacctgggaggaggtgccgcatcacgtggatgtttcttccctaaagaaaaagacacaggaaagctgtctgtctgtaccctgctctggatttattgtcgtacttggacccagaaggggaaatgattccctcaccctttcactttctctctgaacccctactaagtggtgactgcagattctggaaacaattagctgcccgtgactcagctgccagcttcattttctctgccttttgggagaggccctctcacccaggcccaagagatttggagacaggagtcaggccaggtctgaagcaggagaagggaggcccctcctatctacccagttgacatttggctttgggaaaagcgcagcttgttcgagccacgtgtgccaagcaggcttttccttcctcttgtaagtaaagctcgtggttctgtagtccagtcatcctaggagggtgatgttgactgagacttcacgctctccctttgtctctggaaactgccccctcgttctgacagaatcccccaggcaatggaggaagggtgccgaggcgcctctagtctgtgcctttgccgttggaagcatttggtgctgagagggtttcccagccacccgctccctttctggggccatggtgtccctgctgtgtgtcagtggcatgtcactgtggttcagtgagcacatgggtggacgtgcagagactgtctgcgcagcccccagcagacatgcccctggggtgaggacacaggctctgcaggccatctccccctctggctcagtcatcgcctgcccacccttcacttcttaaaggtgcgcaagagaggagggccgactggagggtgtcgccggaaggtttcagcctgcccttcacaattccccttgtgcacagcccagtttccatctctcagggcccacccaggaaaatggatttcaagtgggggttttcatccagagatttgtttaacacaaaacaagaaaagctgagaggcaaaacaggggagtgaggggcaacccagaggtggggaacaacaacagcaagccgcccccatcctgagactggctgggcaccaggggaggacgcgtcaccagagcctggggccaaggccactgggggacctgccacactgtggacctgtctggtgggggctggagcctcgagaagccatgattcttgtcagaaacatttccccaggcagagagagggggccccagcctctcccctcctcttggcctccagagtcctgcaggtgcctcacagtagtgaaacccagttggaagcagctgccctgggagcctgggacaggcgacccaccgggtcagtcccctgccactcagagcagagcagggggctgagggcaagcaggtggggctgtgcgtggcctcagtgcactcggtgtcatgtctgagcctggtgtttatgccccactgctgtcctaagtccctggcgaggggaggtggaggagctgccccgtgggtgtttggagattctgttttactctgcctagagaggaaacggctttggggagggagggggaagcctttattctttactgttgtccctgttttcctttgggggaatttactcagttagcagcccctcctcaccattccccccaggaaggccatgtcccagttttctgtccacccctcctgttcctctgcactatgtctctgattttccctgccagggaagctaacccagagcacgcacctgtgctcatgagtgtttccgcaggataattcgttctgagcatgataccacagtgtggattgtctgtctgtaaggagatgccatctactaaccaatttgtattgtgtttccaataaattcctggaaatttt

SEQ ID NO: 98074 - DNA, 5914 bp, Homo sapiens
tgactctatagtgaccccaaccgtcagtcacctcctgtggatatggcggtcaacatgtaccgggtcggtatattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacatgagacttactattataccactacaataaaaaggagccagtgagagaaacctcaaatagactaacctgaagactagaggaagaaatgtactatgtactatacttttattaaatcaaagctgcagggaaagcgtcagaaaacctatgaaatgctgtattatttgaagcaaatgtgtttcagaaagctagcagcttttcaaactatagattttgtttgggtaatgcatactgctctttggaggtttgttgtttatttggttgaggattttacattgttttcttggttccaatggcaattagaaccatatttggtaaatgtgtgataaataatggagaggttttgattattttgtttgtctagtgttctatcattattatcctttgaattcagaaatcattgtcatctcaaaatgaatgccaattttttttttttttccatttgctttgttttaaatgaggctgagcatggtagttcacgcctataatcccagcactttggggaacctcgtttctgcaaaaaatttaaaagaaatataagcagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggatgaactcacgtgctgtgtgtcagactgagctttccctgattcattctacaatccaagacttgctgcactgtcctgctgatgttcacagccgtgcctgggaagaaggcagccccactcccagtacatttcagtgggagacctctgcgtgcatccatggagacgcaatggggcggggaaggaactgtgggagtgcacgttccaaatcctgtgtctccacgtgtggatcagcagcacctcgctttcttgtcagagacctcgctgttacggagcgagacctgctgagaattgaggggctgagggaacccctccacctcctcccttctgcagcgccctgcgccccacccagcaacagcggccacttggcagtggggctgctgcaagctcagagccgctgccaccctgcatgtgtccgctcagctcggtcttatgctgtatagttactaaatatgtacaggagggccatggcatctttctgaatggatttttcttaagaaatgcgccagtgtttatgaggttcaaggtatttccctgtccttgctgttaccgtcactcagctttttctcgataggcttcatccttgtttttttgaaatgggggaatttgctgtttaccctctgcattcctatatgtgaccctccctcctactcctccaaggaacagaattaccgaggttctgacaaaagataagcctgtaaactcatcatctgtgttttgtggttggagagaaactggtgttctgcccggctctgcttggtcacagacagctccagcaagagcagttgttaaaagtgccaagcgtgtgtatcactgtgacaagccgtttgcttactgccctgttcccttgcagccaaaccagctgatgaagaactgctgccaggtgggtcctacagcaggtcacaaatgacctagtttcattttaagcagacagactctgtttggcctagaggtgtggagtgagagaactgtgtttgtgggtatgagtctgtgtggccaaccccatgacccccacccctccagcccaacatcttgtgagcacatgtgacctaggccccgggggacctgcctgctcctttggcttgggctcttcgtgtttcccacctgccctcggcacgagcccttggtggcatcacagttggccactcagctgtgctgagtagctgtgctacttgtgctggcagctgcaaggataggaatagctcagcgcccgatgagctccctgagcagatgtgaggctggcaactcccctgccctctgtttgcaggcacagggtcacagtcccaagaaagacaactggagtctgatctcccagccatctctggggttactaggaggcagctggatggcagatacgagaggcccaaatagccaagctgttgcaagacagagtggctacaattgaattgacaccctgggaagcacgaggtaacttggtaaggataatgatgctgtagatgtctgtgtcctcggaggctgagctccgcttggcagagagagcgtgctgtgtgaggtggagggcggttttgcagacatctcagcttcttttctgaggaggagttggttctcatcttaggcttctgcaagggcgagcatgggatgtctccaccaccacccactcttggagctgtgctgggtcttggcttggggcgctgagggtggggcctgtgtcagaagcatttggtgagaggggtggaggtggcaggcaggggttctcctcagggttcccactgaggggtcccttcagcaaagacctgggaggaggtgccgcatcacgtggatgtttcttccctaaagaaaaagacacaggaaagctgtctgtctgtaccctgctctggatttattgtcgtacttggacccagaaggggaaatgattccctcaccctttcactttctctctgaacccctactaagtggtgactgcagattctggaaacaattagctgcccgtgactcagctgccagcttcattttctctgccttttgggagaggccctctcacccaggcccaagagatttggagacaggagtcaggccaggtctgaagcaggagaagggaggcccctcctatctacccagttgacatttggctttgggaaaagcgcagcttgttcgagccacgtgtgccaagcaggcttttccttcctcttgtaagtaaagctcgtggttctgtagtccagtcatcctaggagggtgatgttgactgagacttcacgctctccctttgtctctggaaactgccccctcgttctgacagaatcccccaggcaatggaggaagggtgccgaggcgcctctagtctgtgcctttgccgttggaagcatttggtgctgagagggtttcccagccacccgctccctttctggggccatggtgtccctgctgtgtgtcagtggcatgtcactgtggttcagtgagcacatgggtggacgtgcagagactgtctgcgcagcccccagcagacatgcccctggggtgaggacacaggctctgcaggccatctccccctctggctcagtcatcgcctgcccacccttcacttcttaaaggtgcgcaagagaggagggccgactggagggtgtcgccggaaggtttcagcctgcccttcacaattccccttgtgcacagcccagtttccatctctcagggcccacccaggaaaatggatttcaagtgggggttttcatccagagatttgtttaacacaaaacaagaaaagctgagaggcaaaacaggggagtgaggggcaacccagaggtggggaacaacaacagcaagccgcccccatcctgagactggctgggcaccaggggaggacgcgtcaccagagcctggggccaaggccactgggggacctgccacactgtggacctgtctggtgggggctggagcctcgagaagccatgattcttgtcagaaacatttccccaggcagagagagggggccccagcctctcccctcctcttggcctccagagtcctgcaggtgcctcacagtagtgaaacccagttggaagcagctgccctgggagcctgggacaggcgacccaccgggtcagtcccctgccactcagagcagagcagggggctgagggcaagcaggtggggctgtgcgtggcctcagtgcactcggtgtcatgtctgagcctggtgtttatgccccactgctgtcctaagtccctggcgaggggaggtggaggagctgccccgtgggtgtttggagattctgttttactctgcctagagaggaaacggctttggggagggagggggaagcctttattctttactgttgtccctgttttcctttgggggaatttactcagttagcagcccctcctcaccattccccccaggaaggccatgtcccagttttctgtccacccctcctgttcctctgcactatgtctctgattttccctgccagggaagctaacccagagcacgcacctgtgctcatgagtgtttccgcaggataattcgttctgagcatgataccacagtgtggattgtctgtctgtaaggagatgccatctactaaccaatttgtattgtgtttccaataaattcctggaaatttt

SEQ ID NO: 98075 - DNA, 4518 bp, Homo sapiens
  misc_feature (80)..(80): n is a, c, g, or t
tgtttacgtccccgctttcccttcctccctccccctgccctcttccccgtttgctgctgtccgttgtccgattaactganacctggcaaacattgtttagcatcattgaatattattacatgtggaaaactactgacagatatgtgcaacagaaacgtctaaaagcagcagaagctgagagtaaactgaaacaagtatatatcccaacctacagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggatgaactcacgtgctgtgtgtcagactgagctttccctgattcattctacaatccaagacttgctgcactgtcctgctgatgttcacagccgtgcctgggaagaaggcagccccactcccagtacatttcagtgggagacctctgcgtgcatccatggagacgcaatggggcggggaaggaactgtgggagtgcacgttccaaatcctgtgtctccacgtgtggatcagcagcacctcgctttcttgtcagagacctcgctgttacggagcgagacctgctgagaattgaggggctgagggaacccctccacctcctcccttctgcagcgccctgcgccccacccagcaacagcggccacttggcagtggggctgctgcaagctcagagccgctgccaccctgcatgtgtccgctcagctcggtcttatgctgtatagttactaaatatgtacaggagggccatggcatctttctgaatggatttttcttaagaaatgcgccagtgtttatgaggttcaaggtatttccctgtccttgctgttaccgtcactcagctttttctcgataggcttcatccttgtttttttgaaatgggggaatttgctgtttaccctctgcattcctatatgtgaccctccctcctactcctccaaggaacagaattaccgaggttctgacaaaagataagcctgtaaactcatcatctgtgttttgtggttggagagaaactggtgttctgcccggctctgcttggtcacagacagctccagcaagagcagttgttaaaagtgccaagcgtgtgtatcactgtgacaagccgtttgcttactgccctgttcccttgcagccaaaccagctgatgaagaactgctgccaggtgggtcctacagcaggtcacaaatgacctagtttcattttaagcagacagactctgtttggcctagaggtgtggagtgagagaactgtgtttgtgggtatgagtctgtgtggccaaccccatgacccccacccctccagcccaacatcttgtgagcacatgtgacctaggccccgggggacctgcctgctcctttggcttgggctcttcgtgtttcccacctgccctcggcacgagcccttggtggcatcacagttggccactcagctgtgctgagtagctgtgctacttgtgctggcagctgcaaggataggaatagctcagcgcccgatgagctccctgagcagatgtgaggctggcaactcccctgccctctgtttgcaggcacagggtcacagtcccaagaaagacaactggagtctgatctcccagccatctctggggttactaggaggcagctggatggcagatacgagaggcccaaatagccaagctgttgcaagacagagtggctacaattgaattgacaccctgggaagcacgaggtaacttggtaaggataatgatgctgtagatgtctgtgtcctcggaggctgagctccgcttggcagagagagcgtgctgtgtgaggtggagggcggttttgcagacatctcagcttcttttctgaggaggagttggttctcatcttaggcttctgcaagggcgagcatgggatgtctccaccaccacccactcttggagctgtgctgggtcttggcttggggcgctgagggtggggcctgtgtcagaagcatttggtgagaggggtggaggtggcaggcaggggttctcctcagggttcccactgaggggtcccttcagcaaagacctgggaggaggtgccgcatcacgtggatgtttcttccctaaagaaaaagacacaggaaagctgtctgtctgtaccctgctctggatttattgtcgtacttggacccagaaggggaaatgattccctcaccctttcactttctctctgaacccctactaagtggtgactgcagattctggaaacaattagctgcccgtgactcagctgccagcttcattttctctgccttttgggagaggccctctcacccaggcccaagagatttggagacaggagtcaggccaggtctgaagcaggagaagggaggcccctcctatctacccagttgacatttggctttgggaaaagcgcagcttgttcgagccacgtgtgccaagcaggcttttccttcctcttgtaagtaaagctcgtggttctgtagtccagtcatcctaggagggtgatgttgactgagacttcacgctctccctttgtctctggaaactgccccctcgttctgacagaatcccccaggcaatggaggaagggtgccgaggcgcctctagtctgtgcctttgccgttggaagcatttggtgctgagagggtttcccagccacccgctccctttctggggccatggtgtccctgctgtgtgtcagtggcatgtcactgtggttcagtgagcacatgggtggacgtgcagagactgtctgcgcagcccccagcagacatgcccctggggtgaggacacaggctctgcaggccatctccccctctggctcagtcatcgcctgcccacccttcacttcttaaaggtgcgcaagagaggagggccgactggagggtgtcgccggaaggtttcagcctgcccttcacaattccccttgtgcacagcccagtttccatctctcagggcccacccaggaaaatggatttcaagtgggggttttcatccagagatttgtttaacacaaaacaagaaaagctgagaggcaaaacaggggagtgaggggcaacccagaggtggggaacaacaacagcaagccgcccccatcctgagactggctgggcaccaggggaggacgcgtcaccagagcctggggccaaggccactgggggacctgccacactgtggacctgtctggtgggggctggagcctcgagaagccatgattcttgtcagaaacatttccccaggcagagagagggggccccagcctctcccctcctcttggcctccagagtcctgcaggtgcctcacagtagtgaaacccagttggaagcagctgccctgggagcctgggacaggcgacccaccgggtcagtcccctgccactcagagcagagcagggggctgagggcaagcaggtggggctgtgcgtggcctcagtgcactcggtgtcatgtctgagcctggtgtttatgccccactgctgtcctaagtccctggcgaggggaggtggaggagctgccccgtgggtgtttggagattctgttttactctgcctagagaggaaacggctttggggagggagggggaagcctttattctttactgttgtccctgttttcctttgggggaatttactcagttagcagcccctcctcaccattccccccaggaaggccatgtcccagttttctgtccacccctcctgttcctctgcactatgtctctgattttccctgccagggaagctaacccagagcacgcacctgtgctcatgagtgtttccgcaggataattcgttctgagcatgataccacagtgtggattgtctgtctgtaaggagatgccatctactaaccaatttgtattgtgtttccaataaattcctggaaatttt

SEQ ID NO: 98076 - DNA, 5313 bp, Homo sapiens
tgactctatagtgaccccaaccgtcagtcacctcctgtggatatggcggtcaacatgtaccgggtcggtatattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggatgaactcacgtgctgtgtgtcagactgagctttccctgattcattctacaatccaagacttgctgcactgtcctgctgatgttcacagccgtgcctgggaagaaggcagccccactcccagtacatttcagtgggagacctctgcgtgcatccatgtgtggatcagcagcacctcgctttcttgtcagagacctcgctgttacggagcgagacctgctgagaattgaggggctgagggaacccctccacctcctcccttctgcagcgccctgcgccccacccagcaacagcggccacttggcagtggggctgctgcaagctcagagccgctgccaccctgcatgtgtccgctcagctcggtcttatgctgtatagttactaaatatgtacaggagggccatggcatctttctgaatggatttttcttaagaaatgcgccagtgtttatgaggttcaaggtatttccctgtccttgctgttaccgtcactcagctttttctcgataggcttcatccttgtttttttgaaatgggggaatttgctgtttaccctctgcattcctatatgtgaccctccctcctactcctccaaggaacagaattaccgaggttctgacaaaagataagcctgtaaactcatcatctgtgttttgtggttggagagaaactggtgttctgcccggctctgcttggtcacagacagctccagcaagagcagttgttaaaagtgccaagcgtgtgtatcactgtgacaagccgtttgcttactgccctgttcccttgcagccaaaccagctgatgaagaactgctgccaggtgggtcctacagcaggtcacaaatgacctagtttcattttaagcagacagactctgtttggcctagaggtgtggagtgagagaactgtgtttgtgggtatgagtctgtgtggccaaccccatgacccccacccctccagcccaacatcttgtgagcacatgtgacctaggccccgggggacctgcctgctcctttggcttgggctcttcgtgtttcccacctgccctcggcacgagcccttggtggcatcacagttggccactcagctgtgctgagtagctgtgctacttgtgctggcagctgcaaggataggaatagctcagcgcccgatgagctccctgagcagatgtgaggctggcaactcccctgccctctgtttgcaggcacagggtcacagtcccaagaaagacaactggagtctgatctcccagccatctctggggttactaggaggcagctggatggcagatacgagaggcccaaatagccaagctgttgcaagacagagtggctacaattgaattgacaccctgggaagcacgaggtaacttggtaaggataatgatgctgtagatgtctgtgtcctcggaggctgagctccgcttggcagagagagcgtgctgtgtgaggtggagggcggttttgcagacatctcagcttcttttctgaggaggagttggttctcatcttaggcttctgcaagggcgagcatgggatgtctccaccaccacccactcttggagctgtgctgggtcttggcttggggcgctgagggtggggcctgtgtcagaagcatttggtgagaggggtggaggtggcaggcaggggttctcctcagggttcccactgaggggtcccttcagcaaagacctgggaggaggtgccgcatcacgtggatgtttcttccctaaagaaaaagacacaggaaagctgtctgtctgtaccctgctctggatttattgtcgtacttggacccagaaggggaaatgattccctcaccctttcactttctctctgaacccctactaagtggtgactgcagattctggaaacaattagctgcccgtgactcagctgccagcttcattttctctgccttttgggagaggccctctcacccaggcccaagagatttggagacaggagtcaggccaggtctgaagcaggagaagggaggcccctcctatctacccagttgacatttggctttgggaaaagcgcagcttgttcgagccacgtgtgccaagcaggcttttccttcctcttgtaagtaaagctcgtggttctgtagtccagtcatcctaggagggtgatgttgactgagacttcacgctctccctttgtctctggaaactgccccctcgttctgacagaatcccccaggcaatggaggaagggtgccgaggcgcctctagtctgtgcctttgccgttggaagcatttggtgctgagagggtttcccagccacccgctccctttctggggccatggtgtccctgctgtgtgtcagtggcatgtcactgtggttcagtgagcacatgggtggacgtgcagagactgtctgcgcagcccccagcagacatgcccctggggtgaggacacaggctctgcaggccatctccccctctggctcagtcatcgcctgcccacccttcacttcttaaaggtgcgcaagagaggagggccgactggagggtgtcgccggaaggtttcagcctgcccttcacaattccccttgtgcacagcccagtttccatctctcagggcccacccaggaaaatggatttcaagtgggggttttcatccagagatttgtttaacacaaaacaagaaaagctgagaggcaaaacaggggagtgaggggcaacccagaggtggggaacaacaacagcaagccgcccccatcctgagactggctgggcaccaggggaggacgcgtcaccagagcctggggccaaggccactgggggacctgccacactgtggacctgtctggtgggggctggagcctcgagaagccatgattcttgtcagaaacatttccccaggcagagagagggggccccagcctctcccctcctcttggcctccagagtcctgcaggtgcctcacagtagtgaaacccagttggaagcagctgccctgggagcctgggacaggcgacccaccgggtcagtcccctgccactcagagcagagcagggggctgagggcaagcaggtggggctgtgcgtggcctcagtgcactcggtgtcatgtctgagcctggtgtttatgccccactgctgtcctaagtccctggcgaggggaggtggaggagctgccccgtgggtgtttggagattctgttttactctgcctagagaggaaacggctttggggagggagggggaagcctttattctttactgttgtccctgttttcctttgggggaatttactcagttagcagcccctcctcaccattccccccaggaaggccatgtcccagttttctgtccacccctcctgttcctctgcactatgtctctgattttccctgccagggaagctaacccagagcacgcacctgtgctcatgagtgtttccgcaggataattcgttctgagcatgataccacagtgtggattgtctgtctgtaaggagatgccatctactaaccaatttgtattgtgtttccaataaattcctggaaatttt

SEQ ID NO: 98077 - DNA, 3776 bp, Homo sapiens
tgactctatagtgaccccaaccgtcagtcacctcctgtggatatggcggtcaacatgtaccgggtcggtatattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggatgaactcacgtgctgtgtgtcagactgagctttccctgattcattctacaatccaagacttgctgcactgtcctgctgatgttcacagccgtgcctgggaagaaggcagccccactcccagtacatttcagtgggagacctctgcgtgcatccatggagacgcaatggggcggggaaggaactgtgggagtgcacgttccaaatcctgtgtctccacgtgtggatcagcagcacctcgctttcttgtcagagacctcgctgttacggagcgagacctgctgagaattgaggggctgagggaacccctccacctcctcccttctgcagcgccctgcgccccacccagcaacagcggccacttggcagtggggctgctgcaagctcagagccgctgccaccctgcatgtgtccgctcagctcggtcttatgctgtatagttactaaatatgtacaggagggccatggcatctttctgaatggatttttcttaagaaatgcgccagtgtttatgaggttcaaggtatttccctgtccttgctgttaccgtcactcagctttttctcgataggcttcatccttgtttttttgaaatgggggaatttgctgtttaccctctgcattcctatatgtgaccctccctcctactcctccaaggaacagaattaccgaggttctgacaaaagataagcctgtaaactcatcatctgtgttttgtggttggagagaaactggtgttctgcccggctctgcttggtcacagacagctccagcaagagcagttgttaaaagtgccaagcgtgtgtatcactgtgacaagccgtttgcttactgccctgttcccttgcagccaaaccagctgatgaagaactgctgccaggtgggtcctacagcaggtcacaaatgacctagtttcattttaagcagacagactctgtttggcctagaggtgtggagtgagagaactgtgtttgtgggtatgagtctgtgtggccaaccccatgacccccacccctccagcccaacatcttgtgagcacatgtgacctaggccccgggggacctgcctgctcctttggcttgggctcttcgtgtttcccacctgccctcggcacgagcccttggtggcatcacagttggccactcagctgtgctgagtagctgtgctacttgtgctggcagctgcaaggataggaatagctcagcgcccgatgagctccctgagcagatgtgaggctggcaactcccctgccctctgtttgcaggcacagggtcacagtcccaagaaagacaactggagtctgatctcccagccatctctggggttactaggaggcagctggatggcagatacgagaggcccaaatagccaagctgttgcaagacagagtggctacaattgaattgacaccctgggaagcacgaggtaacttggtaaggataatgatgctgtagatgtctgtgtcctcggaggctgagctccgcttggcagagagagcgtgctgtgtgaggtggagggcggttttgcagacatctcagcttcttttctgaggaggagttggttctcatcttaggcttctgcaagggcgagcatgggatgtctccaccaccacccactcttggagctgttttactctgcctagagaggaaacggctttggggagggagggggaagcctttattctttactgttgtccctgttttcctttgggggaatttactcagttagcagcccctcctcaccattccccccaggaaggccatgtcccagttttctgtccacccctcctgttcctctgcactatgtctctgattttccctgccagggaagctaacccagagcacgcacctgtgctcatgagtgtttccgcaggataattcgttctgagcatgataccacagtgtggattgtctgtctgtaaggagatgccatctactaaccaatttgtattgtgtttccaataaattcctggaaatttt

SEQ ID NO: 98078 - DNA, 1688 bp, Homo sapiens
tgactctatagtgaccccaaccgtcagtcacctcctgtggatatggcggtcaacatgtaccgggtcggtatattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatgtagtgccacaatgtaacccctaaggatgctgttataatgagactccataatcgagacagtacagtccagtcttacatggattcattaggtttaaataaaatttgccaatttacactaaa

SEQ ID NO: 98079 - DNA, 1075 bp, Homo sapiens
gcggccgcctactactactaaattcgcggccgcgtcgacaaaactactgacagatatgtgcaacagaaacgtctaaaagcagcagaagctgagagtaaactgaaacaagtatatatcccaacctacagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatgtaagatgcttttaaattcttaaccttatatgttgtgcttctgaccattttctcttttcctctctttccttttttttttgtttgtttgtttgcaataaacataagttcttgtgtacagccttttatttggtttattttttaacattgtttttgtgtgctgccatttgtatcatgccaacctggaaaaaaaaaaatcaaaacattgaaacttctgtactctttaccagagagtagtgcttagcaaaagattggtgggaggtgatcctattccatggggttttgtgatggaattgcctgcagagcccttattgcagcacttttaccttttaggtagtgccacaatgtaacccctaaggatgctgttataatgagactccataatcgagacagtacagtccagtcttacatggattcattaggtttaaataaaatttgccaatttacactaaa

SEQ ID NO: 98080 - DNA, 733 bp, Homo sapiens
gcggccgcctactactactaaattcgcggccgcgtcgacaaaactactgacagatatgtgcaacagaaacgtctaaaagcagcagaagctgagagtaaactgaaacaagtatatatcccaacctacagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatgtaagatgcttttaaattcttaaccttatatgttgtgcttcggcgcaaagttggggccctgtaaaaaacccccccctggattgtttttatacactagaaataagggaa

SEQ ID NO: 98081 - DNA, 1021 bp, Homo sapiens
tgactctatagtgaccccaaccgtcagtcacctcctgtggatatggcggtcaacatgtaccgggtcggtatattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttgtaagtagaaaattatgagtaaaataaaatgttgagatgggaatattctgttttagaaatctggtaaaccttacagtattcatttag

SEQ ID NO: 98082 - DNA, 105 bp, Homo sapiens
gcctgttatcccagcactttgagcagctgaggtgtgggtgagggaccgttgcaggccagaagttcaagaccagccttttcaacatagcaagatcctgtctctatt

SEQ ID NO: 98083 - DNA, 923 bp, Homo sapiens
tctcaggcttccctccatctgaaagagcataaaaaaaaaaaccaagtgattgttttctcaatcgtcatcaaggttaaaagtggatacgtgttctctgctagccaaggaggaacctgttgggggtttctgggaaagctattccttctctgatagcggaagtgcaagagcttttaagctgctcctcatccctgctccctgctcctgaatatgctgatggtgcacaaagctacagaggggatcctgtgtcagtcagatgacaacaagtgaatcaaatgcctgagttcttggtgacagcattaaacaaggcaaacttcaggttttgtgataaatagggaaaaaatcaaaaaggatttaaagatcatactgttacttgctggcaagctcaccttaaaagaaggaacaatcaagccttattaaagcaggaaaaaacaaacaggaatttttaggaaagtatttaattttaggataaagatctaatgttaaaaatttcagttttcgtgaaaaagcagtaactatgcaaaatcaatgactatatagtgaaagaagatttttttgctgacttactactttcaggcaaaatgccataaaagttattatagttctgaattaatagataactgcattcgaaagaggcaataaaatagtttaagatttttacagggaatgaaaagattcaatagtttcttgtagactctttaaatgacatatacaaagagatttaaagtaattttggttttagtttatggttaggactagggcaaaatacaaaagaccttatttatgtcttttgaaactttattactgccaggcaagtaatatatgtttactggggaactgttgtaacttagagtcattttatttcacaagtatttatcagtaaatgctttatttttcacaataaaatggtcctgagggaataagca

SEQ ID NO: 98084 - DNA, 257 bp, Homo sapiens
tttagtagagacggggtttcgccatgttggccaggctggtcttgaactcctgacctcaggtgatccgcccaaagagctgggattacaggtgtgagccaccacgcctggcctactgtctttaacttcttactttactgtaaaagaaaatccttggaaatccatggaacaagagagggaatgaagttttaaaataaatttacttattgtataaccacattactgaacattttgtaaaacaaaggaaaacgaaaaacaaa

SEQ ID NO: 98085 - DNA, 156 bp, Homo sapiens
caaggataagcacgacaaggcaaggccacaggggaaggaaaggagaagagaaggggacttgggcaggggagccaatgacaaaggccaggagtgcaagaaacatggtacctgggaggaactacaagcagtcctggactgctgagggctatgtccata

SEQ ID NO: 98086 - DNA, 497 bp, Homo sapiens
ccatccatcctttcctgagaagttagtttcttacaagcattatgctagacggggttagaaaacagaatgttgaacaagacactgcaatcttttatagaactctggctcgctacattaaaaacaattactatttcttgaaatgagaaagtattgtttctgagtttctgccaattcaatttaatgagaaatcaccaaaactcacttcagagaaatgccatttatgttgtttttgtcactatgccttattaaaataatcttgattacttcttaactcttttttgcaatgctaagcctcaaaccatgcacacaatgatgaagagcagcagacagacaaaggtctgaggcacactgcaactaagggcttaatgaaaggaatgaaggctgatggcagactagatggaagtcgaagttcaaaaaactcaaatccatggcttcctggaaaataaattacttctagcctaaaaggtcttcctgcttttaatttgtttactttccaa

SEQ ID NO: 98087 - DNA, 577 bp, Homo sapiens
ccccccccacacggtggggagtttctattggcccgggggatttgggaacccaagagccgtggttgggcccccccccccccccccgggccaaacccccaaacttttccccaaaaaaaaaaaaaaaaaaaaaaagattgaacagctctttttcatttttgttttgttcattttatacatgacacaaattgtttatcttgctctcattgggagtttctgttgattccctctttcaatgatcatcaaaagtcatcacccctgacttaaatggttttatgaaattcaagaagttgtgaacaaggctttaacaaaatatttccacttttaatgcctatgctctgattttatataaattttgtatgtaggacatgatgttgaagtaaaaccaataaatagccactcagtattcatctctagcgtcaactgaatcctgacctcaatcttcaaaagaatcagaatagtttcacacttcataagttacatatactccagaataaataaaagcagtttgcttgaagtattatcttgggctcatttgtgctgctataacaaaacacacttgagactgggttatttataa

SEQ ID NO: 98088 - DNA, 1105 bp, Homo sapiens
agaaaatgtgctttgcaaagcaaaaaaggcaaaaattggggatgagttcttcagacaagtaccaaaaatgatttctcgtcatttttaatgtatgcatattcatcatagaaaataattttttgttttattgggaataaaatcatgatacttaaaatctgatacacatttcaatgatcgtattaatccaataggttaaattaacaaattcttaggaaaaaaatctgtttatatgaagctatggagaaatctagaaagtaggtaatggtttagattttgagggacctatgaactcagaacaagttcatttagaggtgggaaacctgagattcaaagaggtctgcatggctgccaagattgcagggacagaatccaagcctgggctcactcatgatctgctctcctgtataaatgtcccatgtgcatctatgaccttattgtttgcaaagcaaattcatattccacgacttgtctgcttcttacaacaaactacaaggcaggcattgtgatttctaagtaagaaggaaaaattaagtagtcaagataatatttagaataaatatttttgaagatgatagttaaatagatggctcttcagactcctagctcaggctatttttccagccttcttttcccaaggaagagaagacaaaaaaaaaaaaagattgaacagctctttttcatttttgttttgttcattttatacatgacacaaattgtttatcttgctctcattgggagtttctgttgattccctctttcaatgatcatcaaaagtcatcacccctgacttaaatggttttatgaaattcaagaagttgtgaacaaggctttaacaaaatatttccacttttaatgcctatgctctgattttatataaattttgtatgtaggacatgatgttgaagtaaaaccaataaatagccactcagtattcatctctagcgtcaactgaatcctgacctcaatcttcaaaagaatcagaatagtttcacacttcataagttacatatactccagaataaataaaagcagtttgcttgaagtattatcttgggctcatttgtgctgctataacaaaacacacttgagactgggttatttataa

SEQ ID NO: 98089 - DNA, 963 bp, Homo sapiens
  misc_feature (869)..(869): n is a, c, g, or t
  misc_feature (959)..(959): n is a, c, g, or t
agaaaatgtgctttgcaaagcaaaaaaggcaaaaattggggatgagttcttcagacaagtaccaaaaatgatttctcgtcatttttaatgtatgcatattcatcatagaaaataattttttgttttattgggaataaaatcatgatacttaaaatctgatacacatttcaatgatcgtattaatccaataggttaaattaacaaattcttaggaaaaaaatctgtttatatgaagctatggagaaatctagaaagtaggtaatggtttagattttgagggacctatgaactcagaacaagttcatttagaggtgggaaacctgagattcaaagaggtctgcatggctgccaagattgcagggacagaatccaagcctgggctcactcatgatctgctctcctgtataaatgtcccatgtgcatctatgaccttattgtttgcaaagcaaattcatattccacgacttgtctgcttcttacaacaaactacaaggcaggcattgtgatttctaagtaagaaggaaaaattaagtagtcaagataatatttagaataaatatttttgaagatgatagttaaatagatggctcttcagactcctagctcaggctatttttccagccttcttttcccaaggaagagaagacaaaaaaaaaaaaagattgaacagctctttttcatttttgttttgttcattttatacatgacacaaattgtttatcttgctctcattgggagtttctgttgattccctctttcaatgatcatcaaaagtcatcacccctgacttaaatggccgtgtgtggtggcttatgcctgtaatcccaccactttgggaggccgaggcgggtggattgatcacctgacgncagaagttcgagagcagcctggccaacattggtgggaaccctgtctctaataaaaatataaaaaaattagccgggcgtgatggcgggcgnctgt

SEQ ID NO: 98090 - DNA, 974 bp, Homo sapiens
tccccttcctgtgtctccttctgtcaatctcctcaaattcacgttcataccctcttcaaaacacttctcctccttcatcttctaactttagtggcattgcctcaggctgggggagaattctatccacactcagtcatgctgcaaacatttgctgagggctatttcacattctgaatgctgaggagttaataggagaaaggcgctgacaacatgtctgtaccagaggaaaagataaactccaccttcggaagtgaaattgagtataatatacaaataacagcaaactgtaaagtaacggaagtgcctgaaaatcttgagcatttccacaaaaattttcatttgcctccctgtttttcctcagtctccagcattcaagagaggtagattgttattttgaaagtatttatttttgatttttaatttaaatgccaacattgttagtaattgattgtgaatgtgtttcagctgtgttttggttgggatatgtgtgaaagatgtggctaggagctgtccagggaattaaactgccagctctaataatgatttctatagaaaaggccttctctaattccaaacaacttttggattagagtctactcctaacagaacgtgcgcttaaagtaatataaacacctaattgccactacatacaggatatgagaaatggggcaatagcagaagaccaactgtgggagagggagtctaaacaagtgtgtggaacgcgaatagaagacaataggtggtctacaacagaccgtcgcgactcacgagacaacactttggaggctgaggcaggtggatcacctgagctcaggagttcgagaccagcctgaccatcatggtgaaaccctgtctctactaaaaatacacaaaattagccaggcatggtgttgcatgcctgtaatcccagttactcaggaggctgaggcaggagaatcgcttgaacccgggaggtggggttgcagtgagctgag

SEQ ID NO: 98091 - DNA, 1216 bp, Homo sapiens
gaaaataaaaagtttttcaatttgttttcgtatttgatttgcttagggaaatctcaattttgtatttatttacagaaataatgcatagtctatagcagtaatttcagcaagctttttgtttaaattttagcctctgtagaatcaaaagcataaagaattacaggttgagcattcctaatccaaaaatttgaaatctgaaatgctccaaaatccaaaactttttgagtgccaacatgacagcacaaatggagaatttcacacctgacctcatgtgacaggtcagtcaaaacaaaggcacacaacagtttattaaaactactgtataaaattaccttcaagctatgtatatatgaaacatgaatgaatttcatgtttagacttcccatcccaaagatatctcattatgtatatgtaaatattccaaaatctgaaaaagttaaatctgaagcacttctgttcccacacatttcagataagggatactcaacctgtatctactttttaaaaataatattctgaaattcgatactgtttttcatcttccatgctatttttgctatcaagatatggttacatacagtggctggtccataatatattcctatataatattttagatgtttccttatgagtcatgattcagggtttttttctttgctttgtttatgttaatattacatagtctgagagtgaatttttatttacttgcaagtgatatgtatgctgataggtttttctctctgtcatcaaatctattgagtaaaccatgccaggccaatttgtccatctccttttttctaagtaagaaatcacaaatatacagtaaatagagtgcactaatcataagtgtacttgatttttttacatgtgtatacattcgtatcaagatcatataaaaatgtatacactcagatcaaagtattaaaaatttcaaattctcttatgccctttcctagtctatacatctcgcagaaataactcttcttttctaaagatctgttagttttggttgttctcagatttcatgtgaatggaatcatacagtatatattgttttatgcctggcttctttcagcaatgtacttcttcttttttttattgttatagactatttgattatatgaatatatcataattcatttatccttttacctgttgacatttatttccaattttttgttattatgaataaagctataataaacattcaaatgta

SEQ ID NO: 98092 - DNA, 544 bp, Homo sapiens
ctagctagggaccccaccctgaatcaccttgttagcataaactcaggtgttgcgaagggcagttatgaatagcaaaagatactcctaaagggtggggtgtgttaggaataacaaactatcacttagggaatttctagggttttagacactgtgcgccaggaacccagaacaaaggacaaatatattttgtactctaccacaactagccttatttccactgctaccacactaaacaatgcatatttacagcaaatagcctgctcacagcagagcctgcgggggtagggaagagctgggtggcaagagacctggcttctagtgctggctctcttctaatgtaatctatgaccttgaatcagtcccttaactttgctgggctttgacttataaaaatgcaggacgcagatgatctgttactttgtgattccaaatatttaccttggcaaggactcagtttccaaactgagatttaaaggatttgctgaaaaatccaaatcatctaaatcagtgcatctcaaattgtaatgcatacatgaatcatctt

SEQ ID NO: 98093 - DNA, 912 bp, Homo sapiens
ctggccgcgctgcacaacatggccgagatgaagacgtcgctgttcccctacgcgctgcagggtccggccggcttcaaggcgcccgcgctggggggcctgggcgcgcagctcccgctcgggaccccgcacggcatcagcgacatcctgggccggcccgtgggcgcggcgggcgggggcctcctgggggggctgccccggctcaacgggctcgcgtcgtccgccggcgtttacttcgggcccgcggccgctgtggcgcgcggctaccccaagcccctggccgagctgccggggcgcccgcccatcttctggcccggcgtggtgcagggcgcgccctggagggacccgcgtctggctggcccggccccggccggcggcgtcctggacaaggacgggaagaagaagcactcgcgcccgaccttctcgggccagcagatcttcgcgctggagaaaaccttcgagcagaccaagtacctggcgggcccggagcgcgcgcgtctcgcctactcgctgggcatgaccgagagccaggtgaaggtctggttccagaaccgccggaccaagtggcgcaagcggcacgcggcggagatggcgtcggccaagaagaagcaggactcggacgccgagaagctgaaggtgggcggctcggacgcggaggacgacgacgaatacaaccggcccctggaccccaactcggacgacgagaagatcacgcggctgctcaagaagcacaaaccctcgaacttggcgctggtcagcccgtgcggcggcggcgcgggggacgccttgtgaggacccgcggggtgggggcgaatctatttttgcagaatccgggggcggccccgggtgggcgcgagtcgctttgtatcatcaataaattatttaacgggtccccgtcggagccgtcgctccgga

SEQ ID NO: 98094 - DNA, 617 bp, Homo sapiens
ctggccgcgctgcacaacatggccgagatgaagacgtcgctgttcccctacgcgctgcagggtccggccggcttcaaggcgcccgcgctggggggcctgggcgcgcagctcccgctcgggaccccgcacggcatcagcgacatcctgggccggcccgtgggcgcggcgggcgggggcctcctgggggggctgccccggctcaacgggctcgcgtcgtccgccggcgtttacttcgggcccgcggccgctgtggcgcgcggctaccccaagcccctggccgagctgccggggcgcccgcccatcttctggcccggcgtggtgcagggcgcgccctggagggacccgcgtctggctggcccggccccggccggcggcgtcctggacaaggacgggaagaagaagcactcgcgcccgaccttctcgggccagcagatcttcgcgctggagaaaaccttcgagcagaccaagtacctggcgggcccggagcgcgcgcgtctcgcctactcgctgggcatgaccgagagccaggtgaaggctggctccataaccgcccgtacaagtggcgcaagcgacacgcggggtctattgcatctggcacgcacaaataggactcaggc

SEQ ID NO: 98095 - DNA, 620 bp, Homo sapiens
ctggccgcgctgcacaacatggccgagatgaagacgtcgctgttcccctacgcgctgcagggtccggccggcttcaaggcgcccgcgctggggggcctgggcgcgcagctcccgctcgggaccccgcacggcatcagcgacatcctgggccggcccgtgggcgcggcgggcgggggcctcctgggggggctgccccggctcaacgggctcgcgtcgtccgccggcgtttacttcgggcccgcggccgctgtggcgcgcggctaccccaatggcgcaagcggcacgcggcggagatggcgtcggccaagaagaagcaggactcggacgccgagaagctgaaggtgggcggctcggacgcggaggacgacgacgaatacaaccggcccctggaccccaactcggacgacgagaagatcacgcggctgctcaagaagcacaaaccctcgaacttggcgctggtcagcccgtgcggcggcggcgcgggggacgccttgtgaggacccgcggggtgggggcgaatctatttttgcagaatccgggggcggccccgggtgggcgcgagtcgctttgtatcatcaataaattatttaacgggtccccgtcggagccgtcgctccgga

SEQ ID NO: 98096 - DNA, 198 bp, Homo sapiens
ggacccgagtttgtgcgtgggagagagagacgcgcccttgggacaggagcgctgtgtgtgccctgggagggtctcaggatgggagtgtgtgtgtgtgatcgagggcctgttggagtgcaagttggtgtgggggtgagtttgagtttgggggcttgagagggaaacagtgggactcggtgtgggtgtgaggtgaggggc

SEQ ID NO: 98097 - DNA, 507 bp, Homo sapiens
ctggattgagagacacacatagctggtcaaacacgatttcagccatgaatcaggcataaatattctgatggttaattgtagacgtctacttgactggattgagagacacacacagctggtcaaacacgatttctgggcatatctatgagggcgtttctggaagacactgagataaccatgacccaatgtggatgggcactgatatggtttggctgtgtccccacccagatctcatcttgaattgtagttcctgtaatacctacatgtcgtgggagggacccaatgggaggtgactgaatcgtggtggtggttactgccatgatgttctcatgacagtgagtgagttctcatgatctgatggttttataaggggcttttcccctttggctcagcacttcttgttgctgccatgtgaagagggatagctttgcttccccttctgccatgattgtgaggcccctgcagccatgtggaactgtcagcccattaaacccctttgttctttat

SEQ ID NO: 98098 - DNA, 649 bp, Homo sapiens
tggattctcagtgggcattattcttggtagtaatttcaagtaaagtgttttacttctactctggaaacaagtaaacctggaaaacaatttatagtactaatatgaaaactctaaattcatcctggctttaaaacacccatagggaaggacatggctagattaccaagactaccatgacttttgtttcctaggtacatcttttccgttattctccctacataatacaaatgtagatttattgatttgtttttgctgctttttaaaagagaaaatgaacaaaaaataaatatccctcatatgtagttttaaaattattgaggagatatattgcttttaaatatcaaggagataaattacttttaaagattataaactataaccttaaaatcaagtatgatgcttaatattaaatggacaaaaaattagaatgtaacatattatataatacagccttaggttctttcatgttctttcattcaataatgttagaaataagtaggtgaattattgtagcatcacactatgttgcccaggctagtctcgaactcctgggctcaagtgaacctcccaccacagcctcccaagagctgggactataggcacttgccaccttgccctgctagaatcatttttaaatagcaacacatcc

SEQ ID NO: 98099 - DNA, 115 bp, Homo sapiens
tggaacatcagctcacccctcactgctgtggaacagccccccaggggcactcctggccctgtctactttttccacaagcccccaggacttccccttctactacctgcaacagggt

SEQ ID NO: 98100 - DNA, 411 bp, Homo sapiens
gagctcacaccactacactagagcctgggtgacacagcgagaagaaaattcctgacaaaatgcttaaaataaatcatcagtggatgaaacttgttttaagaagctggtgctccccccaccatcccacctggtaccccagttgccagccaagaattgtgttacctttaccctgactatcgtctttctggatccaatctcagatctaatggttagataattattctcttctcctataaaatgtccctattagagtgaatcttaattggccaacaagagaccttttttccttgcatgtaagattgtaataaaatgttcactcatgctcatagctatgttgtccaaaaagttttctttaacacaccaagaactaatacttcaggtttgtaggaatggaaaggaaggacaccaaag

SEQ ID NO: 98101 - DNA, 316 bp, Homo sapiens
gcccaggctggtctcaaactcctggtctcaagagatctgcctgccttggcctcccaaagtgctgggattacaggcatgtgccaccgtgcccagctagtttctattagtttttgaaattctgtgtatttttgtggttttcccagtctgttattttgcatatgtatgctttgttctttttacttttttttcaggtagtgaaattcagtggtatttatttttctccatctttttcaagctttcaacaataagcatctattacttcttatcaaaaaactaaaaaaaagacggtatggcatcataaatatttattttagaa

SEQ ID NO: 98102 - DNA, 175 bp, Homo sapiens
gccccagggagactctttcccatgctactctgtggtgaaatggaggtcacatgactggttctggccaatggcatgcaggtggaagtgaggaatgtccactccagacttgacctccacatttcccacccccagatccttagctcagtggctcttgcttctgtctcttggttggatg

SEQ ID NO: 98103 - DNA, 223 bp, Homo sapiens
tggaagcaaaatactgaatgtataaaaacaattgctcagagaatgagttcaacctctcaagagcattccaatgggaatgctgcatgcaacaacacgccctcagggaaaagtgggcattcctttcctaatagttggcagtgagaataaagttgtcatacagaacttttgaattgccttagggtgaaataagcagatcttcactaagagtaatattaagaaaaag

SEQ ID NO: 98104 - DNA, 441 bp, Homo sapiens
  misc_feature (1)..(1): n is a, c, g, or t
nagagaatgagagattatctcgatacctccattcctacctcacttctgatacatggagtggacttgagtaagttaaatgggcatgtaatgtgaccccactacttttctctgtttcttgtactttgttgccttttgcctttacttactctaaaatctgtggaaatcttatataatcccacccagcccagatgttttctctttcatgaagtttttcttgttcattcttgtaagaagtagtatgtcattttctaatctctggtaaaatcatttatttcattcatcatacatttatttggatttagaactactgtgtttgtctttgaaggcaaggacaactgtctttgaatccatgtaacatctctacaatcccttatatactaagtcccccataaatatttctcaaataaatgcttgcaaaagtgtgcttcattaaaaaaaaaa

SEQ ID NO: 98105 - DNA, 392 bp, Homo sapiens
atccccaccatttaacataactgacgcagtgtgtgctaaacatctcaattctgaatactattacagaatttgtttcaaagtactataacatatcccaactatcaaatgtctaattttaagtatcttttttatattttgaactttcatattatagtttccaaaaaaagaatgacaagaaatatagctacgtattctttaattagctgagaaacaggttaaaaccattttccaaagatttacatgaagttttaccttccccgaatcctcttaattgatcaggtgtgatcataaatgatataataatttatagtatttgatcacgttttaagtgtaatagagttctggacaactacaaaaccaattaatataaaattaattgtgctactgattgt

SEQ ID NO: 98106 - DNA, 339 bp, Homo sapiens
cactgcctttttgtagcttgggatctaatttgtaacaccttgctacctatgaaaagtgggaatgtaaaagggaaaaagcaacttggcatttactaaacttaggctaaccaaaaccctctgtagagatccttactagacatgggtgcaacagcaagcatcccagaggacccaccactggggtatgttttaggccaatggagcaaattcaaatttggctaaaagaagaagaaactcatttagtatggcaataatatttgcgttcgacacaaagtggcaaaccaacacatttggcctaaacatggttctatatgttataatgatactttacaattagacttc

SEQ ID NO: 98107 - DNA, 131 bp, Homo sapiens
gaaatcctaggtgctacaaaaatatttgggcctgaataaataacctgatttggttgttttgggagtttgaagaggtttaccaaaattcctcaagttagctattttccactttcaggatgcctcactaaaca

SEQ ID NO: 98108 - DNA, 558 bp, Homo sapiens
tctggacgagtgcactggggggaaggtacccgcccctcccccgccccccgccagcacctaggcaataggaaaagctggcttggcctggtggacttgggtggggagggggctttggttggtggctgcagtgacttcgagttctggtccaagactctcgattccttctcctttatgggcacagagggcaaggagtgtgggctttaaggagaatattccgatggggaggggcaagggccaaggcctgggctgtacccccaggacactgcctctgagttggaaccccttcatgggcaaacttggggatcagccccagtctccccgacccaggccactaaacttagcagtctcctgtctcctcatcagctgctcactaacatggctttaattctttgctgcctactcctgggcctatttccttctgtcctcagtgcaaggggtgggatggaagctggcaggcagaggatttcagttcccagtagcttcactgcctctgcagcagcacagtaagtaaagctgccttcccggtgtgaccagtccttgggaggaccccgtgagatg

SEQ ID NO: 98109 - DNA, 399 bp, Homo sapiens
tgtctcccacagccagtcttgaaaaccgagcaggaaactgcgtaccaagcaaagccaacagcacatgagagtttagaggcctgagagcctggcactcagggaactgcagtcaagtgtagctgctgccttagacgtgggggaaatgtgggaactgaggtgggagacatgggtgaggtacagatcacaaaggaccatgatgtcagggcttaccctgaagccctagggaggcaccaagggattttaggcagtggagcaatatggaaaaaactggctcggaatgtttgtttttttttttgagacgaagtctcacactgttgcccttgctggtgtgcagtgagccatgatcatgccactgcattccagcctaggcaacagagcaagaccctatatcaaaaaaaa

SEQ ID NO: 98110 - DNA, 505 bp, Homo sapiens
agacatcctggacagaagagcccgcctgtataaagcctctagtgtgagatgatcaccttggaatccttcatcctcatctgctgctgcacgaagccaggccagacgtggcccagcattcagaggtggaacagcaggttcctgccctggtgtggcccattcttatccaggaatagttctccagcctgaccctaggtttttttttcagccttaaaagttgaccccacggcagagagggaatagagttacattgaaaagtaagtgtagttctcttgagtgaaattgctctacagtatttaatagaatagttccacagtctgtgtatataactgtcatgttattctgtgggcctttcttggagtggggtgataagtgcgtttattgttccctaacttactcacctcactccttgaaatatttagtgtaccttccttcctgtagccagggttgatgacagatgttccttattgatcacactgagaacctatggccagatgaaggaaagaag

SEQ ID NO: 98111 - DNA, 343 bp, Homo sapiens
tctttcatttgtggcagccagattaaaatcggagaacaatttctgccaggcttctaggaactagtcagacaggtatgtgagggaagaaaccggagggcagccaaaggactggaaaagcgaagacacggggtatgaggaggtgaaagggtgtgttaccaggccgtggatgacaggcactggctgaggatgatttgaaaagattctgactggtagaactagtggtgaaaacgaggtaaagcattcgttgtttaattcacacctggatttttggcatgtcaaagcagttaaagctttcttgcagaagtttagaaatggatatcgattgagcctaggcggaattttc

SEQ ID NO: 98112 - DNA, 399 bp, Homo sapiens
gtaggattcaaacctggagttctgaaaatgacctttgccactgcaatgaagaagtccgactgggaaggaaggaaacatggaatggatccagaggtttctgaagtcttcaacacatacttaactctacaaaccaatcgctttcctttctattttaaacaatttggtttgggtttctgtcacttgccaccaaatgtatcttaaagcattataaatcagagtgacagagttttagatacagaactttgaaacatttgattcagagagaccaaaagtagagaaatgaaattggagccaagtgaatttctattaattcaattctacctctagtaagccctgtgccctacacaagtcaagtctgtttgtccctctgggccatgtattcttaacctatgtggtagg

SEQ ID NO: 98113 - DNA, 395 bp, Homo sapiens
ctaagtttcccaggctgctcttgaactcttgaccttgagccatccttccacctccgcctcttgaagtgctggggttacaggcatgagccatggtgcccagcctgctgtttctttagttcatgacgtttatcacaatgtgctactgtttccattgtttacatcatagtaggaaagggaaaataaactccctaagggcagcaataatttctgtctttgaatccttcattcagcaaatatttgttgagcaccaagggccagatggaactgagtatgtagtgttggagccagaaagaaggtccctgctctcctggagcttgtggtctgaccggcaagagagacaacagggggcctgcgagaaaaactgctgtgggtcaaaaaaagcctttttctctagt

SEQ ID NO: 98114 - DNA, 306 bp, Homo sapiens
taaaaaagccaggataggacaaagtctatttcaattaaactgtaggccaaagggatgtgaggaacgcaagatgcaaagcagagaaaaaaagtcacacaaatagaaaggctatcactgcatcaataattcaccagtgacaggcctttagaaggtttactgggaagaagtaactcagttatatacaaagagtaaataatctgaatttaaatgaataccaaaaatgtcaaaatgggcaatttttctgcaaataaccaagagaaaccctaaaataaagaactcatattccaatccagattaatacttatc

SEQ ID NO: 98115 - DNA, 776 bp, Homo sapiens
tcctcatttccagactttccgggcgcccaccaggctcccgggctctcaccggagaccacagggaggagcttcaaggtaccccaagtccctgcggcctccagcagtgaagagttccacaagggagtcttcctacgtcactgaataatgaatgaagatgagaggggaaaagagaagagacaaagtcaatccaaaaagctctcaaaggaaattaaactggattccatcatttcctacctatgattacttcaaccaagtgacgctacagttattagatggctttatgattacactgagcacagatggagtgatcatttgtgtggctgaaaacatctcttctcttcttggacatttaccagctgagattgtgggcaaaaaattattaagccttctgcctgatgaagagaaagatgaagtctaccaaaagattattctcaaatttcctttactaaactcagaaacacatattgaattttgctgtcatttaaaaagaggaaatgtcgaacatggtgatagttctgcttacgaaaacgtgaaatttattgtgaatgtaagagatatttgtaatgagtttcctgtggtctttagtggcttgttttccagccacctctgtgctgactttgctgcatgtgttcctcaggaggatcggctttatcttgtgggaaatgtttgcattctcaggactcagctcctgcagcaactttacacttcaaaggcagtcagtgatgaagctgtacttacacaagattcagatgaggaaccttttgtgggagagctca

SEQ ID NO: 98116 - DNA, 389 bp, Homo sapiens
agtgctgttgataaaggcgggtggggttgttctaacatcctcggtgacatgtgccccggcttttgagaactcctggctctgccggctctcagacttcataaaacccatgtggttgtggcaggcagtctgtcatagctggtctgtgcagtgtggtccatgcccgccaggcaggcttgaactcctcttcctctgtgatccgctctggcaaaataaaccagccaggtctggggtggcacctgccccgcactgaccctcaggcctgccgtgggctgagcacagggtaagcaggtggatccacgctctctctgcccctctcgctccctctccctgctccatcacacttcccattgaagaggaggatgagacgctcagtattttacttctcgccg

SEQ ID NO: 98117 - DNA, 439 bp, Homo sapiens
cacctatgaccaggggaccaagtgctcatcagcaaaccccataacctcgagtgcttcctggggcacaataaagatttgctgaatgagcaagggggggttgttggatggcagagggatgccaagggatgcagactggcttttctgtcaccctctcgaatgccgttgaacttaaaagtccccagagtgagggagcggggtctggagaccttggctctgacaaagcacgtgtggaagatgtgactgccatcactctcttcctgctttgcaccctgatctggaagcagatggtgtccccgtgtccctgtcctctgacaaagaactgggccacaggacgaccttggatagacctggcaaaggctcagtgttggcaggcagtgtccaggtggccatccgtgcatccgcccctccagctagcatttttgggcacctgttatgcttg

SEQ ID NO: 98118 - DNA, 398 bp, Homo sapiens
gatccaaaatgactggtctctctataagaagagaatattaggatacagagacacagagcagagatcatgtgcagacagagggaaaagatagccatttacaagtcagggagagatgcctcagaagaagccagcccagctgatgccttgatttggacttctagcctccagaactatgagaaaacaagtatgtattgtttaagctgtcaggtctgtggtattttgttgtggcagccctagcaaactaatacagcttcctagacatatcagtatttatgtcaaatgcaaatggactatatggtcaaattaaaaggctcaaattgcaatgaaagaagacccttgttggttacaagagacatatcaagaacacaagaatgtggaaagattagaataaaaaggtg

SEQ ID NO: 98119 - DNA, 805 bp, Homo sapiens
ttaggaatgcttcctttattagagattgaccatttatcttctttacatcttagagacataaaatttcacaagagtaaggagagatggaagtgggtcaaatgatttcctacatctttttttccttatcaaatacagtgctcaaaaaatttaagcattccctttattgctttctttcagtcttttcgagaaagtgggaatcagttcaagtagccgtgaggatcagacatggaataatttatttggtgatgggagggtacaaagacagattttgcctacaacccataattggtcttctgtagggacactcaggtaagtatctcagcaaaaggaagacatatagtttttatagactttctgggccagatggttgctgatgaaaactcacaagcttctcatagactactcccattaaacttcacccagaggaaatcccaccaggccttaagcaaagggacgagtcccttctaaatagattagaggacatatatccaaaaagtaggctttcctggaatgtcagtgagacagaaccattaactcacctggaaaaggggatgaagccagggagctgagtgctcttgcacagcggatccaacccccatggagcccaataagctaagatccactggtttgaaattcttgctgccagcacagcagtctgaagtcaacctgggactctcgagcttggttggggaaggggtgtccaccattgctgaggcttgagtacggggttttcccctcacagtgtaaacaaagtgcctgggaagctcgaactgggcggagcccgccacagcgctcaaagccctgg

SEQ ID NO: 98120 - DNA, 200 bp, Homo sapiens
ggcggcgacagcggagccgggccgggggctcagcggggtccgggggctgggggcagcgagcagggcggccccatggccgggcccccctgaggcagtccgggggagtcccctcccctccccagctcgggggtctccgggccccatgagccggggcgcgggcgcgcttcagcgccggacaacgacctacctcatctcgctga

SEQ ID NO: 98121 - DNA, 474 bp, Homo sapiens
cagtgtctgcacacctcattcctcttggtcgtgagacaagaactcagaacttgctgaaatgcagaagtgaaagagcagtatcactccatcctgctgaactacgggagtgaagaagccacagtaggactttactagaagtgaggattggagaacagaatctttccaaaagttttgaagaagcttccatgttgtgagagagcatatggagggggccacgtggcaaggaactgtagtggccactgagtactgagagtgctgagtgctgaacatagaacctcagggcaacagttgcaaagacatgaattccaccaacaacatgaaggccttggaaatggattattctctagtccaggctctgatcaccacagccccagccaacacctgaatttgagccttgtgagaccctggagtagagaacttagctaggatatgcctgacttctgccctacagaaacaaagacataataaatgtgt

SEQ ID NO: 98122 - DNA, 725 bp, Homo sapiens
agccccagctgtgggaacattcctacaaagctgattctcttccgattctgctggaatcctgagtctctctcaaactggaattatcttaacaattcttttgcttgaggtttcctggacggcatatgtggataatggtctcactctgtcatccaggctggagtacagtggcatgatcctagctcactgtagattcgaaatcctgttccagtggtcctcccacctcaacctcctgatcaactgaactacaggaatgcaccaccaaacccagctaattatttttttgtagaggtgggggtctcacaatgctgcccagactgttctcaaactcctggcctcaagtgatgttcctgcccaggcctaaaattttaaggagcaggtgatgtttagcctggagaactgaaggctcaggaagaacggggtcttcaaacacctgaaggactgtctcatgaaaaagagatgcacaagacaggagaattgagcagagagatgtttaactcaaatcgaagaacaaagacagcattgaatcaccacctatcaagggtcttacttgaatagactttggtttggatgagaggctatagaagaaaacctcaaaagtctcttccaattctaaggtttcatgattccaggcatttggagaattaggaaaaataatcacttaaaaaaaaaactatttagtgccaagcttcctaaaacatctttaaaatgtccaatatccatgaatc

SEQ ID NO: 98123 - DNA, 531 bp, Homo sapiens
ccttccttacagtttttaaaaataacttttttgagtaagaattaacatgtagtaaactacatgtttccagagtattaaagttttctcatatgtgtacagctgtgagaccatcactacaagttaggaaatgaacctgtccatcccctgccaaagtttctgcctgaccttttataatctttctcatccagctttccccacagcacacttccacactctccaaccccatctctaatcaatgatctatatctaatcattatagattagatgcattttctgggatattatagaaattgaatcatatagtatgtactcttttcctttttttggtttggctttctcacacaaaataaataacttgacactcatttttgttgtagcatgtatcaataggtcatacatttattgccaagtagtatttcgttgtatggatatgctacaattagtgttatctatttatctgttgatggacatttacactggttgtttcccattttctactatttcaaataaagttgctatgacacttgtgta

SEQ ID NO: 98124 - DNA, 260 bp, Homo sapiens
aactggggcatcagagaggccaagcggcttgcccaaggtcacacagcggatgttcgagtggaaatggaatgcaagcattcagactccagaacttgcactgtcttcagaaatggcctcaagttagtggtttgctcaggggtgaagagcaaagcaaagttcagggcctcatcccagggtgtgtcacttggcatgagggacgaggacccccatttcctctcagctgaggggaagagctctccacaatgtccccctgcacggtc

SEQ ID NO: 98125 - DNA, 424 bp, Homo sapiens
agactgatgcagataacccgatctcctcacctgttgatccacccgcctcggctcccaaagtgctgggattacaggcgtgagccactgtgcccggccgagaagtctttttaacatcattggagagatatggtagaggaagagaccgagacgtagggagcagtgagtcggtttgggatgagactggcaggagcaggcagatacagtattcgacctcggagctgggcttttaggctggggtcctggcgcccctagagtgtcaggaggtgagggcctgaagctacaggcagaatcccagtgtctgtgtgggccgtgggcttgctctggacactctggggacaggatgcaaggccgtcatcagattctcaaaggggcccgtgtccagaaaaaaaacgtgttaaacctccgatatggaagcatctgcagt

SEQ ID NO: 98126 - DNA, 349 bp, Homo sapiens
aaaggggaagagaggcagtaagtggactgtaaagagtgcttattccacgctgggcaggtcattagaattgtcatgtcaaattcccttccttaatcccctcaactacccagtggagtcaggattattaatctcttcctctatacgtgaggacagtgaatccagagtggcttgctggtgctgaatagatcatgttgtcttacaacttgagcttttcccttgttcctttccctatttgtctgctgaactcatctgtctccaggttgtaaatgagattctcctctgaagagcctctgagccccctgtaactctattcttgtattgcatgacgatactcttgttctttaggttt

SEQ ID NO: 98127 - DNA, 286 bp, Homo sapiens
cgacaggattctaggatagtcagtagaattagaattgtgaagatgatcagtgtagagggaaggttattgtgttgctattgattgacatttggaaactgaagctgaggttaatacagagtaaactattctctcttatgaagggttattaactcgttcaggccttctgtcagtggtatgtaattccctgcatgggagtcagaacaacaaagttggaaggttaagagaaacttaacccacccatcgtagaaagaagaggccagaaaagcaaagtggcctgctaaaagtc

SEQ ID NO: 98128 - DNA, 131 bp, Homo sapiens
atcctggaagacaagtgaagctagggtgcaacagagtatcaaatgctactgagatatcaagaataaaaatgggtgagaaatgaccactgactctacatacattttctaaacctgttctttcctattccacg

SEQ ID NO: 98129 - DNA, 392 bp, Homo sapiens
agaagacaagcctcttaggaaggctgcagtttcatcagtttggaagcaggaatagggattattccttagtgatctgacctcgtagggatttgcccagtcttcactgtgtgaatctcaaggttaattacttatgcctaaattaacatggtagaaagcacactgcttaagccagagagctcttcctaactgaggaatggttggaatctttattaaacaatctgaattccttttccctttgggttccaaacaagttttctgaagccattacagaccttttgggtggtccctccagatgagtggcagagatgttgtgagcagtgtacacttctccccgggggtaaggctgtgagtctgccctagctgtggcatctgggatgcaagcaggtacagta

SEQ ID NO: 98130 - DNA, 398 bp, Homo sapiens
aggaggtgaaggctgccgtggtcatgatcacacccccgcactctagtccgagtgtcagagaccttgtctcaaaagaaaaacaaaagaaaagaaggaatagtacacacagagttgaatggcctcatggatccctcctacatggtattcccatcctctgcccctgccaaagaggtagattgtggtaatttcctcaacccatgcccaccccagatcagtcctggctttctctgtgccctgggaggctgatccctaggaactgccctccagttgagtttagtcaatggtagtcaccagaagactggagggcgggagaagagagaggctggggtatctgtttctcctgcctcctccctgttctgctgcccccttcatccactacagctcctcactggcagctc

SEQ ID NO: 98131 - DNA, 117 bp, Homo sapiens
cacatgctgctccttctgtttccaatccttatcttcccctttatttatttatttattttttttttgagacaaggtctcattctatcacccaggctagattgcaatggtgtgatccca

SEQ ID NO: 98132 - DNA, 139 bp, Homo sapiens
cccctcccatcctctagccaggacctggctctgcatttgtctctagctgttgagttcacctgatgttgttacatacttcgtgtacttttcccacactctagactgtacgccacatgcaagtagaacatttatgtcttgt

SEQ ID NO: 98133 - DNA, 347 bp, Homo sapiens
cagatgctggagaggacgtggagaaatagtaacgcttttatgctgttggtgggagtgtaaattagttcaaccattgtggaagacagtgtggtgattcataagctatttttaattgtttttatgttcctggatctagtccatgtaacgtagagaaccaaataaatgggaaaatgagctattatatgtattttgtttgttttggttttttttttttgagatagagttttgctctgtcgcccagtctggagtacagtggtgcaatcttggctcactgcaacctccgcctcctaggttcaagcaattctcatgcctcagcctcccaaatagctgggactagaggcgtgtac

SEQ ID NO: 98134 - DNA, 705 bp, Homo sapiens
atcagttggcgcagcccggaagcttcgaggagctcctagaaccgccgccttagctggcggcgccggctcttagcctggaggtcggcggaccgcttccaaaagtggaccgaaattccggggatggatgccgggtggggacgcggacggccgcaggccagcctcctgacagccggggctgagggaaccggccgcagcaaatcgcacaccctctctgtgtgccagagtgactggcgcaggccgcgtaagagaggagcgagaccccggaccagcccgcaccgcggaggaccggagagggcgattcgaaatgacttactaggggacgagaaacacgtacttggaaagaattgagccagctgaaatggaaaactgtgggaaggggatggggaacgaggctgctccacctgagatccggctccaggacttacagcaaggggaacttggcaacatggacaatctttcctaagctgctcagcttacaagaatcaggacatcatactgctaagaattcagacgtcagcagatcatagtccctgactccaactcttctggcacaaacatcagacatggtggtatccagccgggccttggtccagcgacgaaggcagagatgaacattctagaaaatcaacgagaaattgcgcccccagctggcagagaacaaaccagagttcagaaacctcaaagagaactgttgggtagctcaaa

SEQ ID NO: 98135 - DNA, 528 bp, Homo sapiens
aaaaaaaaaaaaagtgtagtctgtagtgttggtgggattgtgggggaagtagaggctgacatctacaataagtgggtagtgctatcgtggaggttagtttgacagttacctgtcgatatggcaagtgctgacactctttgacccggccgttccttctccaagtatctattctagagaaaaacctatcacagacgcactagacaacatgaataaggacatttgttgcagtgtcaataaacttttaaaaaggaataaaccaactgtctataggggattggcctgagaactcagtcacattgttcaggtaaaaaaaatctcaaaacacatccttgaagaacctttctccaacccctgtcttccatctgctagtccccacctctcccatggtaggcaacaactaccatcatccatttctagactgtccttctagaaatttcttctatgcctatagaagcaactgtgaatacatctttccccctttttagacaaatagttgtgtactatcatgcatttctacactttgctgtt

SEQ ID NO: 98136 - DNA, 569 bp, Homo sapiens
cctcacatgcgcatttcacaatagggtttgtactcctatgagaatcgaatgctattgttgatctgacaggagccggagctcaggtggtaacgcttgctcaccctcccaacgcctgccgtgcacctggttcctaacaggccatagactgataccagtccgtgtcctgggctttggggactcctgacttaacttgtttctttatctcctctccaatatttcctgtggaatatcaaaggctttatcataattatattgtatcacttcagatggcatgtattgtctagctgtttcactgttagtgactagaaattaaggtaaatccctggattaaggtagtgacatctgattccttcattgtaaagttaatattttatacttgagataggcaagaacttcgtagagagatagtttggtactatgtaactgtccagatactcatcattctttcacttaatgagctcagtgtccattgatgatttcttcctgaatcggttatgtcaccgagagctacaaattggtgattttcctattctgttatttcatctgcatttatttcctggcatcttctt

SEQ ID NO: 98137 - DNA, 424 bp, Homo sapiens
ctaaatagggcacacagctcacgtttttacttggaagaaatggacacttacgtgggctggggcagttacaagctgacatcagcaagttcctgcccatggctgttttcctgcaggttgaaaaacctgtttggacagccctggcctggccacgttacaaaatctggtcattgaagagatttccaaggcagaggcagtttcccacatacgttcccacgaggactttgtgcactgctccttggcatggctgtcttaatagccacggcttcagctctagggtctcccggaaagatggtgtcctggttccaagtacccactttccccacttctttaaaattttttttgagacacggtctcgctctgtcacccaggctagagtgcagtggcgcaatcttggcttactacaacctctgcctcccaggctcaa

SEQ ID NO: 98138 - DNA, 545 bp, Homo sapiens
caaccagcatccccagagacagttagcctgacatcagaattgtgttttgctagctaaatacagattccctctacagtattatgcaatttattacaagcagacgggcttgatccagtagctgagaagtcagctgagtcctccttaagaacttgctgaaataaagggaaaggggaaggcaaagggtccaaagacagaaaaggcagaaacagtcagaaataaagagttagtaccaatgtctttagcggcacctcagagatagtcatgggggaatcttgtcaaatgcggattctgactcagtagatctgaggtggggatgaagggtctgaatttctgacaagctcccaggaaatgctgtttatcccaaaaaacaatagtgtcaagaatactaagagcaccaagagtgtcctttttctttgtttaaggatgcttttgctcccaaaaggatacattgtatatgtgctctggttttctttcatattctctttataggatgtagttttgtttctctctaatgttatttcatttgtactgttttcaggtcgcat

SEQ ID NO: 98139 - DNA, 3787 bp, Homo sapiens
ccggcgcgggagtaactcctcgcagaggcctctgggagttgtagtttttttgcctttgcctctccatgacgcaattcctgtgcgacatacgtagcggccgccattgttccgcgccgatggcgagatccttgttcctcagatagcgttcatcgcccgtcgtggtcaacgggccagccgagtctggagtggttgcgaacccttctggctgcagatctggaggtggaggcagtaccctggactctattctgctgccccttcagggtttggaggagccggagcatccctcgcgtcctgtcacttccagcgaggcacacaaaactgaccgtagggatggccaccagggtccggacagcttctatttgggtcccacctctccaagaacgaaacagttcatgggataggatcagaaagctccaaggtcaggaatccatcttgggccaagggactcctggtctgcaacctctccctggaacacccaggcagaagcagaagagtcgcagaatagagaaagtcctagagtggctgtttatttcccaagagcagccaaaaatcaccaagtcctggggacctttgtcattcatggatgtgtttgtggattttacctgggaggagtggcagctgctagacccagcacagaagtgcctgtacaggagtgtgatgttggagaactatagcaacctggtgtccctagggtaccaacacaccaaacctgatatcatcttcaagttggaacaaggagaagagctgtgtatggtgcaggcccaagttccaaatcagacctgtccaaacacagtctggaaaattgatgatcttatggattggcatcaggaaaataaagacaagctgggaagtacggcaaaaagctttgaatgcactacatttggaaaactatgtcttcttagtacaaagtatctttcaagacaaaaacctcataaatgtggcacgcatggaaagagtttgaaatatatagatttcactagtgattatgctagaaataatcctaatgggtttcaggtacatggaaaatcattcttccattctaaacatgagcaaactgttattggaataaaatactgtgaaagtattgaatctggaaaaaccgtcaataagaaatcgcaacttatgtgccaacaaatgtatatgggcgaaaaaccctttggatgcagctgttgtgagaaagccttcagcagcaagtcataccttctagtgcatcagcaaactcatgccgaagagaaaccctatggttgtaatgaatgtgggaaagacttcagtagtaaatcatacctcattgtacatcagagaattcatacaggagagaaactacatgaatgcagtgaatgcaggaaaacattcagtttccattcacagcttgttatacatcagagaattcacacaggtgagaatccctatgagtgctgtgaatgtgggaaagtcttcagtaggaaagaccagcttgtttcacaccagaaaactcattcaggacagaaaccatatgtgtgtaatgaatgtgggaaagcttttggtttaaaatcacagctcattatacatgaaagaattcatacaggagagaaaccatatgaatgcaatgaatgtcagaaagcctttaatacaaagtcaaaccttatggtacatcagagaacccatacaggggagaaaccttatgtttgtagtgattgtggaaaagcctttacattcaagtcacagctcattgtacatcaggggattcacacaggagtaaagccctatgggtgtattcagtgtggtaaaggattcagtttgaaatcacagctcattgtacatcagagaagtcacacaggaatgaaaccttatgtatgcaatgaatgtggcaaagccttcaggagcaagtcataccttattatacatacaaggactcatacaggagaaaaactccatgaatgcaacaattgtgggaaagccttcagttttaaatcacagctcattatacatcagaggattcatacaggagagaacccctatgaatgccatgaatgtgggaaagccttcagtcggaaataccagcttatttcacaccagagaactcatgcaggagagaagccttatgaatgcaccgactgtggaaaggcttttggtttaaagtcacagcttattatacaccagagaactcatacaggggagaaaccatttgaatgtagtgagtgtcagaaagcctttaatacaaagtcaaacctgattgtacatcagagaactcatacaggagagaaaccctatagttgtaatgaatgtggaaaagcctttacgttcaaatcacagctcattgtacataaaggagtgcacactggagtaaaaccctatggatgcagtcaatgtgcaaaaacctttagtttgaagtcccagctcattgtacatcagagaagtcacacaggagtaaaaccatatggatgcagtgagtgtgggaaagccttcaggagcaagtcataccttattatacatatgagaactcatacaggagagaaaccacatgagtgcagggaatgcgggaaatcctttagtttcaattcacaactcattgtgcatcagagaattcacacaggagaaaatccctatgaatgcagtgaatgtgggaaagcctttaataggaaagaccagctcatttcacatcagcgaactcatgcaggggaaaagccttatgggtgcagtgaatgtgggaaagcttttagcagcaagtcatacctaattatacacatgagaactcattcaggtgaaaaaccatatgaatgtaatgaatgtgggaaagccttcatttggaaatcactactcattgtacatgagcgaactcatgcaggggtcaacccttataaatgcagtcaatgtgagaaatccttcagtgggaaattacgccttcttgtacaccagagaatgcacacaagagagaaaccatatgaatgcagtgagtgtggaaaagccttcattaggaattctcaactcattgtacatcaaagaactcattcaggagagaaaccctatgggtgcaatgaatgtgggaaaaccttctctcaaaaatcaattctcagtgcacatcagagaacacatacaggagagaagccttgtaagtgcactgaatgtgggaaagccttttgttggaagtcacagctcattatgcatcagagaactcatgtagatgacaaacattgataattttacgaaactctgaaaagtggattcacaagagatagaaacaatcatatataaagagaaactctgtaagtggaatcatcttgtcatcttccagaaaactcatactgaatagaactttatgaatgcacagcatatggaaaggcatccacagaaagctgttctttacatgcaaaaagatagtagacaatacacaggaaaactgaatttagtaaccactctgaaaatttttagcagcaagtcatacctttttttaaaaagttcatacaggtgaggaaccatgttaaacgttgtaaagtcattttactaacataagattcacaaagaggaaacttcatgaaccagatgaatatagaatagacttctttgaaattcatagtttacagaattttaatgagagaaattattgagctaatgaatggcagaattaacaaaattacaaacattttatgtatcggaagcatataccttggagggaccatgctatgagggaaagtgtaaatctagaaatgagaaacccctagggaaaaaatatatataggagtgaacatcttatgaatgtaccaaataaaccacagctggactgttaacctcaccttagaagcttctttct

SEQ ID NO: 98140 - DNA, 3725 bp, Homo sapiens
ccggcgcgggagtaactcctcgcagaggcctctgggagttgtagtttttttgcctttgcctctccatgacgcaattcctgtgcgacatacgtagcggccgccattgttccgcgccgatggcgagatccttgttcctcagatagcgttcatcgcccgtcgtggtcaacgggccagccgagtctggagtggttgcgaacccttctggctgcagatctggaggtggaggcagtaccctggactctattctgctgccccttcagggtttggaggagccggagcatccctcgcgtcctgtcacttccagcgaggcacacaaaactgaccgtagggatggccaccagggtccggacagcttctatttgggtcccacctctccaagaacgaaacagttcatgggataggatcagaaagctccaaggtcaggaatccatcttgggccaagggactcctggtctgcaacctctccctggaacacccaggcagaagcagaagagtcgcagaatagagaaagtcctagagtggctgtttatttcccaagagcagccaaaaatcaccaagtcctggggacctttgtcattcatggatgtgtttgtggattttacctgggaggagtggcagctgctagacccagcacagaagtgcctgtacaggagtgtgatgttggagaactatagcaacctggtgtccctagggtaccaacacaccaaacctgatatcatcttcaagttggaacaaggagaagagctgtgtatggtgcaggcccaagttccaaatcagacctgtccaattttgaaggctggaaagtccaaagccaaggtgctggcaggtttggtgtctggtgagggcctgctctgtgcttccaagatgacgccttgttgctgcatcctctggagacacagtctggaaaattgatgatcttatggattggcatcaggaaaataaagacaagctgggaagtacggcaaaaagctttgaatgcactacatttggaaaactatgtcttcttagtacaaagtatctttcaagacaaaaacctcataaatgtggcacgcatggaaagagtttgaaatatatagatttcactagtgattatgctagaaataatcctaatgggtttcaggtacatggaaaatcattcttccattctaaacatgagcaaactgttattggaataaaatactgtgaaagtattgaatctggaaaaaccgtcaataagaaatcgcaacttatgtgccaacaaatgtatatgggcgaaaaaccctttggatgcagctgttgtgagaaagccttcagcagcaagtcataccttctagtgcatcagcaaactcatgccgaagagaaaccctatggttgtaatgaatgtgggaaagacttcagtagtaaatcatacctcattgtacatcagagaattcatacaggagagaaactacatgaatgcagtgaatgcaggaaaacattcagtttccattcacagcttgttatacatcagagaattcacacaggtgagaatccctatgagtgctgtgaatgtgggaaagtcttcagtaggaaagaccagcttgtttcacaccagaaaactcattcaggacagaaaccatatgtgtgtaatgaatgtgggaaagcttttggtttaaaatcacagctcattatacatgaaagaattcatacaggagagaaaccatatgaatgcaatgaatgtcagaaagcctttaatacaaagtcaaaccttatggtacatcagagaacccatacaggggagaaaccttatgtttgtagtgattgtggaaaagcctttacattcaagtcacagctcattgtacatcaggggattcacacaggagtaaagccctatgggtgtattcagtgtggtaaaggattcagtttgaaatcacagctcattgtacatcagagaagtcacacaggaatgaaaccttatgtatgcaatgaatgtggcaaagccttcaggagcaagtcataccttattatacatacaaggactcatacaggagaaaaactccatgaatgcaacaattgtgggaaagccttcagttttaaatcacagctcattatacatcagaggattcatacaggagagaacccctatgaatgccatgaatgtgggaaagccttcagtcggaaataccagcttatttcacaccagagaactcatgcaggagagaagccttatgaatgcaccgactgtggaaaggcttttggtttaaagtcacagcttattatacaccagagaactcatacaggggagaaaccatttgaatgtagtgagtgtcagaaagcctttaatacaaagtcaaacctgattgtacatcagagaactcatacaggagagaaaccctatagttgtaatgaatgtggaaaagcctttacgttcaaatcacagctcattgtacataaaggagtgcacactggagtaaaaccctatggatgcagtcaatgtgcaaaaacctttagtttgaagtcccagctcattgtacatcagagaagtcacacaggagtaaaaccatatggatgcagtgagtgtgggaaagccttcaggagcaagtcataccttattatacatatgagaactcatacaggagagaaaccacatgagtgcagggaatgcgggaaatcctttagtttcaattcacaactcattgtgcatcagagaattcacacaggagaaaatccctatgaatgcagtgaatgtgggaaagcctttaataggaaagaccagctcatttcacatcagcgaactcatgcaggggaaaagccttatgggtgcagtgaatgtgggaaagcttttagcagcaagtcatacctaattatacacatgagaactcattcaggtgaaaaaccatatgaatgtaatgaatgtgggaaagccttcatttggaaatcactactcattgtacatgagcgaactcatgcaggggtcaacccttataaatgcagtcaatgtgagaaatccttcagtgggaaattacgccttcttgtacaccagagaatgcacacaagagagaaaccatatgaatgcagtgagtgtggaaaagccttttgttggaagtcacagctcattatgcatcagagaactcatgtagatgacaaacattgataattttacgaaactctgaaaagtggattcacaagagatagaaacaatcatatataaagagaaactctgtaagtggaatcatcttgtcatcttccagaaaactcatactgaatagaactttatgaatgcacagcatatggaaaggcatccacagaaagctgttctttacatgcaaaaagatagtagacaatacacaggaaaactgaatttagtaaccactctgaaaatttttagcagcaagtcatacctttttttaaaaagttcatacaggtgaggaaccatgttaaacgttgtaaagtcattttactaacataagattcacaaagaggaaacttcatgaaccagatgaatatagaatagacttctttgaaattcatagtttacagaattttaatgagagaaattattgagctaatgaatggcagaattaacaaaattacaaacattttatgtatcggaagcatataccttggagggaccatgctatgagggaaagtgtaaatctagaaatgagaaacccctagggaaaaaatatatataggagtgaacatcttatgaatgtaccaaataaaccacagctggactgttaacctcaccttagaagcttctttct

SEQ ID NO: 98141 - DNA, 812 bp, Homo sapiens
ccggcgcgggagtaactcctcgcagaggcctctgggagttgtagtttttttgcctttgcctctccatgacgcaattcctgtgcgacatacgtagcggccgccattgttccgcgccgatggcgagatccttgttcctcagatagcgttcatcgcccgtcgtggtcaacgggccagccgagtctggagtggttgcgaacccttctggctgcagatctggaggtggaggcagtaccctggactctattctgctgccccttcagggtttggaggagccggagcatccctcgcgtcctgtcacttccagcgaggcacacaaaactgaccgtagggatggccaccagggtccggacagcttctatttgggtcccacctctccaagaacgaaacagttcatgggataggatcagaaagctccaaggtcaggaatccatcttgggccaagggactcctggtctgcaacctctccctggaacacccaggcagaagcagaagagtcgcagaatagagaaagtcctagagtggctgtttatttcccaagagcagccaaaaatcaccaagtcctggggacctttgtcattcatggatgtgtttgtggattttacctgggaggagtggcagctgctagacccagcacagaagtgcctgtacaggagtgtgatgttggagaactatagcaacctggtgtccctagggtaccaacacaccaaacctgatatcatcttcaagttggaacaaggagaagagctgtgttttgggtggcaaaggccccaagtttccaaaattaagaacccttgttcccaaatttttggaaa

SEQ ID NO: 98142 - DNA, 3893 bp, Homo sapiens
ccggcgcgggagtaactcctcgcagaggcctctgggagttgtagtttttttgcctttgcctctccatgacgcaattcctgtgcgacatacgtagcggccgccattgttccgcgccgatggcgagatccttgttcctcagatagcgttcatcgcccgtcgtggtcaacgggccagccgagtctggagtggttgcgaacccttctggctgcagatctggaggtggaggcagtaccctggactctattctgctgccccttcagggtttggaggagccggagcatccctcgcgtcctgtcacttccagcgaggcacacaaaactgaccgtagggatggccaccagggtccggacagcttctatttgggtcccacctctccaagaacgaaacagttcatgggataggatcagaaagctccaaggtcaggaatccatcttgggccaagggactcctggtctgcaacctctccctggaacacccaggcagaagcagaagagtcgcagaatagagaaagtcctagagtggctgtttatttcccaagagcagccaaaaatcaccaagtcctggggacctttgtcattcatggatgtgtttgtggattttacctgggaggagtggcagctgctagacccagcacagaagtgcctgtacaggagtgtgatgttggagaactatagcaacctggtgtccctagggtaccaacacaccaaacctgatatcatcttcaagttggaacaaggagaagagctgtgtatggtgcaggcccaagttccaaatcagacctgtccaattttgaaggctggaaagtccaaagccaaggtgctggcaggtttggtgtctggtgagggcctgctctgtgcttccaagatgacgccttgttgctgcatcctctggagacacagtctggaaaattgatgatcttatggattggcatcaggaaaataaagacaagctgggaagtacggcaaaaagctttgaatgcactacatttggaaaactatgtcttcttagtacaaagtatctttcaagacaaaaacctcataaatgtggcacgcatggaaagagtttgaaatatatagatttcactagtgattatgctagaaataatcctaatgggtttcaggtacatggaaaatcattcttccattctaaacatgagcaaactgttattggaataaaatactgtgaaagtattgaatctggaaaaaccgtcaataagaaatcgcaacttatgtgccaacaaatgtatatgggcgaaaaaccctttggatgcagctgttgtgagaaagccttcagcagcaagtcataccttctagtgcatcagcaaactcatgccgaagagaaaccctatggttgtaatgaatgtgggaaagacttcagtagtaaatcatacctcattgtacatcagagaattcatacaggagagaaactacatgaatgcagtgaatgcaggaaaacattcagtttccattcacagcttgttatacatcagagaattcacacaggtgagaatccctatgagtgctgtgaatgtgggaaagtcttcagtaggaaagaccagcttgtttcacaccagaaaactcattcaggacagaaaccatatgtgtgtaatgaatgtgggaaagcttttggtttaaaatcacagctcattatacatgaaagaattcatacaggagagaaaccatatgaatgcaatgaatgtcagaaagcctttaatacaaagtcaaaccttatggtacatcagagaacccatacaggggagaaaccttatgtttgtagtgattgtggaaaagcctttacattcaagtcacagctcattgtacatcaggggattcacacaggagtaaagccctatgggtgtattcagtgtggtaaaggattcagtttgaaatcacagctcattgtacatcagagaagtcacacaggaatgaaaccttatgtatgcaatgaatgtggcaaagccttcaggagcaagtcataccttattatacatacaaggactcatacaggagaaaaactccatgaatgcaacaattgtgggaaagccttcagttttaaatcacagctcattatacatcagaggattcatacaggagagaacccctatgaatgccatgaatgtgggaaagccttcagtcggaaataccagcttatttcacaccagagaactcatgcaggagagaagccttatgaatgcaccgactgtggaaaggcttttggtttaaagtcacagcttattatacaccagagaactcatacaggggagaaaccatttgaatgtagtgagtgtcagaaagcctttaatacaaagtcaaacctgattgtacatcagagaactcatacaggagagaaaccctatagttgtaatgaatgtggaaaagcctttacgttcaaatcacagctcattgtacataaaggagtgcacactggagtaaaaccctatggatgcagtcaatgtgcaaaaacctttagtttgaagtcccagctcattgtacatcagagaagtcacacaggagtaaaaccatatggatgcagtgagtgtgggaaagccttcaggagcaagtcataccttattatacatatgagaactcatacaggagagaaaccacatgagtgcagggaatgcgggaaatcctttagtttcaattcacaactcattgtgcatcagagaattcacacaggagaaaatccctatgaatgcagtgaatgtgggaaagcctttaataggaaagaccagctcatttcacatcagcgaactcatgcaggggaaaagccttatgggtgcagtgaatgtgggaaagcttttagcagcaagtcatacctaattatacacatgagaactcattcaggtgaaaaaccatatgaatgtaatgaatgtgggaaagccttcatttggaaatcactactcattgtacatgagcgaactcatgcaggggtcaacccttataaatgcagtcaatgtgagaaatccttcagtgggaaattacgccttcttgtacaccagagaatgcacacaagagagaaaccatatgaatgcagtgagtgtggaaaagccttcattaggaattctcaactcattgtacatcaaagaactcattcaggagagaaaccctatgggtgcaatgaatgtgggaaaaccttctctcaaaaatcaattctcagtgcacatcagagaacacatacaggagagaagccttgtaagtgcactgaatgtgggaaagccttttgttggaagtcacagctcattatgcatcagagaactcatgtagatgacaaacattgataattttacgaaactctgaaaagtggattcacaagagatagaaacaatcatatataaagagaaactctgtaagtggaatcatcttgtcatcttccagaaaactcatactgaatagaactttatgaatgcacagcatatggaaaggcatccacagaaagctgttctttacatgcaaaaagatagtagacaatacacaggaaaactgaatttagtaaccactctgaaaatttttagcagcaagtcatacctttttttaaaaagttcatacaggtgaggaaccatgttaaacgttgtaaagtcattttactaacataagattcacaaagaggaaacttcatgaaccagatgaatatagaatagacttctttgaaattcatagtttacagaattttaatgagagaaattattgagctaatgaatggcagaattaacaaaattacaaacattttatgtatcggaagcatataccttggagggaccatgctatgagggaaagtgtaaatctagaaatgagaaacccctagggaaaaaatatatataggagtgaacatcttatgaatgtaccaaataaaccacagctggactgttaacctcaccttagaagcttctttct

SEQ ID NO: 98143 - DNA, 1520 bp, Homo sapiens
ccggcgcgggagtaactcctcgcagaggcctctgggagttgtagtttttttgcctttgcctctccatgacgcaattcctgtgcgacatacgtagcggccgccattgttccgcgccgatggcgagatccttgttcctcagatagcgttcatcgcccgtcgtggtcaacgggccagccgagtctggagtggttgcgaacccttctggctgcagatctggaggtggaggcagtaccctggactctattctgctgccccttcagggtttggaggagccggagcatccctcgcgtcctgtcacttccagcgaggcacacaaaactgaccgtagggatggccaccagggtccggacagcttctatttgggtcccacctctccaagaacgaaacagttcatgggataggatcagaaagctccaaggtcaggaatccatcttgggccaagggactcctggtctgcaacctctccctggaacacccaggcagaagcagaagagtcgcagaatagagaaagtcctagagtggctgtttatttcccaagagcagccaaaaatcaccaagtcctggggacctttgtcattcatggatgtgtttgtggattttacctgggaggagtggcagctgctagacccagcacagaagtgcctgtacaggagtgtgatgttggagaactatagcaacctggtgtccctagggtaccaacacaccaaacctgatatcatcttcaagttggaacaaggagaagagctgtgtatggtgcaggcccaagttccaaatcagacctgtccaattttgaaggctggaaagtccaaagccaaggtgctggcaggtttggtgtctggtgagggcctgctctgtgcttccaagatgacgccttgttgctgcatcctctggaggtgaggaacactgtgggacagaaagaggggcaaaaaaggcctaagatcattccctcaagcccttttagaaacgactaatccattcatgagggcacaacttaatcttctcttaataccaccacaatggggagtaagtttcaacatgagttttagaggggacacattcaaaccttaataacttccattcggaagattgaagctcttttcctctactggtaattgatagccatactgatcttttatctgccctttggtcctggttttgattgattcactggcatctccctcataccactccctggcctcgttttcagaaactggaatcgtctctcccactgctccacctacataccaccttcttttcatctttcttctctttgtttatcctgttttttaaattctaattttgtatttttagacagggtttcaccatgttgatcaggctggtctcgaactcctgacctcaggtgatcccgcctcagcctcccaaggtgctgggattacaggcatgaaccactatgcccggccaaccctgtctctttaaaaaaaaaaaaaaaaaaggccaggtgtggtggctcatgcctgtaatcccagcactttgggaggctgaggcaggtggatcacgag

SEQ ID NO: 98144 - DNA, 329 bp, Homo sapiens
attccttatgcttgtttcacttggttgagaatggtgctacagctcagcttgcacatcctcacaccgactcccaaacgagaagaaagaatcaaaggctttctctttacaaggctttgatcttttattcaggaggcatctttctaagctctccagacaacatttcctgatgtctccctgggcagagctaggacagggctgcaaaggagcctgggccaataggcagctggccaagggagttaggggtgctatgtgaacctagtccagtcaagattcatcccttgggaccggacacggtggctcacgcctgtaatcccaccactttgggaggc

SEQ ID NO: 98145 - DNA, 321 bp, Homo sapiens
tatagtaggagctcagtaactgtttggtcggttggtcctgccttctgtctgattcccttccttgtcctgagctcaaactcatttctccagctgcttgctggacatgtcacctgagccacctcagttaaaaatcttatctctaaaatgtttctgagttcctcccccattttcctccatctttctgtcgtcattatctcttgcctgcattattagaattacttcctaactggactccccccttactggtctctcacttgctggtgcacacttggcactgctactcaggagatctttctaacccacagccatctgatcatgtta

SEQ ID NO: 98146 - DNA, 279 bp, Homo sapiens
tcataattacttatttaaaatttgttgccatttaatttctgttcctcttagcttagtaactttaggatttttaaataacaactattgaaatcatgccctcgaggtgttacaacctattttggtaaaacgttaggactacaaaccttttaaattttttaaaaaatagatgagtgtggtggctcatgcctgtaatcccaacactttgggaagccgggtcgggaggatagcttgagtccagcagtttgagaccagtcagggcaacacagcaagaccccatat

SEQ ID NO: 98147 - DNA, 330 bp, Homo sapiens
gctctgttcctggtaagtgcccagtacaggtgtgccattttttatcttttataccatatttttactgtacctgttctatgtctaaatatgtttaggcacacaaatactcaccattgtcttacaatggcatttagcattcggcacagtaatgctgaggtgtgtagcctgggggcaataggctacaccatatagcctgggtgtgtagcaggccttacagcctgcatgtgtataactgtactcttggatgttcacacagtgacaaaattgcctgatgacgtgtttctcagaacacatctgtgttattaagtgatgcctgactgtaaaatctcc

SEQ ID NO: 98148 - DNA, 338 bp, Homo sapiens
atactataataaattgccatcaccatccccttcctcactgtggatcaaagccttggagtgcttgatgaaaatttattagacctctgcccactgattcccacctggctgctcacagcacccttggccagcattgccttgagctggctggagacggacactctgatgactaacagctgggtgtctcagacaagccgtctctacctccagcatccacgggctaactctgcttgctttcctacttctcttttcttatcttacacttaggtcttttggtcaattcatggcagaggctgccaaggatgtcaaaaacaagacgtgggggcaaaggggtgggtgtg

SEQ ID NO: 98149 - DNA, 937 bp, Homo sapiens
tgagaatgcgacggggcgacagcttcctgtcttttccagtggcttttggcatccccagaggaaaaaacggggagacccgctttggcctcaggaagcgcagaaacactgtcctggctgcgcgcgcaagggcgagaacctaggggacccgcctaaagcgccgttggggctgagcaccgaactcgcacagctccgggcagcgacccgcgatgcggcatccttccgtccggtcggagccctcctagccctcagcgcgtctattcctagcttcggtccccgcaaccatataagcaatgacaccctcgccgactcgcctgccagttggcctgcttcccctcactcctcgggccttgctcttcccccaggtgcccactgccctccctgctgtgtaccactttcttgctgcctgtgaaggtatttgtcctcactcttgtgctgctccttcaatgatagaactttgggactttctcatccagcagcaccagcctgaaaaagcagtggcttgcaccaccacacacatacctggtctcagatatcagctccatgagaacaggcaccttgtttaccttgtccatggatacagaacagtgcctagtgctcactaaatgaacagtgagtgaataagtgagtgtcgacgtcggctaaggtgaaccttcagatgagcttgctaatgcagatttgtggacgatgtagagcaaagcgaggacgtctgaacgaattccgagtagtttggaagatgggtgccagaaggatggccggaaagcatgtcaggggcgatgtgcggcgcaaaggtatccaacgcaagagtacaggagtaggcacgactggggcaagtggcagaggagcctgaggcagaactggcgaagcccgcaaacggtgaggactccggaaccaaacaaccggattgggccaaggggtgaaaacacaaggcggcgccacg

SEQ ID NO: 98150 - DNA, 385 bp, Homo sapiens
tgagaatgcgacggggcgacagcttcctgtcttttccagtggcttttggcatccccagaggaaaaaacggggagacccgctttggcctcaggaagcgcagaaacactgtcctggctgcgcgcgcaagggcgagaacctaggggacccgcctaaagcgccgttggggctgagcaccgaactcgcacagctccgggcagcgacccgcgatgcggcatccttccgtccggtcggagccctcctagccctcagcgcgtctattcctagcttcggtccccgcaaccatataagcaatgacaccctcgccgactcgcctgccagcttggccgcctccctgcagagggctgacgcttctccagaagttgtaagaaaaggagggaaagcaggc

SEQ ID NO: 98151 - DNA, 342 bp, Homo sapiens
gagagagccattaagattcttttatcctgctgcctgcctgagtattctgggaatcctacaaggatttgagggagcccttgggattccaacctaacaaattagttttctgtaatattgttctagtccatttagattgtgtaaatgatctaaatggtgtaaccatttaatatcaaaagtataacagcatttaagtcagcttttcgaagaaacttttattttttaactaaaaacaaactttttttcagagacaaggtctcactatgttgcccaggctggacatgaactcctgggcttaagacatcctcctaccctagcctcctgagtagctgggactgtgggcac

SEQ ID NO: 98152 - DNA, 723 bp, Homo sapiens
ctcgggacgaagttctcggacagagaacaagtgcgctcctgtcgtacgaagtacgtgaagctgcagaggccaaaaaacacgccgagcccttggggatgcggtttgattttaaagttgctgccgtgtcgccccgacttcgcagtttagcagtgcccagtaagatagaagaggacctgccttgcagccagctagactgtcagtttttattggagacattgtcatgacggccatcagaagggttgctattcgtccaaagtgaaaactaagcacagttctcaaaatgcgcggaatagggaagatgaattcaatattaagttatgtatttacaaacatatttaagcccattttgcagcggccaaaatacgggagcaaggcaccaacagcaccattaaggcagtgtaggtggacttaatggtggtgttgtattattcttgtttctcaaatcataggagatgacatttgttcctgtgacattctcaaactaaatgtaaagtggttggagcgaggtgagtgacttgggagttcatctgtgtgagattttggcttaacacatgttctgccaaaatgggcaggtcgtctcagatgagggagggaacttcagattagcacccacagaaaggaggctttcacccagcttcttgcatggatttagttaccactttgttttcatgtggtctggactgtaaggagggcaggaggcttagcagtgctatagtgtagaat

SEQ ID NO: 98153 - DNA, 153 bp, Homo sapiens
tatggtggggttacgtccagataaacctgttgtaaattaatgatctcataagtcagaagttcatttgatacttcatttgatatcataggatacttctctttgaaaactgaagagcattccgagtgtgtaccactttggcgcaattataaagtc

SEQ ID NO: 98154 - DNA, 815 bp, Homo sapiens
cagaaccaccgggttggttgccgtctgagctgtgcctcctcgtcaccgccaccgctatgcctggaggtcggcttcttggggacgtggctcccaactttgaggccaataccaccgccggccgcgtccgtttccaggactttctgggaaactcactgggcattctcttctcccaccctcgggactttaccccagtgtgcaccacagagcttggcagagctgcaaaactggcaccggaatttgccaagaggaatgttaagttgattgccctttcttttttctttctttttctttttctttttttgagacggagtcttgctctgtcgcccaggctggagtgcagtggtgcactcttggctcactgcaatctcggctcactgcaatctctgcatcctgggtttaagcaattctcctgcctcagactcctgagtagctaggactacaggtgtgcgacaccacgcccagctaatttttgtatctttagtagagatggggtttcaccatgttggtcaggctggttttgaactcctgacctcgtgatctgcccacctcagcctcccaaagtgctgggattacaggtgtgagccaccacacctagcggattaccctttcgatagaccgtgttgaggaccgtcttgcctggagcaaggatatcaatgcttacaatggtgaagaatccacagaaaagttaccttttcgcatcatccatgataagaatcgggaccttttcatcctgttgggcatgctggatccagcggagaaggatgaaaaggacatgcctgtgacagctcgtgtggtgtttgttattggtcctgata

SEQ ID NO: 98155 - DNA, 230 bp, Homo sapiens
tttttcttttgcaaggttattaattattgattcaaatatttcaatggatgtaggcctagtcagattacgtatttcttcttttatgagtttttgaaggttgtgcttttcaagtaattggcctttttcatttaaattatcaaatttgagagcatcaatttattcacatatttctttattatttgtttaatgttcatggaatctatggtgatgttccttctttaattttgaca

SEQ ID NO: 98156 - DNA, 424 bp, Homo sapiens
tggagaagttaagctttgaggcccagggagccaagacaaagtccaattccagagtctatgccttggctacagtgcattctatcctgcctacctttcctcttccctccttgcaccccaggtcccctcagatgctgctggagaattccagaggcctgctgggctgcaccagcgtcagcatgtgggttgggtttccatagcccagtgggacccccaggcctctcagcctctcaggttccatggccaggccaagagagggggcctgggggtccctgcagacccagagctccccctgtgtccctgggacagactggctggtggagaaagttccccctcttctcaagtgcctgagtttcctgcacttcagggaaaggactctatcccaaagatgtcctttcagagcacagaagagattgccctagacctg

SEQ ID NO: 98157 - DNA, 439 bp, Homo sapiens
gtctagaggatccgtgtcatcccccttcgtctctatgaatttgacatctctaggtaactcacataagtgggatcagagagtatttgtctttttgtgtctggctgacttcacctagaatagcgtccacctagcaggacatccatgtagcacgtgtcagaatctccttccttctgaagatggaagaatatttcatggcaaggccaccttttaaagtggggctctagggctgggttgacggggttcttggccagaatatgcagtgaggaaggagtccagaagcctgtgccacccacttgctggtgaccctaaaaaaaacgctcaactctgagctaatatcacctgccctgcctttctcagagtcagggtgaggctctgatgaggtcccaggcagctgctgcaaggaatgggaggggacagtattgctgaccccggttgaccc

SEQ ID NO: 98158 - DNA, 289 bp, Homo sapiens
  misc_feature (9)..(9): n is a, c, g, or t
  misc_feature (18)..(18): n is a, c, g, or t
cccaatgtntgggctggnattggccccaggttttccccctagggttttcatagtgtggggttttatttatttatttatttatttatttatttatttattttatttttttgagacacagtctcactctgcactctagcctgggcaacagagcaagaccctgtctcataaaaaaataaaaaagaaagaaagcagctagatctgcccaggtagggacaagaaacttttccagttaagattatatttgatctgggtcttgatagaaagataagtttaggagtttactaagctg

SEQ ID NO: 98159 - DNA, 160 bp, Homo sapiens
gacagtccagccaattatggaagcacttagagatgcaacaaggagacgcacctttgccctggtctctcaagcatatacttcaatcatcactgatgattttgcagcctttgttggacttcctatagaagaggctgtgaaaggcttattagaacaaggatgg

SEQ ID NO: 98160 - DNA, 767 bp, Homo sapiens
aatccttgagtacagcataatcctgctgctaatggacatcatctaggctcacaaaacagcaatttatatgtgttttaaagtttgtgattttcttatatttttgctacaatagataaaactttttttcctgaactatattctggaaaaatagcatatttttggccagtagataaggttatatactcaattcactacatggcttactaactaaacacactatattctggaaaaatagcatatttttggccagtagataaggttatatactcaattcactacatggcttactaactaaacacacttctatgaatctgatattaaagcctgaggtggcattataaaaataacccctaatattctcagctgtttcccacacagtgtcaatctatccaacatattaggccactgacaattccttcacagttgtttaatatgcatgacatttttatgatagaaaagatttttcaagtttaagaggtgtattctctgtatgtgtacatttgtgcattcctacatagaacttatgtaatacagcagactagataacctgaaaaacctctcactacaaaaccagttacactgtgcagaatatgaaacagcatgcaaagaagagctttgaaaaaaagtaaaggaaatcccagtgcttaataaaaagagactaaaaggcataaaaccagaaaattaaacatattgtaatggtaatacaagaactggagacaaagcctgatcttgcaggagccaggtgttggaactgagaccttacataa

SEQ ID NO: 98161 - DNA, 104 bp, Homo sapiens
agacacaacagacacagcatggtcagtgctgtgggagaagaggccccagcaggggatggagcttctcagtcttggacgagaacctgggcacagctgtatgcacg

SEQ ID NO: 98162 - DNA, 857 bp, Homo sapiens
agcggatatcatttcctttccctttcagtttataccttgtgatccctccagcccattcatactcttgccactaccccagtccttttgtttactagtcttgcaaaggctaagctcacaataagtcaaaccattttactcttcactctcaatccaggatgctgacttaagatacaagaaagaaggggggctgttgatgggtgcaaggaaacatgggttgagagagtaacaagtgggctgagggtccaattgtgattggaaatgtaaatgtgtcaagacaccaactcacatggttgtgtgatttcctccagtgacccagggtaggagtacagtgaccaaatggttggatttagggccttgcagtagaggtgaatggaatgataagacaacgaaggaactgagatagacggaagcaaagggccatagtagtatctaaattgaagaggaaagggagtaaaagcataacttctgttgggcctagtatgtacactgtatccatctactttctttttctttatttggggtatatgagaacctggcacagtgttaataagacccaagtgttcagaagagaatgcaagccaggctaatgaaggtggcaggaatagcaccatctctcctggaccattcaccacacacaaatgtgactgcggtgacatggagatctaaaatgatctaatgcagccagttggtaagggctcaaggctagatttcatctttcagggtaatgagatgtagcatcagtaattgagagtgcaggcttgaaggcagggggctacaatccaagaacaccaggggattcctgaaacctcagatagtactgaacactatatatactaggttttttcctatacatacat

SEQ ID NO: 98163 - DNA, 382 bp, Homo sapiens
tagcagagtgtcctccctgaaaggagactatccagaatgaagtctacctgagcctcctggcagcccaggctccatagccctgctccctcctctgcacaagcctgatctgatttctgagggcgatacctctatgccaaagcagttcaggcttctacatctcttgcctgggttacaacagtttcctcactattcgccctgtctctgttctagtttctttcaaactcatcctctaccaagcagtgagtacaatttttctaaaattcaaatctgggccaggcacagtggctcatgcctgtggtctcagctatttgggaggctgagcctgggaggtggaagctgcagtgagccatgatcttgccactgaagtccagcctgggtgaca

SEQ ID NO: 98164 - DNA, 554 bp, Homo sapiens
tgtgatgtaattattttgtaaatgtggaggggacgacaactggggaaaaggtgtgggcatgatttgttagattctcatctgccataaatgaaagtcaatgcataatgtctcaaattgataagccatgaaatatccataacgcttactgtttagaaacacgaaagtagatcccagaagaaaacaattaaaaacaataaaaaaaaagtttgcttctggggagtagatctcaaaggtggtagggaattttttttttcattataagcactgtagcaccaacttacatttaaattcatgcatactattttaatagaaaaaaatgtcaaggacaattgggaaggtaagaagtagccatcgtgaatctaaacagctttctcaagaattttgacaatacaggaaaagaaataatatctgatacatatgtagccttaacattagctaggtaccattctgaacgctttaggtatattaactgtttaatcctcgtctcaaacctatgaagtaggtactgttactggccccattttacagatgaggaaacagttctcacagctagt

SEQ ID NO: 98165 - DNA, 234 bp, Homo sapiens
caaaaatctccataaaccacttacttaaaatgccattatgtccctattcatagtaggctctcaacaaatatttgtacaacgtaataatgactggtgaaataaaggaagcatgtgtgaaccagtatatatttttaaaaaattgtagtaaaattctgggatatattttcctcataaacgatttattcttaagttttatatattaaagatccaaaattcagaatgtgaagggggcta

SEQ ID NO: 98166 - DNA, 285 bp, Homo sapiens
agcaacgagcctagctgtgtaggctcggcagcggccccaggtgtcagaagcagacaagcactaaatcaagctactggtagctgatcccactgcagaggcctaacccccagaggcagagtaagaaggatgctgaagatgagcaggctgtggtggcacggcagtccacagtgtcatcaggaataggcaccttctctctctatctgccacccttagcaagtgactccgtcttggcgtgcaccagacggcacctctgcagtggtgttccaggtctgagccagggaagga

SEQ ID NO: 98167 - DNA, 498 bp, Homo sapiens
aaaatgaaataaaatgtaaaattattggccaagtgcggtggctcacacccgtaatcccagcattttgggaggccgaggtgggtggatcaattgaggcccggagtttgagaccagccctggcccaacatggtgaaacctcgtctctacaaaaagatacaaaaagtagcccaggtatcatggcacatacatgcagtcccagctactgaggaggctgaggtaggagaatcgcttgaatccaggaggcggaggtttcagtaagctgaaatcatgccactgcactccagcctgggcgatagagtgagactccatcttaaaagaaaaataaataaataaaattatttatatattctatagcatataataatggtaaattagtgttagctattactaacttcagtcctctggcacatagaagtgcccagcctattttgttgaatgagtgaatgaatgatggtgaatatacctctaagcaatctgagccttagactacatgaccat

SEQ ID NO: 98168 - DNA, 138 bp, Homo sapiens
ggcagggctctcaagccaaataactctacacacacatacacacacacacacacaaacgctgctttttagtttataaaatattttatggaaattgtctgattcaaattgtctaaatcatgttcctgaactaatattcca

SEQ ID NO: 98169 - DNA, 249 bp, Homo sapiens
tcggacagtggtgtgccagtaaatgtttaacaaccagctctctggaaagaagagctctgacttacagcctttgccaattgccgtggtttaaatactcctatcatggttgagttcaagctaccaacatgacatcaccgaatacagaggagaagaggtgcgtaatcaacagcacaagcatcatgtagtatttacacacagggacaataaagtatagataatagtaaaatgaaataaaatcattagaaaatg

SEQ ID NO: 98170 - DNA, 731 bp, Homo sapiens
ttgttgatgaattttttaataaacttttgattcactatttagaatacatttatttctaccagacctcagtgggaaattaacccaatatatcattttaatgaatttatgactataatcgtatatatgctctttacgaactataaattcaatatatataatgcaatataaatgtaatatgaaaattcaattttcagtataagtttatttggtttgtgcaataactactaaattctagagatatcacagaataaactgttccactaggcattttatttttcttatctttcagtcactggagtttaaatgagtagcaagtaaattgcaaataattatttttcaatagcttttgggtacaagtgtttttggttacgtgaatgaatcatatagtgctgaagtctgacattttttagcatttaaaacattaaatttacctgattaacataaagatttggcattaaacaaagacccttataaataatcccactattttattagcagtacataaaaatgtgcatcaagacatcttgatgtcaggtgcagtggctcaagtctgtaatcccagcactttgggaggccgaggcgggcagatcacaagttcgagaccagcctggccaacatggtgaaaccccatctctacagaaaatacaaaaattagctgtgtgtggtggtgggcacctgtaatcccagctacttgggaggctgaggcaggagaatcgcttgaacccagaagg

SEQ ID NO: 98171 - DNA, 232 bp, Homo sapiens
gcatagctcaacactgatcaaggatggtggtcttcagcccttattatggttccatcagcctttgaccgttttttccttggctcttcaattacatatgggactcgaggtctaaactgaccctcatctcattttcccaaagtcaaagttgctgcaagatcttgctaataaaacattggctaagcaatgtgctatcacgcagtgtcatctttttatttaacacaacttggctttt

SEQ ID NO: 98172 - DNA, 437 bp, Homo sapiens
aaaggcagctcagagtcttattgcccaaggtcacgtcacacagcctgcaatttttgattttcttattttttagttttgggggtgcataggtgtatatatttatggggtacctgagatgttttgatataggcatgcaatgcataacaatcacatcatgaaaaatggggtatctatccccttaaacatttctcctttgttacaaattatacacttttatttttaaatgtacgattaaattattattgactatagtcgccctgttgtgctgtcaaatagtgggtcttattcattatatttttttgtatccattaaccatccccatccccaccccagtacccttcccagtctctggtaaatcttctactctatctatctccatgagtccaattgttttgttagttcccacaaataagcgagaacatgcgaagtttgtcttt

SEQ ID NO: 98173 - DNA, 460 bp, Homo sapiens
agtgttctcttttctctgcagccttgctggcatctgttggtttttgactttttgttagttgccattctgactgatgcgagatggtatctcattgtggttttgatttgcatttctctgatgattagtgatgttgagcattttttcatgtttgttggccacttgtccatcttcttttgagaagtgtctgttcatgtcttttgcccattttttttttgaaacagggtctcactctgtcacccagggtggagtgtagtggcacaatcttggctcactgtagccttgacctcctgggctgaagcagtccttctatctcagcctcctgagtgagtagctaggactaaaggtgcacaccaccatactcagctaattttgtttatagtttgtagagatgaagtctcattatattgccctggccggtctcaaactctgggctccagctctcttcctgcgtcggccttcc

SEQ ID NO: 98174 - DNA, 541 bp, Homo sapiens
cgtctcgctgaggtcgatcctttacggcaggcgtccgcgtcgctagctagtcgttctgaagcggcggccagagaagagtcaagggcacgagcatcgggccatgcctttcttggacatccagaaaaggttcggccttaacatagatcgatggttgacaatccagagtggtgaacagccctacaagatggctggtcgatgccatgcttttgaaaaagaatggatagaatgtgcacatggaatcggttatactcgggcagagaaagagtgcaagatagaatatgatgatttcgtagagtgtttgcttcggcagaaaacgatgagacgtgcaggtaccatcaggaagcagcgggataagctgataaaggaaggaaagtacacccctccacctcaccacattggcaagggggagcctcggccctgaacagagcagctgctgatgtctggaggctgattttcctgttctctgttctccactggaaaggttgtttacgacaaacctccttgtcaaagtgtgtaaaaataaaggattgctccatcctaa

SEQ ID NO: 98175 - DNA, 525 bp, Homo sapiens
aacttaggcagtgcgaggctgggtgaatcggccgaggcttgggagcggcggccagagaagagtcaagggcacgagcatcgggccatgcctttcttggacatccagaaaaggttcggccttaacatagatcgatggttgacaatccagagtggtgaacagccctacaagatggctggtcgatgccatgcttttgaaaaagaatggatagaatgtgcacatggaatcggttatactcgggcagagaaagagtgcaagatagaatatgatgatttcgtagagtgtttgcttcggcagaaaacgatgagacgtgcaggtaccatcaggaagcagcgggataagctgataaaggaaggaaagtacacccctccacctcaccacattggcaagggggagcctcggccctgaacagagcagctgctgatgtctggaggctgattttcctgttctctgttctccactggaaaggttgtttacgacaaacctccttgtcaaagtgtgtaaaaataaaggattgctccatcctaa

SEQ ID NO: 98176 - DNA, 497 bp, Homo sapiens
gcgcttctgccagcggcggacctataacctgtcagggcgcgagcatggggtaggccatgcctttcttggacatccagaaaaggttcggccttaacatagatcgatggttgacaatccagagtggtgaacagccctacaagatggctggtcgatgccatgcttttgaaaaagaatggatagaatgtgcacatggaatcggttatactcgggcagagaaagagtgcaagatagaatatgatgatttcgtagagtgtttgcttcggcagaaaacgatgagacgtgcaggtaccatcaggaagcagcgggataagctgataaaggaaggaaagtacacccctccacctcaccacattggcaagggggagcctcggccctgaacagagcagctgctgatgtctggaggctgattttcctgttctctgttctccactggaaaggttgtttacgacaaacctccttgtcaaagtgtgtaaaaataaaggattgctccatcctaa

SEQ ID NO: 98177 - DNA, 839 bp, Homo sapiens
  misc_feature (647)..(647): n is a, c, g, or t
  misc_feature (650)..(650): n is a, c, g, or t
  misc_feature (692)..(692): n is a, c, g, or t
  misc_feature (697)..(697): n is a, c, g, or t
  misc_feature (706)..(706): n is a, c, g, or t
  misc_feature (709)..(709): n is a, c, g, or t
  misc_feature (712)..(712): n is a, c, g, or t
  misc_feature (716)..(716): n is a, c, g, or t
  misc_feature (719)..(719): n is a, c, g, or t
cgtctcgctgaggtcgatcctttacggcaggcgtccgcgtcgctagctagtcgttctgaagcggcggccagagaagagtcaagggcacgagcatcgggccatgcctttcttggacatccagaaaaggttcggccttaacatagatcgatggttgacaatccagagtggtgaacagccctacaagatggctggtcgatgccatgcttttgaaaaagaatggatagaatgtgcacatggaatcggttatactcgggcagagaaagagtgcaagatagaatatgatgatttcgtagagtgtttgcttcggcagaaaacgatgagacgtgcaggtaccatcaggaagcagcgggataagctgataaaggaaggaaagtacacccctccacctcaccacattggcaagggggagcctcggccctgaacagagcagctgctgatgtctggaggctgattttcctgttctctgttctccactggaaaggttgtttacgacaaacctccttgtcaaagtgtgtaaaaataaaggattgctccatcctaaaaaaaaaaaaaaaaaaaaaaaacaaaagaaacacccggggggccatcaatgcgcgggggcggggaaaaaaggggatggaaagggcacagggccaaaaggggttccnggnacccaggttttctgggtcacaaggggggaaaactcggcgggnccccnaaaaggggngcnganaaantcnagacgcgggtacctgtagatgcgcacgacaaacagcgccaccacacaaaagaggaactggagcaacagaacattacacctaaacagtaatcagctaaacgacacactaacccggttcaca

SEQ ID NO: 98178 - DNA, 710 bp, Homo sapiens
  misc_feature (4)..(6): n is a, c, g, or t
  misc_feature (11)..(11): n is a, c, g, or t
  misc_feature (30)..(30): n is a, c, g, or t
  misc_feature (38)..(38): n is a, c, g, or t
  misc_feature (50)..(50): n is a, c, g, or t
  misc_feature (537)..(537): n is a, c, g, or t
  misc_feature (539)..(540): n is a, c, g, or t
  misc_feature (547)..(547): n is a, c, g, or t
  misc_feature (558)..(559): n is a, c, g, or t
  misc_feature (572)..(572): n is a, c, g, or t
  misc_feature (574)..(574): n is a, c, g, or t
aggnnntttgnagcccccttcctgtttganttaccgtntcagaagagtcnagggcacgagcatcgggccatgcctttcttggacatccagaaaaggttcggccttaacatagatcgatggttgacaatccagagtggtgaacagccctacaagatggctggtcgatgccatgcttttgaaaaagaatggatagaatgtgcacatggaatcggttatactcgggcagagaaagagtgcaagatagaatatgatgatttcgtagagtgtttgcttcggcagaaaacgatgagacgtgcaggtaccatcaggaagcagcgggataagctgataaaggaaggaaagtacacccctccacctcaccacattggcaagggggagcctcggccctgaacagagcagctgctgatgtctggaggctgattttcctgttctctgttctccactggaaaggttgtttacgacaaacctccttgtcaaagtgtgtaaaaataaaggattgctccatcctaaaaaaaaaaaaaaaaaaaaccccggggncnnctaaggncgggggcgcgnnaaaaagaggaaangnaagggcgcccggggccaaacgggtcccgtgacccagtttcctggggccaaagggggacactcgccggcccccataagggaggcggaataaatccagaaacccgggtaccggttagcctccgaaaaccccaccaaca

SEQ ID NO: 98179 - DNA, 611 bp, Homo sapiens
cgtctcgctgaggtcgatcctttacggcaggcgtccgcgtcgctagctagtcgttctgaagcggcggccagagaagagtcaagggcacgagcatcgggccatgcctttcttggacatccagaaaaggttcggccttaacatagatcgatggttgacaatccagagtggtgaacagccctacaagatggctggtcgatgccatgcttttgaaaaagaatggatagaaaaaaaaaaaaaaaaaaaaaaaaaaaaaactgtgtgggggcgcgcgctggggcgccccggaaaaacgtttctaaagaaccatatcgcggggggcgcgcgcgggggccccaagaaggagaagggcgacactggggccaaaagggggtacctaagaggagaaaccgcgggcaacgagtgaacaagaggcgcggggatttcctccaaccaattaaaaaagaggccgcgggggggacaaacgcagagaggcgttcgcggaacaccaaatctccgcaagagagggaggctcgggggaggacaacatgagaggggacattctctccacagagggagcgtcccaggggagagactgcagaatttcaaatataaggcccggcgtgggggggcaa

SEQ ID NO: 98180 - DNA, 395 bp, Homo sapiens
gaggatccccagggagtgctcgtctttggcagaaaacgatgagacgtgcaggtaccatcaggaagcagcgggataagctgataaaggaaggaaagtacacccctccacctcaccacattggcaagggggagcctcggccctgaacagagcagctgctgatgtctggaggctgattttcctgttctctgttctccactggaaaggttgtttacgacaaacctccttgtcaaagtgtgtaaaaataaaggattgctccatcctaagctggagtgcgacggcatgatctcagcttaccgcaacctccgcctcccgggttgaagcgattctcctgcctcagctgctgagtagctgggattacaggtgtggcatctggcatgaaaccaaaagacgagcac

SEQ ID NO: 98181 - DNA, 743 bp, Homo sapiens
  misc_feature (628)..(630): n is a, c, g, or t
  misc_feature (632)..(632): n is a, c, g, or t
  misc_feature (637)..(637): n is a, c, g, or t
  misc_feature (647)..(648): n is a, c, g, or t
  misc_feature (654)..(655): n is a, c, g, or t
  misc_feature (664)..(666): n is a, c, g, or t
  misc_feature (674)..(674): n is a, c, g, or t
  misc_feature (694)..(694): n is a, c, g, or t
cgtctcgctgaggtcgatcctttacggcaggcgtccgcgtcgctagctagtcgttctgaagcggcggccagagaagagtcaagggcacgagcatcgggccatgcctttcttggacatccagaaaaggttcggccttaacatagatcgatggttgacaatccagagtggtgaacagccctacaagatggctggtcgatgccatgcttttgaaaaagaatggatagaatgtgcacatggaatcggttatactcgggcagagaaagagtgcaagatagaatatgatgatttcgtagagtgtttgcttcggcagaaaacgatgagacgtgcaggtaccatcaggaagcagcgggataagctgataaaggaaggaaagtacacccctccacctcaccacattggcaagggggagcctcggccctgaacagagcagctgctgatgtctggaggctgattttcctgttctctgttctccactggaaaggttgtttacgacaaacctccttgtcaaagtgtgtaaaaataaaggattgctccatcctaaaaaaaaaaaaaaaaaaaaaaaaaaaaaaaaaaaaaaaaaacccggggggcaattttgggggggggggaaaaaggggtttggaagggnnntnggtcnaaggtgttcnnggcccnntttttttgnnnaagggggnaaaattgggggggccccaanaggggggggaaaaaattggaaagcggggtaccgtgttttatttggataa

SEQ ID NO: 98182 - DNA, 752 bp, Homo sapiens
cgtctcgctgaggtcgatcctttacggcaggcgtccgcgtcgctagctagtcgttctgaagcggcggccagagaagagtcaagggcacgagcatcgggccatgcctttcttggacatccagaaaaggttcggccttaacatagatcgatggttgacaatccagagtggtgaacagccctacaagatggctggtcgatgccatgcttttgaaaaagaatggatagaatgtgcacatggaatcggttatactcgggcagagaaagagtgcaagatagaatatgatgatttcgtagagtgtttgcttcggcagaaaacgatgagacgtgcaggtaccatcaggaagcagcgggataagctgataaaggaaggaaagtacacccctccacctcaccacattggcaagggggagcctcggccctgaacagagcagctgctgatgtctggaggctgattttcctgttctctgttctccactggaaaggttgtttacgacaaacctccttgtcaaagtgtgtaaaaataaaggattgctccatcctaaaaaaaaaaaaaaaaaaaaaaaaaaaaaaaaaaaaaaaaaacccggggggcaattttgggggggggggaaaaagggggtaaaaaggggccagggggcaaaggaggcaaaccggaacccaacatcgggggacacaagggggcaaaaatgcccggagaccccatagaagggagacgcgcaataaacccggaaaacccgggtaagccgcacgaaa

SEQ ID NO: 98183 - DNA, 510 bp, Homo sapiens
  misc_feature (4)..(6): n is a, c, g, or t
  misc_feature (11)..(11): n is a, c, g, or t
  misc_feature (30)..(30): n is a, c, g, or t
  misc_feature (38)..(38): n is a, c, g, or t
  misc_feature (50)..(50): n is a, c, g, or t
aggnnntttgnagcccccttcctgtttganttaccgtntcagaagagtcnagggcacgagcatcgggccatgcctttcttggacatccagaaaaggttcggccttaacatagatcgatggttgacaatccagagtggtgaacagccctacaagatggctggtcgatgccatgcttttgaaaaagaatggatagaatgtgcacatggaatcggttatactcgggcagagaaagagtgcaagatagaatatgatgatttcgtagagtgtttgcttcggcagaaaacgatgagacgtgcaggtaccatcaggaagcagcgggataagctgataaaggaaggaaagtacacccctccacctcaccacattggcaagggggagcctcggccctgaacagagcagctgctgatgtctggaggctgattttcctgttctctgttctccactggaaaggttgtttacgacaaacctccttgtcaaagtgtgtaaaaataaaggattgctccatcctaa

SEQ ID NO: 98184 - DNA, 727 bp, Homo sapiens
  misc_feature (612)..(614): n is a, c, g, or t
  misc_feature (616)..(616): n is a, c, g, or t
  misc_feature (621)..(621): n is a, c, g, or t
  misc_feature (631)..(632): n is a, c, g, or t
  misc_feature (638)..(639): n is a, c, g, or t
  misc_feature (648)..(650): n is a, c, g, or t
  misc_feature (658)..(658): n is a, c, g, or t
  misc_feature (678)..(678): n is a, c, g, or t
aacttaggcagtgcgaggctgggtgaatcggccgaggcttgggagcggcggccagagaagagtcaagggcacgagcatcgggccatgcctttcttggacatccagaaaaggttcggccttaacatagatcgatggttgacaatccagagtggtgaacagccctacaagatggctggtcgatgccatgcttttgaaaaagaatggatagaatgtgcacatggaatcggttatactcgggcagagaaagagtgcaagatagaatatgatgatttcgtagagtgtttgcttcggcagaaaacgatgagacgtgcaggtaccatcaggaagcagcgggataagctgataaaggaaggaaagtacacccctccacctcaccacattggcaagggggagcctcggccctgaacagagcagctgctgatgtctggaggctgattttcctgttctctgttctccactggaaaggttgtttacgacaaacctccttgtcaaagtgtgtaaaaataaaggattgctccatcctaaaaaaaaaaaaaaaaaaaaaaaaaaaaaaaaaaaaaaaaaacccggggggcaattttgggggggggggaaaaaggggtttggaagggnnntnggtcnaaggtgttcnnggcccnntttttttgnnnaagggggnaaaattgggggggccccaanaggggggggaaaaaattggaaagcggggtaccgtgttttatttggataa

SEQ ID NO: 98185 - DNA, 582 bp, Homo sapiens
cgtctcgctgaggtcgatcctttacggcaggcgtccgcgtcgctagctagtcgttctgaagcggcggccagagaagagtcaagggcacgagcatcgggccatgcctttcttggacatccagaaaaggttcggccttaacatagatcgatggttgacaatccagagtggtgaacagccctacaagatggctggtcgatgccatgcttttgaaaaagaatggatagaatgtgcacatggaatcggttatactcgggcagagaaagagtgcaagatagaatatgatgatttcgtagagtgtttgcttcggcagaaaacgatgagacgtgcaggtaccatcaggaagcagcgggataagctgataaaggaaggaaagtacacccctccacctcaccacattggcaagggggagcctcggccctgaacagagcagctgctgatgtctggaggctgattttcctgttctctgttctccactggaaaggttgtttacgacaaacctccttgtcaaagtgtgtaaaaataaaggattgctccatcctaacctaaatcgtcgagtgtttatagttgtttctttttgttctt

SEQ ID NO: 98186 - DNA, 486 bp, Homo sapiens
caggtggggccgggcacggtggctcacgcctgtaatcccagcactttgggaggctgaggcaggcggatcacctgaggtcaggagttcgagaccagcctgagcaacatggagaaaccccatctctactaaaaatacaaaattagcctggcgtggtggcgcatgcctgtaatcccagctactcaggagggtgctactctgcactttccagagtgcaagatagaatatgatgatttcgtagagtgtttgcttcggcagaaaacgatgagacgtgcaggtaccatcaggaagcagcgggataagctgataaaggaaggaaagtacacccctccacctcaccacattggcaagggggagcctcggccctgaacagagcagctgctgatgtctggaggctgattttcctgttctctgttctccactggaaaggttgtttacgacaaacctccttgtcaaagtgtgtaaaaataaaggattgctccatcctaa

SEQ ID NO: 98187 - DNA, 896 bp, Homo sapiens
gataggcacaggacagaataagttcatcttcagatactaaatataattgtacagattacagaattgtggcaaaggttaagtgctcaacctcagcaagttctcttgctaagattaggacactgattgggaaggagtaggaccatagacttgtgataggaacatttggacagacacagacaaagccgaattcccaaatctcaaggctcccttgtatacagaagcagccccgcctcccctgtgcaaggaaattagccttcacatacactaagagctttcaagacttcactggggcctctgcctcccacatggatgcctgttctcctccaaacttgcccctgatgcacctcattgactccaggagcataacaagaataaactctctacagagcccagaaggagaaatgcaaggtcagccagagaagaggaggatggaaatagattatataccacgaaagctggaaaatcttgccaatatgtgttgcagagaagctgagaactgtgtatgggaatggattctaaagtgttagactaaggaggatgaaatactaggttaggccaggcatggtggctcacacctatattcccagcactttggaaggcagagacaggaggatagcttgaggccaggagttcaggaccagcctcggcaacgcggtgagacaccgtctctacaaaaaatgtaaaaattagccacgtgtggtggtgcacgcgtgcctctggtcccagctgctcaaaggctgaggtgggaggatcatttgaacctaggaggtcaaggctgcagagacctataatggcaccattgcacttcagcctggtgacagagcaagaccctgtctcgaataaaatataaagtaagattcagcaaaatttatgaatatgcatacattcccctggga

SEQ ID NO: 98188 - DNA, 486 bp, Homo sapiens
acacacccaatgggattctcggaggtaacaaaattagatgagggtatttaatccatcattttaatctggagcccctagggatgaattatttagatgcaggatacctaataattagtttaactcatattgttttagctgaattggatgttgaaggcattccaatactaaatgaggagttgggttacggagtggacattgggacattgttttttagctactcaaactcattccttcttcctactagacctccatttacttgggggccttaactcctgtcccatgtgcatattcttaggaaggtactccctacccacatcaaaactaaggggaccagaattgcactctccctgctccaataaacatagggtagacatcccttccagtcaaccccctccctgactaaaaacaatattctgatttctgtttgattcattgattgagatgggatcttgctatgttatataggcaggtcttgaactcctggcc

SEQ ID NO: 98189 - DNA, 215 bp, Homo sapiens
ttacaatagggttcacgctcctatgagaatctaatgcttgcgactgatctgacaggaggcggagctcagtctggaatggttgctcacctccagctgtgcagcccagtacctaacaggccatggactgctactggtctgttgcctgggggttggggatccctggtataaagaggagaaggggccaggctaggtggctcatgcttgtaatctcagca

SEQ ID NO: 98190 - DNA, 219 bp, Homo sapiens
ttaaaacaaaactgaaaagtctcacagataaatccaaggcacataattatgttatgactgttgtgctgagtggtaatttagtatggatatcaggtagtttacttaaaagattgtaattatccttattacactgcaagtcaaagattttaaaatttacattctttcgtatcagcagatacataccagttcagccatcattagtttgtcaaaagctagtgc

SEQ ID NO: 98191 - DNA, 239 bp, Homo sapiens
agcacttagaacaacagcaacaaaagtctccataatgtgtatattgacacgtgttgaaatgatactattgtagatatagtggtttaaaatagtaaaattaattttacctatttgtttctttaactttaaaaaaatgtggttagtagaaagtttaaagttacatatgtgcttcatattatgtttctgttggacagtgcagccctagagtttctgagaaggtaactttgactagttattta

SEQ ID NO: 98192 - DNA, 505 bp, Homo sapiens
tcaccactgatgcagtgggagaccctcgggcctgacccctttctatgccaggcattgtctttgctgcttctgagcgaccagctgagtggaacacagaagggctggtcaaaggctgcagggcagggagcgctgagctgagaccaggactcaagctcactttgtctcggggcgacatttgctgggtgagggctcttggcagcccctctctttcacatgtgagttgccagatgatgagtgaacacaactgccacacgcatgtaaaaggttaattattgattacatagaaagagacccttagtaaatatctctacgttttggtttgcgcctctgtagaatggattctgtggttattttgtgttgatactctgccactggcatcagtaacacccaatcttttcttaaaggtggaatttaactttttgagttggtaaaatactacgtggttcataacgctttaaaaaagatttacaatgcgttcctttcttcatccacctcatctcccacc

SEQ ID NO: 98193 - DNA, 297 bp, Homo sapiens
gacaacgcccgaaaaacaagaggaaagaagtttcaggtctcactctgttgcccaggctggtctcaaactcctgacctcaagtgatccatctgcctcagcctcccaaaagtgctgggattacaggtgtgagccaccacacacaacctaaagcattctgtctgatctcttcaatgttgcaaaacatctctgtgaatatgattcttgtaattagtcaaaaggacgagtaatatagagctaagtaatgaatgccatgttttgggtgccaaatggagttcaatgattttaaaaagagggttt

SEQ ID NO: 98194 - DNA, 511 bp, Homo sapiens
ttgcactccactggttgcgtattactgtatatattgtggttcttgagtcaacttttcttccaaatctggaaaaaaataagcttggtttaagaattctgaagaagaaaacataggccaggcatggtgactcatgcctgtaaccccagtgaggcaggagaatagggtctggaggcagggaacctaaggcccacccaccctgactggatataagatataacccctcctttttctggtggcagctggaaaatgaaagtaactctgattggtcccccctacaaccaatcagactagtcgtggaccactagagtgaaccaatgggaaaccaatgggaaacctctagaaggcatataaaccccagaagaaccagtgttcctgagcctcttgcttcagccggctcccaccctgtggagcatactttcatttaaaataaatctctgctttcactgccttggttttttgtgcattttgtccaattctttgttcaaaacaccaaggagctagacaactaccc

SEQ ID NO: 98195 - DNA, 421 bp, Homo sapiens
gaaaattattgtatgaagaggtggtgagtgataaagcaggagtggtaagcagaggtcagatgatggagagtctttgcattgttttctatttactgctgtaacaaatgaccacaaattggtggcttcaaacaacatgaatttatcacctataggttagaagtccacctgagctaaaaccaaggcatctacagggctgcattcccttctagagaatctaagggagaattaatttcttgcctttgtcagctagcttctggatgctgcccacattccttggtccatggcccactttctccatgttcaaagccagcaacattgcatctgtctgagaattcttctgtagtcacatctccctctgactctcttctacctctgcttttctgctcttaaggatgtttgtgattatattggtctcacctgg

SEQ ID NO: 98196 - DNA, 675 bp, Homo sapiens
ctgcctttagccaccaggaggctcggttcctgattcccctcctggtccccctggtcctgctttgtagtccacagacgcagcctgtgccttggaagggcactgtggtcctcttcaacgccctcggtgccctcctcttcggctgcctgcatcaggggggcctggtgcctggcctggagtacctggagcaggtggtccatgcccctgtgctcccaagcacacccacccactacacactcctcttcactcacacctacatgcccccccggcacctcctacacctcccaggcctgggggcaccagtggaggtggtggacatgggggggactgaggactgggccctgtgccaaaccctgaaaagcttcaccagacaaccagcctgccaagtggctggtgggccatggctctgccgcctctttgtggtaacccctggcaccaccaggcgtgccgtggagaagtgcagcttccccttcaagaatgaaacacttttatttccccatctgaccctggaggatccaccagccctgtcctccttgctgagtggggcttggagggaccacctcagtcttcacattgtggagctgggggaagaaacctgacaatatgacagagcacccactgcccaagactcagccatagaagatgccgccccaccttctacttgggtagctgggctgg

SEQ ID NO: 98197 - DNA, 198 bp, Homo sapiens
tgtttaaaataagtaaatacatatatactaaactcatgattagactaagctggttttcattcatttataaaattttctgggaatgtaatagcaataaaccgatgctgatcaacccaaataaacacgtacactctatttctcttgtggtatgagagtaactatgctgaatttgagtcatggctgggcatggtggctcac

SEQ ID NO: 98198 - DNA, 409 bp, Homo sapiens
gttccctcaggtgaaaaatgaggactagcttggattattaatattttgcttgtacccattttcccctgaagaatgtctcattacataaatttgtagtattcacaactaagtttttgtcaacaacatattttgaaatcattcacggccgggtgcgatggctcacgcctataatcccagcactttgggaggctgaggctggtggatcacgaggtgaagagatcgagaccatcctggccaacattgtgaaaccccgtctctactaaaaatacaaaaattagctgggcatggtggtgcgtgcctatagtcccagctccttgggaggctgaggcaagagactcacttgaatccaggcggtggaggttgcagtgagctgagattgtgctactgcactccagcctggtgacagagc

SEQ ID NO: 98199 - DNA, 630 bp, Homo sapiens
gtgtttttttaagacagggtttcattctgtcacaaaggctagagtacaatggcacaatcatagctcactgcagcctcaaactcctggggttaagtgatcctcctacctcagcctccctagtagctgggactacagacaggtacatgccaccaaccctgggctaatttttgtattcttgtagagagagagagagagagacaggatctcactatgttgcccaggctggtcttgaacttggggctcaagtgattctcctgccttgacctcccaaagtgctgggattacaggcaagagccatcatgctcggcccaaaattctagtttttctctgaagctcacattttattgttattggaaagtactatcaattgtttaccttgaagtgacaggctcactttgttcattgttctagacagtgtctctgaatacccaactgtgaatagccatggattgtcagctgtgcttccaggcaaaattcatgtttcctgaaaggggagctagttcagctcacaaacaacagcacaaatgcttttctcaagatgactaacagactttcatctgcagcagaagggctttatgttcactttccatccattacaccaaatattaaaaaggtgtgtacttaaggatc

SEQ ID NO: 98200 - DNA, 673 bp, Homo sapiens
attttagtcaaggcccccaggtatctggcacaaccccggcaatatgcaaagcctcctctaatgatggttgaatccaggagaccccaaccgctgtgatggaaacctcgccacctccagaggcagccgatgactcctggggcagccccacccggctcaaaggcaacctgctccacagagccagccccatccctaggcttggagccaaacaggattgctccttcataagaaaaaaaaatcagagctacagagtcagccgtcttaaaaagctccctgcattcttgccttgcccagccaagcagcctcaggtccccctgctccctgtacctggctgggctcagagccactctcaaccacatattttttaagtcctttgtcccagactatgaacggcatggaaaccaattgaggactgggggtggcagcttgtgtgtgtgactgcttgagctctggagggtccttctactgtcagcgcctccccatcccccacccccattcttctgtgatggccccgagtgtctgtaatgcatccctcaacttttcatctgccagtgagactcacagagcaaatagcccaaggaaagacaaactatggatcaaactcatactaaagtataaatgactttcttctcccagatcattttgatagtgaacaggacaatcagcatcaggccca

SEQ ID NO: 98201 - DNA, 327 bp, Homo sapiens
ctgcctagaactgtgctgagcatggagtagatgctcagggatatttgttgaaagaattgcaggtgcttcatgaatatccattgaatcgatacataaaagtcacttcaactaaagtctataggtttgctttgaagaatgatctatttctgaaattctgcctttgaaacccaagctattaagctgcaatccccactgaattaaaacctttccttctgagcattcattttctctttctcactctctctctctttctctctctctttttctctctctttctctctctctctctttcagacagggttttgctgtgctgcccaggctggactt

SEQ ID NO: 98202 - DNA, 551 bp, Homo sapiens
gccaggaatggggttacctaagccggatcatgaaggacgagaacagactcaccaggggtcgagggacaaggaggcagcaagtccgcagcatgaaggcaggagagaacattgctgtaagcctttaccatggccactgcatggggaggaaacaggagatttggaatgagctgtgacactgggcaggaaagcaagacccaggtcttgtgaggccttgagcgtcaagcttaggagtcaggacctggggattttaagtacagcaatatcataattacattcatgtttcagagagatcactcaggcagcagtctggaaggtggagtggaaaacggagaaattagtcatgaagacctatttagaaagtagtaggcaagaaatacccagggcctaacctgaggtgtaggcaggggatgggaatgagagcaattaccgaactagaatgaactaaactcaatgaacaggagcggggaagagggaatgcagaaatggctctcagatttctgacttgttcgcttaatgactggggttgtcatttgtttagataagcaataaag

SEQ ID NO: 98203 - DNA, 359 bp, Homo sapiens
tccctctgcccaccaaactgcgagccagagccccatttcacatgtgcagaaactgccctaaaaggctaagcgacttgccggaggtcacacagctcaaaagcagcagaactggggctcacagcaaggtgtgcagactttccactcattggtcaggatattttttcctaatgctctgagaattattcccataggaaacattcagctcatttggaactcttttgacactaaaacctctttccctgagaacctgccttcaggggcaaaacaaggctggtggctgctgataagccacagcgtggcatggagaagcagcacggactttcaacgaggcagcccccgtcccgggtccacccccgaag

SEQ ID NO: 98204 - DNA, 728 bp, Homo sapiens
ggtgggctgaagggctcctcaagtgccgccaaagtgggagcccaggcagaggaggcgccgagagccagcgagggctgtgagaactgccagcacgctgtcacctctcactaccaaggtgggtgagggaagaccatcagatgggggtggggctaggcgagtctgggcttagactcttcttggtcagatcttgctgtggctgctgtcaggggtgggggtgagattcccaggtcactggagttgtgtacctaggaggattatggttgcctctgctgagtcatgaaatttttcagggaagtggggaaagccagcagtcacaggcctcagctagcactcacacaaactaaagggctggtctcactcccctatgcccttgccaacagccctcagaccttttccaggcagagtgatataggcttgaaaaactgccccaggctaactgcttcccagctgcgaaagaaatgggcttgcttctttccctgcctgtggagccagcacaacagatttgcaccctcccatgagttctggccgggaggcttctcaccccattcaaactgttacaaagttcagctagaggtttgctattccctgtagttttaccccctctgttcctccagcattggatccgtctgatgccaagcaggaatgacttcctaggggaccctgtgagctcccagggcctttctgctgtttcctcagtggttcacatctataatcacagcactttggaa

SEQ ID NO: 98205 - DNA, 192 bp, Homo sapiens
ccttaatatcagatattcaggtttaaactcattgtgaaaattcagactagtgtcttcctcatattatgataaagttgtgaaatttgtgatacttgtaattgttactaagaaaaactaaagttgtgactaattttagtggcaaagacagtactttgaattacaaataaatattacagcatttctttgaattgc

SEQ ID NO: 98206 - DNA, 550 bp, Homo sapiens
tgctcctgctctttgacatattttccgtgtagaagatatggagcctggaaatcatgtgacagttggagtaagccattcctaatcccatgccagaacggaaggctaatggccacattcttcttttaaagaaggtgagaagacaattcctaatccaaaaccagtgcctatcttcacgaccacatccgccaggcaccggtcccacttccggccaagctccaactccgacctgttccccaccggcgcctccagctttcctcttggccggcttcccgctccaacccctgcaagtctcgcgagctattttctttaaaagcattacccttgaaaacttccatagtttcggctcttaacaccatcaaaattagtcttaatctctgaacacataaagataatcctttcttctctctttctgcacaatatagattttcaaaacagagggaaataaagcactttatttagttccagatttattgtgttccatttaggaatgaactactatctgggtaacccatgggatgccaactctatatggagagaataaactatttta

SEQ ID NO: 98207 - DNA, 128 bp, Homo sapiens
ctccaacaacaacaacaacaacaacaaaattatagtgtatatgtcattgatttgatatgtaaggacatgaataaaagtaaacgctaaaaaactgcaagtttaatactggaatcgttttttttaatcct

SEQ ID NO: 98208 - DNA, 797 bp, Homo sapiens
agacatagggcatcactatgttgcccaagctgatcttgaactatcctcaagtgaccctcctgcctcagcctcccaaaatgctgatctcactcctctataatttgccaaagtatcatacatgtgtgaagggaaaacgaacagaaagacattctcatactggaaagatttagaaggcaatttacacatgtattcctcttaaaaaattacttgaataaaattacagtctttttaaaaatgaatcaaaacaaagctcaaatatggaagttaatgtaatttttaaaatgtattaagcaaagaaaatggaatatggttatgaaaatggaaatgacaaagtaatgattgaaagagaagacagataacctaaaatgttcattatcaaaactttaaaatcttatattgttttcctaggtactagagcttaggagaagaatagaagaaaacaaagatatggtaaatttctcatttaacaaaggtaatcagtagaaacaatttgtttcctgatatttagggaaaaatcgactcacaatattagaaattgactcagtcaccttataattaaaaaagcatgaaattacaaaaattatgaaacaaaatcttgaattttttttgttaaaatagatcataaaattgaaagaaaaaaactggaaaaaatattaacatatacataaaacatcttaatatgaaaagagtagttataaattaatcatttgataaagtctatgtagttaatttaaaaggcatgtcagacttatgtttctgcatttaaaaattaatatatacctatatacacatacaca

SEQ ID NO: 98209 - DNA, 634 bp, Homo sapiens
tcattcctgttacccctttcctgcactctcatgtgttacttggatatattgtcatactgtattttaatttgcctactgtgattttgactgtgtctctgtgtaaacatttttattgatttatcctgggattacaaaatctgtaggtatgtatcattgactaaattttgcaagtttttagccattatttattaaaaaatattttcagcaccatgctgtttctttttaacttctggtatttcaatgatacaaatatcagactttttgttgatatttcacaagtccctgggactttgctaatgttttcattgagatataatttatagataataaaattcacctatgtaattaccttcatcagtgctgtttatttcttcatgtggaatcaagttattatcaagtgtattttcatttcagccagaaaaacttcctttaacatttcttttcagggaagtatgctagagaaaaactttctgagcctttggctatctgggtatgtcttgatttctcctccatatttagaggaaagtttttcttcatatagaattctttgtttgcactctctgtccctctcttccccaggacgttaaatgttatcccactgtcttctatcgtacattatttctgattagaaatc

SEQ ID NO: 98210 - DNA, 334 bp, Homo sapiens
aaagtttcagtggggttagttacttgtgggggctgtgcgggagaatctgttgcacgcctctctccttgttcctagtgacagcaggcagtccttgatgtttctcccgtgtgtttctgtcttttcttctctttttcttttttcttttcttttctttcttttcttttctgttcctcctctcctgtcttcattcttcttcttcttcctcttcttcctcttcctcctcttcttcttcttcttccttttctctctctctctctctgtctctttcttcttctttcaacagagtctcactttgtcacccagtctggagtgcagtagtgcaaaaccaactcac

SEQ ID NO: 98211 - DNA, 583 bp, Homo sapiens
caggagaggaagtcagagatttgacagctagcagacaatggggagctcagtcaataagctttcaaggaaatgaattctgcctacaaacaatgaacttggaagagaatcccaaatcccaaataagaagcccagccctggacaacactttgatttcagtctaaagaaaccctgagaagagaatacagtgacattgtacctagacttccggcctacacaactgtaagataataaatacatgttgttttaagctgtacagtctgtggtaatttgtggcacagtaagagaaaactaatacaagctgggcgtggtggctcatacctgtaatcccagcactctaggagacccagaaaggcggaccacttgagcccaagttttgagaccagcctgggcaacatgtgaaacgctgtctctacaaaaaatattaaaaaaaaatcacccaagcatgatggtgtgcacctatagtaccagctaattaggagactgagctgggaggattgcttgagcccaggaggtcaaagctacagagagctgtgatcatgccactgcactgcagcctgagcaactgagcaagaccctgtctcca

SEQ ID NO: 98212 - DNA, 513 bp, Homo sapiens
ctttgagctaatcagaaccagccccttgccttcaactacagtttacatcataatgactcctaaatcccatatctctgctgagttttgggaaccagttctaacaccatactagatatttttaccttatgctacatagccatcacaaatgtaactcccttatccaaaactgaactcattatccaaccacactaacttcatctccactgatggcagtatgacccatccagtggtagaagccagaagtttgggagttagcctagatttctccttgaattttgtgtaccactggtcaatcattacattttaagattctgcttccaaaatagctctctaatttgttacctcccctttccactgccttaatttaggccctcatattttttgtactgctgcattggtgtcttaactgatacgcccatttctgacctagttccatccctcagtttcatccttcacattaaaaccattttgtcttttaatttttaattttatttttgagacagggtctggctc

SEQ ID NO: 98213 - DNA, 514 bp, Homo sapiens
ttttttgagacagagtcttgctctgtcacccaggctggagtgcagtagcataatcttggttcactgcaatctttgccacccaggttcaggcgatcctcctgcctcagcctcccgagtagctgggattacaggtgcacgccaccacgcctggctaatttttgtatttttagtagagacggggtttcgccatgttggccaggctggtcttgaactcctgacctcaaatgatccacccgcttcggcctcccaaagtgctggcattacaggagtgtgccactgcacccagcctgtactagtttttataacatagaagaatacctgacattttgaaaatccttattattccaagtgctttacacgtattttctccttcacctgattaaataccttttccaggtggcctggcaggtaagggggaagcaggtgttcacgaagggaccagagtctgggctccagagtccaccctgtgtgccaccacactgtactgcctgtgggtaccttggtaaagcaagtc

SEQ ID NO: 98214 - DNA, 5908 bp, Homo sapiens
  misc_feature (5760)..(5760): n is a, c, g, or t
  misc_feature (5763)..(5763): n is a, c, g, or t
  misc_feature (5765)..(5765): n is a, c, g, or t
cggccgcctctcttcgcccaaggagttgacattttgcaggactcgcgcgacgcccagtcgccggcgctccccgggaccccgccgccgggaggagggggcggaggagggtggagactgcggggcttggccaaggaaggcgcacatcctcgggcgggcggccgtgacgcggcggggatcaactttgcatgaataatgtgagtgcgcttggaaaagagacctcctgctccgcgggctcggggcaagagcccgcaggctaccttccccgggcaggggcgctcaacccaaccggctccagggcactggtaatttggctagaggaccgcgcggaggcagcgggatctgcgatttccttctggttggctgtcctgcgtgggtgccaagttccacacatgatttaatgaataagaaggagatgtcagtgaaaaaagggatccagaatgattactaacctatgactcccaacagtatgacagaaaatggccttacagcctgggacaaaccgaagcactgtccagaccgagaacacgactggaagctagtaggaatgtctgaagcctgcctacataggaagagccattcagagaggcgcagcacgttgaaaaatgaacagtcgtcgccacatctcatccagaccacttggactagctcaatattccatctggaccatgatgatgtgaacgaccagagtgtctcaagtgcccagaccttccaaacggaggagaagaaatgtaaagggtacatccccagttacttagacaaggacgagctctgtgtagtgtgtggtgacaaagccaccgggtatcactaccgctgtatcacgtgtgaaggctgcaagggtttctttagaagaaccattcagaaaaatctccatccatcctattcctgtaaatatgaaggaaaatgtgtcatagacaaagtcacgcgaaatcagtgccaggaatgtcgctttaagaaatgcatctatgttggcatggcaacagatttggtgctggatgacagcaagaggctggccaagaggaagctgatagaggagaaccgggagaaaagacggcgggaagagctgcagaagtccatcgggcacaagccagagcccacagacgaggaatgggagctcatcaaaactgtcaccgaagcccatgtggcgaccaacgcccaaggcagccactggaagcaaaaaccgaaatttctgccagaagacattggacaagcaccaatagtcaatgccccagaaggtggaaaggttgacttggaagccttcagccattttacaaaaatcatcacaccagcaattaccagagtggtggattttgccaaaaagttgcctatgttttgtgagctgccatgtgaagaccagatcatcctcctcaaaggctgctgcatggagatcatgtcccttcgcgctgctgtgcgctatgacccggaaagtgagactttaaccttgaatggggaaatggcagtgacacggggccagctgaaaaatgggggtcttggggtggtgtcagacgccatctttgacctgggcatgtctctgtcttctttcaacctggatgacactgaagtagccctccttcaggccgtcctgctgatgtcttcagatcgcccggggcttgcctgtgttgagagaatagaaaagtaccaagatagtttcctgctggcctttgaacactatatcaattaccgaaaacaccacgtgacacacttttggccaaaactcctgatgaaggtgacagatctgcggatgataggagcctgccatgccagccgcttcctgcacatgaaggtggaatgccccacagaactcctcccccctttgttcctggaagtgttcgaggattagactgactggattccttctctataattcctacagcactactgggtgtcatttcattccattgcctagctcttttttgtttgtttctttgtgttgggagggattatttgggagggaaaagggaagtagtccttggcatagacatggatgaaattgccccttgaatgcgggtacttgaaactattgcatttcgttctccggtcctgtgatgtgaatgctctgaaggttttatggttgtggaggtggggtgggggacaatcattaactcaccagcaccaagcatcaccagctcccacccgtccctggtccaagacttgagtcagcaaaatggcgccacaggacactaaagaagccttaaaaccaagataatacgaccacctccacccaatcctgatgttcgcagggctgaagttaacagagcacagaccacctttagttagatgtggctttcagctttttagggaaagactcgaacaaattttcatctattcaagagcatgctgtttgcagcactctttatggtctcctaggagcataacttggaatgtacaggaatatttgtgtcctaaaaaaatcagctgcccttccaatatcatttttataacgttatggtttaattcaagttatacaaaggtgtgactcaaggatgtgcaggtattgactgatggaggccgacaaggaaaatattttttttcagtgagccgagagaaattagaaatcttcaccaatgtcagtgactgcatggtttccaaaaattcacatagtattacctcacagtaggaaggcttctttcccatttaggctcagagaacacttttacagaaatcaaacctatttacagggtggcaccccttttctgtggcatctgatctgtcatctcccaagctcctgaagttctttatccaggttgtatctttgctgagctgacaactaatttctctcggacaaatgattctaatcaaggaaagatacggtgaaacttcagtcttcttctggaggaatgctgaggcgagattagtgcagctacattctgagttgaaggaaatgcagtgttctgagggcccctttgtgtcctgatggctggaggacgcttcctcctggttagatcctcaagctccttgcctcattgacaaatgtctcctagtcccctttttccctctgactctgaggaactaaatagcttgactatctctaaacagagactggccctgccactgaccctcctgtccctctcatagcataccctgacagatactcaatagaaaacacctgcagaccatgtgcacacttaactttcctgcccaacctgcctccccaacggcccatgctagaatagcttgtgcccagaaaacaaacggtgacacttcatctcttcagcgtcagaaaatgggcatagaatgtacccatgcaattgaatgtatctcattctccactggcatagtagatataaactattcctttgcctaccttttactgccttatcctggaaatattggggaaaataagccatatcagtgagatttacctaaaaacaaaggaaggaaagtcactatggaaaccaagtagatgctttttgtaagtttggtggagcataactggcccagaagtctgggtgcctgagttctagttcgtgctctgtcaactggtagatttgtaattctaggtcttggttttcttacctggtgaataagtcatgatctctaaaacccttcctgcccttaatattgtctgaatttcaaggggaaaaaaaaaatctggttcctttaattatttttttttaacacttaaattcctaactttattagacaagaagtatggcccacttaacagttaaggaacgtaaatttgttattggctcgaaataataatttgacacaatactagtcaaccatttagaggccttggaaaaagaagaggaacagcactgaaaattccaagtatgattggaaattatctgggagcggggaattaaatattcaatgcatgaaagcaattgtactggcttctgggaaaaaggaaacaagaacattgctatggaacttgttacccagagaaaggaagtgaaaagatttacaattataagcacgaaattcattggcagattacctgctttatctacagacagattgttttggggtttggttttgtctaggcagcctctggccaggctccttaattgcttgctctgctaatatttcagcttcctctcttgactccttgaggaaccaaccgctctttggaagacaaacacttagccacctctgtgctccagggtaaccctgagaagctctgctgtctggggcaagctttctttccaaagggaatgagaggaaggcaagcaggcagggtcctgcagcgtcaggccttctggggaaagtttcctcattttgtttgacagggtcctcagtacatcagacacccagatttgaatataagttcagagcctgatctcaagctaaatcagaatgctttggggactaaccatgatcgagaattggccaaatagtatggcatataaacagccatccagccagccgcaagtaaaggaacgtttgatccttggcaccttaaatgattgattgccttcaataggcaaactgctggtctggaaatctcgttgaaggctgaatacttcatgcggagtaggacaagccttagcccaccttcaggttgaaaggaaaggccataggactcaaaagataatgactctgaaactaaactccttccttctgaagctgacagaggtacttagtgcatctcaagactccatctcataaaactcatttgtgagggatttgctctagatttttctaaacattttttcatctattgtccagacttgcaaatccagtgtggacctgatggagatacccttcacacctgcgctcccaccccctcggcagggagacgtctcagtagaggagaacacacccattatgctgggatttgtatttataaatcacttcccttttagggatgagcggtgtggggcgtgtgtgcgtgtgagtgtatgcgcgtgcgtgtgtgaccctcaagtgtactttgctcaatttagacgtgcagtatttccagaaacaatgaaaaaagtaagatgttttcttctttatgattctgctcaaaacaccacgtgccgcctcagagctttttctagagcctcggtcctcaatgacgcgcttgacctgttgatgcctcagcccagcgaagccccttcacctgtgccccgggcgacagttctttcagtgtggcagtgcaggcctgggggtgggactgccagggctttcgctcttgttgccagcaacggcctttcttgttgctcctccatgaacagcgggtacaagccctggcccctcctcgacactaagccccccacagactcagcctccaaggaaccgctgagcacccttgaagcatgtcattgtcagtgatacctttttattctatggaactctaacctattcgtgtcatattgaccttttgctgcatgagtcataaattatgaaatcagtcttacagtttttgaaatgtagccagcatttgtaaggctaaacctttttcatgaactgaatttaagtgaataaccaagccacagttcctcctcaaatggagagtgatgatcgacatttgaatctctttgccctttccaacggctatggcatcaggttctaaaataagctcgtaatttttcctgttattttaataatatggaaatattagcatagtgtttcttttgatagtgatagactataatccatatttaaattttatagagaagaaattttattgtactgtgatgtagatatttattatccaggtaaggatttgcccggtgtgtattttttacaattgagacattttactttaatctttaaaaaaaatgcattaaaaacacactcaaaaaaaaaaaaaaaaaaaaaaaaaaaaacccnatngnggggggaaaaagggttggggcctttttcacaagaattttaaaaggggcgggacaaaagttgtttggacattgggaaaagtgggggatcttaaaggggtgtgtcccactttatataaaaggggcggctttaaggaggacatttt

SEQ ID NO: 98215 - DNA, 5727 bp, Homo sapiens
cggccgcctctcttcgcccaaggagttgacattttgcaggactcgcgcgacgcccagtcgccggcgctccccgggaccccgccgccgggaggagggggcggaggagggtggagactgcggggcttggccaaggaaggcgcacatcctcgggcgggcggccgtgacgcggcggggatcaactttgcatgaataatgtgagtgcgcttggaaaagagacctcctgctccgcgggctcggggcaagagcccgcaggctaccttccccgggcaggggcgctcaacccaaccggctccagggcactggtaatttggctagaggaccgcgcggaggcagcgggatctgcgatttccttctggttggctgtcctgcgtgggtgccaagttccacacatgatttaatgaataagaaggagatgtcagtgaaaaaagggatccagaatgattactaacctatgactcccaacagtatgacagaaaatggccttacagcctgggacaaaccgaagcactgtccagaccgagaacacgactggaagctagtaggaatgtctgaagcctgcctacataggaagagccattcagagaggcgcagcacgttgaaaaatgaacagtcgtcgccacatctcatccagaccacttggactagctcaatattccatctggaccatgatgatgtgaacgaccagagtgtctcaagtgcccagaccttccaaacggaggagaagaaatgtaaagggtacatccccagttacttagacaaggacgagctctgtgtagtgtgtggtgacaaagccaccgggtatcactaccgctgtatcacgtgtgaaggctgcaagggtttctttagaagaaccattcagaaaaatctccatccatcctattcctgtaaatatgaaggaaaatgtgtcatagacaaagtcacgcgaaatcagtgccaggaatgtcgctttaagaaatgcatctatgttggcatggcaacagatttggtgctggatgacagcaagaggctggccaagaggaagctgatagaggagaaccgggagaaaagacggcgggaagagctgcagaagtccatcgggcacaagccagagcccacagacgaggaatgggagctcatcaaaactgtcaccgaagcccatgtggcgaccaacgcccaaggcagccactggaagcaaaaaccgaaatttctgccagaagacattggacaagcaccaatagtcaatgccccagaaggtggaaaggttgacttggaagccttcagccattttacaaaaatcatcacaccagcaattaccagagtggtggattttgccaaaaagttgcctatgttttgtgagctgccatgtgaagaccagatcatcctcctcaaaggctgctgcatggagatcatgtcccttcgcgctgctgtgcgctatgacccggaaagtgagactttaaccttgaatggggaaatggcagtgacacggggccagctgaaaaatgggggtcttggggtggtgtcagacgccatctttgacctgggcatgtctctgtcttctttcaacctggatgacactgaagtagccctccttcaggccgtcctgctgatgtcttcagatcgcccggggcttgcctgtgttgagagaatagaaaagtaccaagatagtttcctgctggcctttgaacactatatcaattaccgaaaacaccacgtgacacacttttggccaaaactcctgatgaaggtgacagatctgcggatgataggagcctgccatgccagccgcttcctgcacatgaaggtggaatgccccacagaactcctcccccctttgttcctggaagtgttcgaggattagactgactggattccttctctataattcctacagcactactgggtgtcatttcattccattgcctagctcttttttgtttgtttctttgtgttgggagggattatttgggagggaaaagggaagtagtccttggcatagacatggatgaaattgccccttgaatgcgggtacttgaaactattgcatttcgttctccggtcctgtgatgtgaatgctctgaaggttttatggttgtggaggtggggtgggggacaatcattaactcaccagcaccaagcatcaccagctcccacccgtccctggtccaagacttgagtcagcaaaatggcgccacaggacactaaagaagccttaaaaccaagataatacgaccacctccacccaatcctgatgttcgcagggctgaagttaacagagcacagaccacctttagttagatgtggctttcagctttttagggaaagactcgaacaaattttcatctattcaagagcatgctgtttgcagcactctttatggtctcctaggagcataacttggaatgtacaggaatatttgtgtcctaaaaaaatcagctgcccttccaatatcatttttataacgttatggtttaattcaagttatacaaaggtgtgactcaaggatgtgcaggtattgactgatggaggccgacaaggaaaatattttttttcagtgagccgagagaaattagaaatcttcaccaatgtcagtgactgcatggtttccaaaaattcacatagtattacctcacagtaggaaggcttctttcccatttaggctcagagaacacttttacagaaatcaaacctatttacagggtggcaccccttttctgtggcatctgatctgtcatctcccaagctcctgaagttctttatccaggttgtatctttgctgagctgacaactaatttctctcggacaaatgattctaatcaaggaaagatacggtgaaacttcagtcttcttctggaggaatgctgaggcgagattagtgcagctacattctgagttgaaggaaatgcagtgttctgagggcccctttgtgtcctgatggctggaggacgcttcctcctggttagatcctcaagctccttgcctcattgacaaatgtctcctagtcccctttttccctctgactctgaggaactaaatagcttgactatctctaaacagagactggccctgccactgaccctcctgtccctctcatagcataccctgacagatactcaatagaaaacacctgcagaccatgtgcacacttaactttcctgcccaacctgcctccccaacggcccatgctagaatagcttgtgcccagaaaacaaacggtgacacttcatctcttcagcgtcagaaaatgggcatagaatgtacccatgcaattgaatgtatctcattctccactggcatagtagatataaactattcctttgcctaccttttactgccttatcctggaaatattggggaaaataagccatatcagtgagatttacctaaaaacaaaggaaggaaagtcactatggaaaccaagtagatgctttttgtaagtttggtggagcataactggcccagaagtctgggtgcctgagttctagttcgtgctctgtcaactggtagatttgtaattctaggtcttggttttcttacctggtgaataagtcatgatctctaaaacccttcctgcccttaatattgtctgaatttcaaggggaaaaaaaaaatctggttcctttaattatttttttttaacacttaaattcctaactttattagacaagaagtatggcccacttaacagttaaggaacgtaaatttgttattggctcgaaataataatttgacacaatactagtcaaccatttagaggccttggaaaaagaagaggaacagcactgaaaattccaagtatgattggaaattatctgggagcggggaattaaatattcaatgcatgaaagcaattgtactggcttctgggaaaaaggaaacaagaacattgctatggaacttgttacccagagaaaggaagtgaaaagatttacaattataagcacgaaattcattggcagattacctgctttatctacagacagattgttttggggtttggttttgtctaggcagcctctggccaggctccttaattgcttgctctgctaatatttcagcttcctctcttgactccttgaggaaccaaccgctctttggaagacaaacacttagccacctctgtgctccagggtaaccctgagaagctctgctgtctggggcaagctttctttccaaagggaatgagaggaaggcaagcaggcagggtcctgcagcgtcaggccttctggggaaagtttcctcattttgtttgacagggtcctcagtacatcagacacccagatttgaatataagttcagagcctgatctcaagctaaatcagaatgctttggggactaaccatgatcgagaattggccaaatagtatggcatataaacagccatccagccagccgcaagtaaaggaacgtttgatccttggcaccttaaatgattgattgccttcaataggcaaactgctggtctggaaatctcgttgaaggctgaatacttcatgcggagtaggacaagccttagcccaccttcaggttgaaaggaaaggccataggactcaaaagataatgactctgaaactaaactccttccttctgaagctgacagaggtacttagtgcatctcaagactccatctcataaaactcatttgtgagggatttgctctagatttttctaaacattttttcatctattgtccagacttgcaaatccagtgtggacctgatggagatacccttcacacctgcgctcccaccccctcggcagggagacgtctcagtagaggagaacacacccattatgctgggatttgtatttataaatcacttcccttttagggatgagcggtgtggggcgtgtgtgcgtgtgagtgtatgcgcgtgcgtgtgtgaccctcaagtgtactttgctcaatttagacgtgcagtatttccagaaacaatgaaaaaagtaagatgttttcttctttatgattctgctcaaaacaccacgtgccgcctcagagctttttctagagcctcggtcctcaatgacgcgcttgacctgttgatgcctcagcccagcgaagccccttcacctgtgccccgggcgacagttctttcagtgtggcagtgcaggcctgggggtgggactgccagggctttcgctcttgttgccagcaacggcctttcttgttgctcctccatgaacagcgggtacaagccctggcccctcctcgacactaagccccccacagactcagcctccaaggaaccgctgagcacccttgaagcatgtcattgtcagtgatacctttttattctatggaactctaacctattcgtgtcatattgaccttttgctgcatgagtcataaattatgaaatcagtcttacagtttttgaaatgtagccagcatttgtaaggctaaacctttttcatgaactgaatttaagtgaataaccaagccacagttcctcctcaaatggagagtgatgatcgacatttgaatctctttgccctttccaacggctatggcatcaggttctaaaataagctcgtaatttttcctgttattttaataatatggaaatattagcatagtgtttcttttgatagtgatagactataatccatatttaaattttatagagaagaaattttattgtactgtgatgtagatatttattatccaggtaaggatttgcccggtgtgtattttttacaattgagacattttactttaatctttaaaaaaaatgcattaaaaacacactc

SEQ ID NO: 98216 - DNA, 5854 bp, Homo sapiens
  misc_feature (5706)..(5706): n is a, c, g, or t
  misc_feature (5709)..(5709): n is a, c, g, or t
  misc_feature (5711)..(5711): n is a, c, g, or t
cggccgcctctcttcgcccaaggagttgacattttgcaggactcgcgcgacgcccagtcgccggcgctccccgggaccccgccgccgggaggagggggcggaggagggtggagactgcggggcttggccaaggaaggcgcacatcctcgggcgggcggccgtgacgcggcggggatcaactttgcatgaataatgtgagtgcgcttggaaaagagacctcctgctccgcgggctcggggcaagagcccgcaggctaccttccccgggcaggggcgctcaacccaaccggctccagggcactggtaatttggctagaggaccgcgcggaggcagcgggatctgcgatttccttctggttggctgtcctgcgtgggtgccaagttccacacatgatttaatgaataagaaggagatgtcagtgaaaaaagggatccagaatgattactaacctatgactcccaacagtatgacagaaaatggccttacagcctgggacaaaccgaagcactgtccagaccgagaacacgactggaagctagtaggaatgtctgaagcctgcctacataggaagagccattcagagaggcgcagcacgttgaaaaatgaacagtcgtcgccacatctcatccagaccacttggactagctcaatattccatctggaccatgatgatgtgaacgaccagagtgtctcaagtgcccagaccttccaaacggaggagaagaaatgtaaagggtacatccccagttacttagacaaggacgagctctgtgtagtgtgtggtgacaaagccaccgggtatcactaccgctgtatcacgtgtgaaggctgcaagggtttctttagaagaaccattcagaaaaatctccatccatcctattcctgtaaatatgaaggaaaatgtgtcatagacaaagtcacgcgaaatcagtgccaggaatgtcgctttaagaaatgcatctatgttggcatggcaacagatttggtgctggatgacagcaagaggctggccaagaggaagctgatagaggagaaccgggagaaaagacggcgggaagagctgcagaagtccatcgggcacaagccagagcccacagacgaggaatgggagctcatcaaaactgtcaccgaagcccatgtggcgaccaacgcccaaggcagccactggaagcaaaaaccgaaatttctgccagaagacattggacaagcaccaatagtcaatgccccagaaggtggaaaggttgacttggaagccttcagccattttacaaaaatcatcacaccagcaattaccagagtggtggattttgccaaaaagttgcctatgttttgtgagctgccatgtgaagaccagatcatcctcctcaaaggctgctgcatggagatcatgtcccttcgcgctgctgtgcgctatgacccggaaagtgagactttaaccttgaatggggaaatggcagtgacacggggccagctgaaaaatgggggtcttggggtggtgtcagacgccatctttgacctgggcatgtctctgtcttctttcaacctggatgacactgaagtagccctccttcaggccgtcctgctgatgtcttcagatcgcccggggcttgcctgtgttgagagaatagaaaagtaccaagatagtttcctgctggcctttgaacactatatcaattaccgaaaacaccacgtgacacacttttggccaaaactcctgatgaaggtgacagatctgcggatgataggagcctgccatgccagccgcttcctgcacatgaaggtggaatgccccacagaactcctcccccctttgttcctggaagtgttcgaggattagactgactggattccttctctataattcctacagcactactgggtgtcatttcattccattgcctagctcttttttgtttgtttctttgtgttgggagggattatttgggagggaaaagggaagtagtccttggcatagacatggatgaaattgccccttgaatgcgggtacttgaaactattgcatttcgttctccggtcctgtgatgtgaatgctctgaaggttttatggttgtggaggtggggtgggggacaatcattaactcaccagcaccaagcatcaccagctcccacccgtccctggtccaagacttgagtcagcaaaatggcgccacaggacactaaagaagccttaaaaccaagataatacgaccacctccacccaatcctgatgttcgcagggctgaagttaacagagcacagaccacctttagttagatgtggctttcagctttttagggaaagactcgaacaaattttcatctattcaagagcatgctgtttgcagcactctttatggtctcctaggagcataacttggaatgtacaggaatatttgtgtcctaaaaaaatcagctgcccttccaatatcatttttataacgttatggtttaattcaagttatacaaaggtgtgactcaaggatgtgcaggtattgactgatggaggccgacaaggaaaatattttttttcagtgagccgagagaaattagaaatcttcaccaatgtcagtgactgcatggtttccaaaaattcacatagtattacctcacagtaggaaggcttctttcccatttaggctcagagaacacttttacagaaatcaaacctatttacagggtggcaccccttttctgtggcatctgatctgtcatctcccaagctcctgaagttctttatccaggttgtatctttgctgagctgacaactaatttctctcggacaaatgattctaatcaaggaaagatacggtgaaacttcagtcttcttctggaggaatgctgaggcgagattagtgcagctacattctgagttgaaggaaatgcagtgttctgagggcccctttgtgtcctgatggctggaggacgcttcctcctggttagatcctcaagctccttgcctcattgacaaatgtctcctagtcccctttttccctctgactctgaggaactaaatagcttgactatctctaaacagagactggccctgccactgaccctcctgtccctctcatagcataccctgacagatactcaatagaaaacacctgcagaccatgtgcacacttaactttcctgcccaacctgcctccccaacggcccatgctagaatagcttgtgcccagaaaacaaacggtgacacttcatctcttcagcgtcagaaaatgggcatagaatgtacccatgcaattgaatgtatctcattctccactggcatagtagatataaactattcctttgcctaccttttactgccttatcctggaaatattggggaaaataagccatatcagtgagatttacctaaaaacaaaggaaggaaagtcactatggaaaccaagtagatgctttttgtaagtttggtggagcataactggcccagaagtctgggtgcctgagttctagttcgtgctctgtcaactggtagatttgtaattctaggtcttggttttcttacctggtgaataagtcatgatctctaaaacccttcctgcccttaatattgtctgaatttcaaggggaaaaaaaaaatctggttcctttaattatttttttttaacacttaaattcctaactttattagacaagaagtatggcccacttaacagttaaggaacgtaaatttgttattggctcgaaataataatttgacacaatactagtcaaccatttagaggccttggaaaaagaagaggaacagcactgaaaattccaagtatgattggaaattatctgggagcggggaattaaatattcaatgcatgaaagcaattgtactggcttctgggaaaaaggaaacaagaacattgctatggaacttgttacccagagaaaggaagtgaaagacagattgttttggggtttggttttgtctaggcagcctctggccaggctccttaattgcttgctctgctaatatttcagcttcctctcttgactccttgaggaaccaaccgctctttggaagacaaacacttagccacctctgtgctccagggtaaccctgagaagctctgctgtctggggcaagctttctttccaaagggaatgagaggaaggcaagcaggcagggtcctgcagcgtcaggccttctggggaaagtttcctcattttgtttgacagggtcctcagtacatcagacacccagatttgaatataagttcagagcctgatctcaagctaaatcagaatgctttggggactaaccatgatcgagaattggccaaatagtatggcatataaacagccatccagccagccgcaagtaaaggaacgtttgatccttggcaccttaaatgattgattgccttcaataggcaaactgctggtctggaaatctcgttgaaggctgaatacttcatgcggagtaggacaagccttagcccaccttcaggttgaaaggaaaggccataggactcaaaagataatgactctgaaactaaactccttccttctgaagctgacagaggtacttagtgcatctcaagactccatctcataaaactcatttgtgagggatttgctctagatttttctaaacattttttcatctattgtccagacttgcaaatccagtgtggacctgatggagatacccttcacacctgcgctcccaccccctcggcagggagacgtctcagtagaggagaacacacccattatgctgggatttgtatttataaatcacttcccttttagggatgagcggtgtggggcgtgtgtgcgtgtgagtgtatgcgcgtgcgtgtgtgaccctcaagtgtactttgctcaatttagacgtgcagtatttccagaaacaatgaaaaaagtaagatgttttcttctttatgattctgctcaaaacaccacgtgccgcctcagagctttttctagagcctcggtcctcaatgacgcgcttgacctgttgatgcctcagcccagcgaagccccttcacctgtgccccgggcgacagttctttcagtgtggcagtgcaggcctgggggtgggactgccagggctttcgctcttgttgccagcaacggcctttcttgttgctcctccatgaacagcgggtacaagccctggcccctcctcgacactaagccccccacagactcagcctccaaggaaccgctgagcacccttgaagcatgtcattgtcagtgatacctttttattctatggaactctaacctattcgtgtcatattgaccttttgctgcatgagtcataaattatgaaatcagtcttacagtttttgaaatgtagccagcatttgtaaggctaaacctttttcatgaactgaatttaagtgaataaccaagccacagttcctcctcaaatggagagtgatgatcgacatttgaatctctttgccctttccaacggctatggcatcaggttctaaaataagctcgtaatttttcctgttattttaataatatggaaatattagcatagtgtttcttttgatagtgatagactataatccatatttaaattttatagagaagaaattttattgtactgtgatgtagatatttattatccaggtaaggatttgcccggtgtgtattttttacaattgagacattttactttaatctttaaaaaaaatgcattaaaaacacactcaaaaaaaaaaaaaaaaaaaaaaaaaaaaacccnatngnggggggaaaaagggttggggcctttttcacaagaattttaaaaggggcgggacaaaagttgtttggacattgggaaaagtgggggatcttaaaggggtgtgtcccactttatataaaaggggcggctttaaggaggacatttt

SEQ ID NO: 98217 - DNA, 5765 bp, Homo sapiens
  misc_feature (5617)..(5617): n is a, c, g, or t
  misc_feature (5620)..(5620): n is a, c, g, or t
  misc_feature (5622)..(5622): n is a, c, g, or t
cggccgcctctcttcgcccaaggagttgacattttgcaggactcgcgcgacgcccagtcgccggcgctccccgggaccccgccgccgggaggagggggcggaggagggtggagactgcggggcttggccaaggaaggcgcacatcctcgggcgggcggccgtgacgcggcggggatcaactttgcatgaataatatctgcgatttccttctggttggctgtcctgcgtgggtgccaagttccacacatgatttaatgaataagaaggagatgtcagtgaaaaaagggatccagaatgattactaacctatgactcccaacagtatgacagaaaatggccttacagcctgggacaaaccgaagcactgtccagaccgagaacacgactggaagctagtaggaatgtctgaagcctgcctacataggaagagccattcagagaggcgcagcacgttgaaaaatgaacagtcgtcgccacatctcatccagaccacttggactagctcaatattccatctggaccatgatgatgtgaacgaccagagtgtctcaagtgcccagaccttccaaacggaggagaagaaatgtaaagggtacatccccagttacttagacaaggacgagctctgtgtagtgtgtggtgacaaagccaccgggtatcactaccgctgtatcacgtgtgaaggctgcaagggtttctttagaagaaccattcagaaaaatctccatccatcctattcctgtaaatatgaaggaaaatgtgtcatagacaaagtcacgcgaaatcagtgccaggaatgtcgctttaagaaatgcatctatgttggcatggcaacagatttggtgctggatgacagcaagaggctggccaagaggaagctgatagaggagaaccgggagaaaagacggcgggaagagctgcagaagtccatcgggcacaagccagagcccacagacgaggaatgggagctcatcaaaactgtcaccgaagcccatgtggcgaccaacgcccaaggcagccactggaagcaaaaaccgaaatttctgccagaagacattggacaagcaccaatagtcaatgccccagaaggtggaaaggttgacttggaagccttcagccattttacaaaaatcatcacaccagcaattaccagagtggtggattttgccaaaaagttgcctatgttttgtgagctgccatgtgaagaccagatcatcctcctcaaaggctgctgcatggagatcatgtcccttcgcgctgctgtgcgctatgacccggaaagtgagactttaaccttgaatggggaaatggcagtgacacggggccagctgaaaaatgggggtcttggggtggtgtcagacgccatctttgacctgggcatgtctctgtcttctttcaacctggatgacactgaagtagccctccttcaggccgtcctgctgatgtcttcagatcgcccggggcttgcctgtgttgagagaatagaaaagtaccaagatagtttcctgctggcctttgaacactatatcaattaccgaaaacaccacgtgacacacttttggccaaaactcctgatgaaggtgacagatctgcggatgataggagcctgccatgccagccgcttcctgcacatgaaggtggaatgccccacagaactcctcccccctttgttcctggaagtgttcgaggattagactgactggattccttctctataattcctacagcactactgggtgtcatttcattccattgcctagctcttttttgtttgtttctttgtgttgggagggattatttgggagggaaaagggaagtagtccttggcatagacatggatgaaattgccccttgaatgcgggtacttgaaactattgcatttcgttctccggtcctgtgatgtgaatgctctgaaggttttatggttgtggaggtggggtgggggacaatcattaactcaccagcaccaagcatcaccagctcccacccgtccctggtccaagacttgagtcagcaaaatggcgccacaggacactaaagaagccttaaaaccaagataatacgaccacctccacccaatcctgatgttcgcagggctgaagttaacagagcacagaccacctttagttagatgtggctttcagctttttagggaaagactcgaacaaattttcatctattcaagagcatgctgtttgcagcactctttatggtctcctaggagcataacttggaatgtacaggaatatttgtgtcctaaaaaaatcagctgcccttccaatatcatttttataacgttatggtttaattcaagttatacaaaggtgtgactcaaggatgtgcaggtattgactgatggaggccgacaaggaaaatattttttttcagtgagccgagagaaattagaaatcttcaccaatgtcagtgactgcatggtttccaaaaattcacatagtattacctcacagtaggaaggcttctttcccatttaggctcagagaacacttttacagaaatcaaacctatttacagggtggcaccccttttctgtggcatctgatctgtcatctcccaagctcctgaagttctttatccaggttgtatctttgctgagctgacaactaatttctctcggacaaatgattctaatcaaggaaagatacggtgaaacttcagtcttcttctggaggaatgctgaggcgagattagtgcagctacattctgagttgaaggaaatgcagtgttctgagggcccctttgtgtcctgatggctggaggacgcttcctcctggttagatcctcaagctccttgcctcattgacaaatgtctcctagtcccctttttccctctgactctgaggaactaaatagcttgactatctctaaacagagactggccctgccactgaccctcctgtccctctcatagcataccctgacagatactcaatagaaaacacctgcagaccatgtgcacacttaactttcctgcccaacctgcctccccaacggcccatgctagaatagcttgtgcccagaaaacaaacggtgacacttcatctcttcagcgtcagaaaatgggcatagaatgtacccatgcaattgaatgtatctcattctccactggcatagtagatataaactattcctttgcctaccttttactgccttatcctggaaatattggggaaaataagccatatcagtgagatttacctaaaaacaaaggaaggaaagtcactatggaaaccaagtagatgctttttgtaagtttggtggagcataactggcccagaagtctgggtgcctgagttctagttcgtgctctgtcaactggtagatttgtaattctaggtcttggttttcttacctggtgaataagtcatgatctctaaaacccttcctgcccttaatattgtctgaatttcaaggggaaaaaaaaaatctggttcctttaattatttttttttaacacttaaattcctaactttattagacaagaagtatggcccacttaacagttaaggaacgtaaatttgttattggctcgaaataataatttgacacaatactagtcaaccatttagaggccttggaaaaagaagaggaacagcactgaaaattccaagtatgattggaaattatctgggagcggggaattaaatattcaatgcatgaaagcaattgtactggcttctgggaaaaaggaaacaagaacattgctatggaacttgttacccagagaaaggaagtgaaaagatttacaattataagcacgaaattcattggcagattacctgctttatctacagacagattgttttggggtttggttttgtctaggcagcctctggccaggctccttaattgcttgctctgctaatatttcagcttcctctcttgactccttgaggaaccaaccgctctttggaagacaaacacttagccacctctgtgctccagggtaaccctgagaagctctgctgtctggggcaagctttctttccaaagggaatgagaggaaggcaagcaggcagggtcctgcagcgtcaggccttctggggaaagtttcctcattttgtttgacagggtcctcagtacatcagacacccagatttgaatataagttcagagcctgatctcaagctaaatcagaatgctttggggactaaccatgatcgagaattggccaaatagtatggcatataaacagccatccagccagccgcaagtaaaggaacgtttgatccttggcaccttaaatgattgattgccttcaataggcaaactgctggtctggaaatctcgttgaaggctgaatacttcatgcggagtaggacaagccttagcccaccttcaggttgaaaggaaaggccataggactcaaaagataatgactctgaaactaaactccttccttctgaagctgacagaggtacttagtgcatctcaagactccatctcataaaactcatttgtgagggatttgctctagatttttctaaacattttttcatctattgtccagacttgcaaatccagtgtggacctgatggagatacccttcacacctgcgctcccaccccctcggcagggagacgtctcagtagaggagaacacacccattatgctgggatttgtatttataaatcacttcccttttagggatgagcggtgtggggcgtgtgtgcgtgtgagtgtatgcgcgtgcgtgtgtgaccctcaagtgtactttgctcaatttagacgtgcagtatttccagaaacaatgaaaaaagtaagatgttttcttctttatgattctgctcaaaacaccacgtgccgcctcagagctttttctagagcctcggtcctcaatgacgcgcttgacctgttgatgcctcagcccagcgaagccccttcacctgtgccccgggcgacagttctttcagtgtggcagtgcaggcctgggggtgggactgccagggctttcgctcttgttgccagcaacggcctttcttgttgctcctccatgaacagcgggtacaagccctggcccctcctcgacactaagccccccacagactcagcctccaaggaaccgctgagcacccttgaagcatgtcattgtcagtgatacctttttattctatggaactctaacctattcgtgtcatattgaccttttgctgcatgagtcataaattatgaaatcagtcttacagtttttgaaatgtagccagcatttgtaaggctaaacctttttcatgaactgaatttaagtgaataaccaagccacagttcctcctcaaatggagagtgatgatcgacatttgaatctctttgccctttccaacggctatggcatcaggttctaaaataagctcgtaatttttcctgttattttaataatatggaaatattagcatagtgtttcttttgatagtgatagactataatccatatttaaattttatagagaagaaattttattgtactgtgatgtagatatttattatccaggtaaggatttgcccggtgtgtattttttacaattgagacattttactttaatctttaaaaaaaatgcattaaaaacacactcaaaaaaaaaaaaaaaaaaaaaaaaaaaaacccnatngnggggggaaaaagggttggggcctttttcacaagaattttaaaaggggcgggacaaaagttgtttggacattgggaaaagtgggggatcttaaaggggtgtgtcccactttatataaaaggggcggctttaaggaggacatttt

SEQ ID NO: 98218 - DNA, 790 bp, Homo sapiens
cggccgcctctcttcgcccaaggagttgacattttgcaggactcgcgcgacgcccagtcgccggcgctccccgggaccccgccgccgggaggagggggcggaggagggtggagactgcggggcttggccaaggaaggcgcacatcctcgggcgggcggccgtgacgcggcggggatcaactttgcatgaataatatctgcgatttccttctggttggctgtcctgcgtgggtgccaagttccacacatgatttaatgaataagaaggagatgtcagtgaaaaaagggatccagaatgattactaacctatgactcccaacagtatgacagaaaatggccttacagcctgggacaaaccgaagcactgtccagaccgagaacacgactggaagctagtaggaatgtctgaagcctgcctacataggaagagccattcagagaggcgcagcacgttgaaaaatgaacagtcgtcgccacatctcatccagaccacttggactagctcaatattccatctggaccatgatgatgtgaacgaccagagtgtctcaagtgcccagaccttccaaacggaggagaagaaatgtaaaggtaaccagatttttattagcccattatcatgtgtttcaacaagaaaaaaaatatccctgttgtagctgtgtacttcatctacatttctcttccaatgtatggtgtcccatgttttctccaactgttcttttactaggcgtccttttcttcaaatattcttttaaacataaataaataagtggaatccaaagaaaggcag

SEQ ID NO: 98219 - DNA, 736 bp, Homo sapiens
cggccgcctctcttcgcccaaggagttgacattttgcaggactcgcgcgacgcccagtcgccggcgctccccgggaccccgccgccgggaggagggggcggaggagggtggagactgcggggcttggccaaggaaggcgcacatcctcgggcgggcggccgtgacgcggcggggatcaactttgcatgaataatatctgcgatttccttctggttggctgtcctgcgtgggtgccaagttccacacatgatttaatgaataagaaggagatgtcagtgaaaaaagggatccagaatgattactaacctatgactcccaacagtatgacagaaaatggccttacagcctgggacaaaccgaagcactgtccagaccgagaacacgactggaagctagtaggaatgtctgaagcctgcctacataggaagagccattcagagaggcgcagcacgttgaaaaatgaacagtcgtcgccacatctcatccagaccacttggactagctcaatattccatctggaccatgatgatgtgaacgaccagagtgtctcaagtgcccagaccttccaaacggaggagaagaaatgtaaaggtaaccagatttttattagcccattatcatgtgtttcaacaagaaaaaaaatatccctgttgtagctgtgtacttcatctacatttctcttccaatgtatggtgtcccatgttttctccaactaccacggggccggggatcctca

SEQ ID NO: 98220 - DNA, 408 bp, Homo sapiens
cggccgcctctcttcgcccaaggagttgacattttgcaggactcgcgcgacgcccagtcgccggcgctccccgggaccccgccgccgggaggagggggcggaggagggtggagactgcggggcttggccaaggaaggcgcacatcctcgggcgggcggccgtgacgcggcggggatcaactttgcatgaataatgtgagtgcgcttggaaaagagacctcctgctccgcgggctcggggcaagagcccgcaggctaccttccccgggcaggggcgctcaacccaaccggctccagggcactgatctgcgatttccttctggttggctgtcctgcgtgggtgccaagttccacacatgatttaatgaataagaagctcgccagagacgcaaactccagcatttatattt

SEQ ID NO: 98221 - DNA, 583 bp, Homo sapiens
ggtagaaggtggtaaaaacagagttgccactctcggtgtggccacgtgagcacgtcccacttaagtaacagggtgtccctcaggtcagcttgtgataaaacccaagtcaaacaaggctgaatcctgggtgttttatgtcctaaggatctgaaaagtgttcacggccagccctgaccctcaagacctcaaatggtcatctaagcagtaacgtaaattggtgtgtaaacttgctcctgggccattgctgtggaagtgggactggcgaaagtacagccttgccatgcaggaactaatgtctttctaggcatttaaaataagggggaatgtgttgattactccgacaggcaacccaactgcagtggctaaatgcccaaggctgacaaattctgcatcttatcactcccgtcaagtggcatgtgaatactgtcagcccaaaagaattgagaaacaacttgccttccaaaactctgcatctcagcaaaatcttgacaatgccaacagctcgtcatctcgtgtttttcaaccctttagaaaatggccttacagcctgggacaaaccgaagcactgtccagaccgagaaca

SEQ ID NO: 98222 - DNA, 180 bp, Homo sapiens
gtaacgggttaggtgcagtggctcatgcctataatcccagcactttaggaggccaaggcgggaggatcctttgagctccggagttcaagaccagtctgcgtaacatagtgggaccccatctctacaaaaaatttaaatatttttaaaatgtcttaaaaagaaccagtcgtggctacccat

SEQ ID NO: 98223 - DNA, 142 bp, Homo sapiens
agataggaggattgcttcagtccaggtgtgcaaaactggtctgggtaacatggggaaaccccatttctacaaaaaaatgcaaaattagctgggcatggtggtgctcacctatgatctcagctactcaggcagctgaggtgga

SEQ ID NO: 98224 - DNA, 719 bp, Homo sapiens
agaactaaatctagatcttttgtcttcttggtaactgataatgacatatttattccattgattctatgacatggacgaataaaagctgcttaaggccaggcgaggtggctcacacctgtaatcccagcactttgagaggcctaggcaggtggatcacttgaggtcaggagttcgagaccagcctggccaaccaatatggtaaaacctcgtctccactgaaaatatgaaaattagctgggctttgttgtaggcatctataatcccagctactcgtgaggctgagagaagagaatcacttgagcccgggaggcggagtttgcagtgagctgagattgtgccactgtacacactgtacactgtaccactgtacagcctgggtgacagagtgaaactctgtctcaaaaaaaaaaaaaaacagaagctgcttaagactccttatgcttttgagctgtggtccttgataatccttgataatggatagtaactttgaagttaaaacattttataatgtatttttggcactggtattggttctagctgttttagaagaaagttagcattttcttattacatatatgaaccaggcagtacattttaaactatataatagagtcattgtgagttaataggttatcattttttaacatgaggataagatctgagagatacccacaagctagtaaataagtgagttttaaactatataatagagtcattgt

SEQ ID NO: 98225 - DNA, 513 bp, Homo sapiens
gtgaattagaaacttcctctgtaaactagcagagtagaaataagaggccaggattcagcaccaggtaggctggattccttcttaggtggctcaagctggctatggggctggtctcatcatatctaaagaactgcccagcttttacgcattttgaatgtggtggaaccagctgcatatttttatatgagagcggcaaatagtcattgtgttccagtttgcttctcgggtcatctaaacatcagaggccatgccacaagcaccgtaactgagggatatagtgtgactgtggtccaggccagtgacctctggagctgaatcatgacttcccagatgactcccagagcctgagaggggactggtgcgtggctccaaatgattttcacctgggcctctttgaagtcgggagagatacgtgcagtatggtagatgtggagagggagaggcatggtgtgtccaaaaattagcaggacctgatccatatacgtggattctgaagcagtgcacttactagat

SEQ ID NO: 98226 - DNA, 1431 bp, Homo sapiens
taagaataactcaggtgactgataccaaaaataaatctctaatacagctgagaatccagaaacacaaataatatgttgagtaagtaataaaagtgacatttcaaattagtaaggaaaaaatggattattcaacaaatagtatgggatagcataacaatttagaagaaatataaagttagatctttcacaaaaattaattctagctagactagcagttagtcttctactttttggttactcccttttagaaattggaagctatgaagctatataccctgtccatttgaaaatgcacataagcaaagaactttacaaataggttataaagagaagctcaatctcagcaaaataagggaagtgcacattaaaacacaagaaaccatctcagatccaactaatatttagcgtgcatacaaatcaaaagctggaaagggtgtggaaaaacaggaatacattgctagtgagcatacaaattggcacagcctcttttaaagacaattgtgtatcacccattaaattttaaaagtcacataccctgtgacctaacaattccaacttttaatgtcctaaagaaacatacatgtgttcacaagatagcctgtacaatgatgtcaattgcacctttgcttgtacagtagacccccttatctgcattttcactttttgaggtttcagtcatccaaggtcaaccacaatacaaaaatattaaatggaaaattccagaaacgaacataagttttaaacttcaaacctttctgcatagtataataaaaatctctcactatccctctccatcctgcctgggacaggaatcatccctttgtccagtgtatccacaatgtatacactcattatatacccattttataatgcccattagtcatttctattatcagatcataaaaaaacatagtacatagagggtttggtattattcatggtttcaggcattcagtgagggtcttggaaaatatcctccatgatgggggagctactgtaatactatgaaattggaaaaaccaaaatactcatcaagaggatggactatggtacacatgatgaagtattaagtatcaatgaaaaagagagagtcctacatgtccggcatggaaggatctccaggagacaatgttaaaagtttgggggaaaaattgaaagacaatacctgtaatacatatgatactagtgatgttaaatcacatcacacacacacacacacacacacacacacacacacaaatactgtatagtgtacttctacaagtacatatttgtgtattatatagagagaaggtctggaaggatactaaccaaactgtcaacagtagtttggtagcgtgcattagctttaactgtaatgtttgatgtttttgaatatgcatttatgtattgtttgtgtaatgacaaattaataaattagaaataaaataa

SEQ ID NO: 98227 - DNA, 1229 bp, Homo sapiens
aagcagtggtatcaacgcagagtcgccattacggccgggcttttagaaattggaagctatgaagctatataccctgtccatttgaaaatgcacataagcaaagaactttacaaataggttataaagagaagctcaatctcagcaaaataagggaagtgcacattaaaacacaagaaaccatctcagatccaactaatatttagcgtgcatacaaatcaaaagctggaaagggtgtggaaaaacaggaatacattgctagtgagcatacaaattggcacagcctcttttaaagacaattgtgtatcacccattaaattttaaaagtcacataccctgtgacctaacaattccaacttttaatgtcctaaagaaacatacatgtgttcacaagatagcctgtacaatgatgtcaattgcacctttgcttgtacagtagacccccttatctgcattttcactttttgaggtttcagtcatccaaggtcaaccacaatacaaaaatattaaatggaaaattccagaaacgaacataagttttaaacttcaaacctttctgcatagtataataaaaatctctcactatccctctccatcctgcctgggacaggaatcatccctttgtccagtgtatccacaatgtatacactcattatatacccattttataatgcccattagtcatttctattatcagatcataaaaaaacatagtacatagagggtttggtattattcatggtttcaggcattcagtgagggtcttggaaaatatcctccatgatgggggagctactgtaatactatgaaattggaaaaaccaaaatactcatcaagaggatggactatggtacacatgatgaagtattaagtatcaatgaaaaagagagagtcctacatgtccggcatggaaggatctccaggagacaatgttaaaagtttgggggaaaaattgaaagacaatacctgtaatacatatgatactagtgatgttaaatcacatcacacacacacacacacacacacacacacacacacaaatactgtatagtgtacttctacaagtacatatttgtgtattatatagagagaaggtctggaaggatactaaccaaactgtcaacagtagtttggtagcgtgcattagctttaactgtaatgtttgatgtttttgaatatgcatttatgtattgtttgtgtaatgacaaattaataaattagaaataaaataa

SEQ ID NO: 98228 - DNA, 438 bp, Homo sapiens
tagaggatcgcctcaatcgacggtttctcgtgtgaatgagggtttatgttggttaatgtggtgggtgagtgagcctagtatgaggagcgttatggagtggagatgaaatcacttggcaatgaggaaaagaggcaacagggctccttgtagacatatacatgatacaaaactactaaatatacatagaaatgatacaaaactactgatacaacatatgaatgatacaaacctactaaatatacctaggaatgatacaaaattactaatgatacaaacataaatgatacaaaactactaatgatacaaacatatgaatgatacaaaactactaatgatacaaacatatgaatgatacaaaaactactaatgatacagacctgctactgatacaaacatgaatgatacaaaactactaatgatacaaacatacgaatgata

SEQ ID NO: 98229 - DNA, 263 bp, Homo sapiens
accgggaggtccgcaacggctgcggggacaagtccgttgaggctgccaggcgagtcaggtctctctggacctcgcctgactcggctgggctgtgcctgaaattgacccagctccaccatactccttgattatgagaaaacaaggagtaagctcaaagcggctgcaatcttccggccgcagccagtctaaggggcggcgcggggcctccctcgcccgggagccggaggtagaggaggagatggaaaagtcggccctaggcggcg

SEQ ID NO: 98230 - DNA, 493 bp, Homo sapiens
aaacaatgactggcagtagagcagagactacaagttgtttaccaaaaaataaattctcttcctttcaataatggaagtgctatgtatatccatgtccaactatactgcatgtgtcccttgaggttagatgtagccatttaaataaattgtttcaatagtatgcatacaaaaggatgtatcctacttccaatctgggctctcaagatcactttctctttcaccttcctgtgaaattaagcaatttaatatattgttaatataagtattgttatattattatatataacgatatattgtatatagttagtataagtattaacatatatacttcagacttagaaaaataaaatactattttgtcttaaccattattgttttggcctctttgtcatagccactagcattcctgaatactaatatagcaaagaaagtgtctcatcttagtcccagtgcactttcaaactggctcaggtaaagatatgacatcattcct

SEQ ID NO: 98231 - DNA, 749 bp, Homo sapiens
attctgggctggagcccaaccttattttccacaactaattatctttttaatcagcctgagccctgtatgtttcctttatctcttgacttgtcactgaactctgccctacatcatttagattcatttctaatggcttgctgactaatctaacattcaggtgagtatcgttgggctgctctttatgtacgtgtatgcacaaggtgaatgcgttttccttcttttaatttcagaggtgaccgcgccatgttggggcctttgacccaatagatggacacctcatggagacagtgagcaggaaagcaaatgtaggatgatcagtatttgggataatgagttgggagaaccagaagctttgacctccggatgagaacaggaacttgaatgttgttgactgatgggatctttatgctgctgagccattagcaagatgatccctccccctctgtaaatcctatagttgctggagtagaaagtggcatctggaatactgtttggtcttgatttctgcagctctaggaaaaaaagaattttagacttgagggaattcagtgcaagcaactgaaatgattaaggagttgaaggggatcaactccaggggagaaatgttacgaagataaaatatgtgtaactctagtttggggatgtagctccaatacctgcagtttacagatctcacaggagttctaaacatttgccagcttgtcttgcacagctcccattcattccaattgtatagcttgggaagatag

SEQ ID NO: 98232 - DNA, 175 bp, Homo sapiens
caggtggctcccaggagcagagaaattcaagcaggctgttgtgtaggctgaattcccacctactgcatggagaaactggaacatggacatggaatagcatttctgcatggaatctgttttttttttcttctctggctttgaaatttgcatttcttttagtaaaataagctggttc

SEQ ID NO: 98233 - DNA, 1047 bp, Homo sapiens
ccttgccagagcagcgcatagcaggcccctgcagaggattaacacggtggctgaacaccggaaagaactggcacttggagtcgcgacatctgaaacttgctatatggaggaagcagcagagaagggcaaattttaaaaagtggaagaaaactggtatgcatattttcaaccaagtgaaaacgtcaaggaggttaaagtaatcaactgggtcaaatgctgctgagaggtcaaataagtcctcaagaataactgtagaatgtgctgggagtgcaacatcctaaaataaggaggaagtggctgaaacagcctgggctgtattcctgtctccatctagcacaagatgtccttcaaccctttagcccagcgtgcaaggtaagctgcttattggggtccctcagctgtggtgcaagaagagcatgtgcagttaagacaccatctaccgtaggcagctttctgagttacaagggaccaacacacaatgaaccctagtcttgctatcccttgctgcctgtctgtaagtacaaatttgcttcatatagcttgcttatgaatatcttatgtctcagctgattcaaagaagttggtaagcagtgcacagttaacctgcttcacacttacaattttctgatctttcacaaattactgggcattggtcttacatcactgctctttttgaacctcgggatatggtagatacaaccattcagtttatatatttttttatttttgggacggagacttgctctgtcacccaggctggagttcagtggcctgatctcgactcactgcaacctccgcctcccgggttcaagcgattctgctgcctcggcctcccaagtagctgagactacgcgcaccaccacacctggctactttttgtattttttaatagagacagggtttcaccatgttagccaggctggtctcagactcctgacctggctcacgcctgtaatcccaacactttgggaattaatctttagaactgggccattttccctaaccacctccaagctccctcccaaataatcctttgagcttccctcc

SEQ ID NO: 98234 - DNA, 764 bp, Homo sapiens
agtgtctgaaaggttttgtctgcagctcgtcctgctacatttcttggttccctgaccaggaaacgaggtaactgatagacatagacggcagagctaacccgttaggcggcttaggcctgtcctgtggagcgtccctgcaggggactccagtcagcctgagtgacgcgatccaaagaacgctcccgggtaggaaattgccccggtggaatgccttgccagagcagcgcatagcaggcccctgcagaggattaacacggtggctgaacaccggaaagaactggcacttggagtcgcgacatctgaaacttgctatatggaggaagcagcagagaagggcaaattttaaaaagtggaagaaaactggtatgcatattttcaaccaagtgaaaacgtcaaggaggttaaagtaatcaactgggtcaaatgctgctgagaggtcaaataagtcctcaagaataactgtagaatgtgctgggagtgcaacatcctaaaataaggaggaagtggctgaaacagcctgggctgtattcctgtctccatctagcacaagatgtccttcaaccctttagcccagcgtgcaagccctggttctcggtctctcctgtagtactaccagaacgtttggggtcagaaatcggatatctacacttccccgtctcccaaaagagcttccctccttaggcgtccggaggtctcttggatttttcactgctaatcccatctgtcttcactagactcacttcccacaacttgctccaggaggg

SEQ ID NO: 98235 - DNA, 326 bp, Homo sapiens
gttcaagctgttctcgtgtctcagcctcccaaatagctgggactacaggtgcgtgctaccacacccagctaatttttgtatttttagtagagacagggttttgccatgttggccaggctggtatcgaactcctgagctcaagcaatatgtccacctaggcctcccaaagtgctaggattacaggtgtgaaccactgcgaccagtccttatcacttttagaataaaactaaaaatcctcactttggccacacagcctcacagaatttggcctctggctagctatctgatttcacatttgatcattgtttgcccacctggctatactg

SEQ ID NO: 98236 - DNA, 697 bp, Homo sapiens
agcgggtgtatggaaaataaacctcattttaaatataatttatatattaaatatactttgtttcaaactgaaaaataaataagacatttgtggcctggatcttaccaaaaagattaacaatggttatgtctttttccacataaggaaagtaagaacttattttatgttttaagctcataactcttattaaatattggtaattaatacactaatgaaaaattatgtctggtttctaaggttataatattggaagacaaccaccttcaaagagaatttgaacctattctaactgattttaccttgaaataactatgcactaaaaagaaatcagaatcttacttgaacttgagctactcaggtcaaacttgagctactcagatactgtttaaattgtactctgagactcacaactcattgtggagaaaaaaatctaaccaccacacagccaagccatggctcaaaaaaagaaaagccattaataaagaagtcattaatattatcatctgtcacaccaaaggaagagggtacttaggccatgaatatattctgatacggaaaactaggttggaaaactgaggattgataattgatgataacctatcctctgttcaccatattcaataaataggtttaatttttttaatagggtacacaatttgtctaattcatgtgggcagctaaggagattgattataag

SEQ ID NO: 98237 - DNA, 349 bp, Homo sapiens
tctccaggtcctggaggcaaccgcagaaacagaacagtgcaaatgccagcatttccgcagataagcgtggcccgccagctgcaaacacccctgacatgcagccgtctgtttaaaatctggttgcccgctgcagccagtggagctcagagggctgcctggcgggtaaggactccaggcacacagcaacaagtggctgccacctcaaatcccacgtggaatatgatggggtccgagccagccagtaactccaggagggctgtagtgtgtaagttcggccagagtttgcagatataataacattggccccacgacgtagacctgtggcggctcagggttaagagacggaagc

SEQ ID NO: 98238 - DNA, 419 bp, Homo sapiens
gggcaacaatttattctatctgtgtactctgctagggatgcagtggtgagcaaacaggcaaggtctctgcccttggagaatgtaatctaactgggatgccagaatctaactgggatggtagctattaggcaagtaattctataaataaataaatcattaacaaatcatttaaagttacaataaggtccaggaaggaaaagtatgaaatttgagattgcacaggacctggggtctagacctggtcagggtggggcagggggtccgggcaagcttcctgaggaagtgttacctgggctgaaagctgaagggagaggaatgaggaagagcattccaggtaggggaaagcatgtgtgaagaggccgtgtgcaggtgaggtctattaaagaacatcgatgaagtccacgtggcttcacatggag

SEQ ID NO: 98239 - DNA, 372 bp, Homo sapiens
tttttctttcgcttgtttctttctttggcttttaattatggaggaatttaacaaaaacatgtagacaaaagtacacatggatctgttcatgtatccatcactgagatgcagaaagatgcagaatcataattgtttgccaactttgtttcatctcttttttcctacttctttccctacttgcaaaggattattttaagcaaactttagacataatatcatttcgtcataataaacttgtctttgcataaccaatatttttttccttttttctctttctttctctttcttctttctttcatctcttttttctttcttcttcttttctttttttttttttttgagagtgtctcattctgttgctcaggctggagt

SEQ ID NO: 98240 - DNA, 673 bp, Homo sapiens
aattatttcccttttaatcttctctactttctgagttaagagctgtttctattccccttttgcaaaggaggaaaccagtgtagggagattcagcttcttccctgatgtctcaccagattcagcagagcctggcagagttggtgccagtgcccctacgtgatgtgctgtggtgtctactaggctagggctatgaaagtgggctgtggactcctttttgaaatgtggccagccacaatgtcccttccctcccaggactgccttcgtgttttttttttcctggccccttttaaaaatctcatccaacattacactttggatgtgcttattgttttctagtctcctccccactaagacctccaatttctcccctgattacaactgaatttcttcatttagaaagtcagaaaccagtctggggaatactgtggaaggtggagcactagcatgactggatatgtgaaacaaaggacaagtggattctctgggggaaaaaaaccctagaaaacacataaatgcatcatgacaggacagtgactagaatgtgttcatcctaaccatgggaacagagcaaagaattaatttctaaattcgctaccaggatttaaaactgggacgatttcacattaatactgcatttctgacttttgggggaaaaaaaaaaacagttcaaaga

SEQ ID NO: 98241 - DNA, 157 bp, Homo sapiens
ggtctaatattaaccccacattcatagccgggttattgccaccaccacacaaaactctgggggccctggatccaggctaagtataattcagtgcacttctgtggggcacctactgtgttgcaagcatgatactcagataggacagcaaagacaaaag

SEQ ID NO: 98242 - DNA, 410 bp, Homo sapiens
tactaaattaaaaacaccagctaggagaacagtagttacggattagttagtctccatcataaacacagggatgtgagagcattttagcattttcatattgtaccatctgagtctgatgcaatatatgcatttacctctgaaatctttaaatattataaaacaaagtgacctagaattgaaatttgttatggcacttgatatttgatttgccccaatggcacatactccatcaaggccaaaactgtaatgaaagatgcgatttctagccaacttctagttctggatcaacagaaggaacacaggagttcaaaggtttaaatttgtgtttgagggttatggggagatatgtcatacaataattaaataccttttgtcttttataaaggaactacacaaatatttgccctaca

SEQ ID NO: 98243 - DNA, 691 bp, Homo sapiens
agcgggtgagcagtgctgaccctaccctgcgtcacagcacagtggcctcatcagaaccaagacgaccaaccttctccagagaatggacttctgttgggagactctcctctttctacaaacaaaatggccagcttgttgagaatttttagtaccatttgcagagctctccataatgtgatacagactctggcctgaagaaagcacaaaataaacatgaacaaatcataactgtgcttcagtaggatcaccgagagccaagatacagatttgtgagataactacaagttttggtatcaggatgatgctggactcataaaatgaattagggaggagtccctccttttcaattgtttttccatctatccatctgacaaaggtctaatatccagaatctacaaggaactcaaacaaatttacaagaaaaaaaaccattaaaaagtggtcaaaaatatgaacagacacttctcaaaataagacatttatacaaccaccaaacatatgaaggaaaagctcaacatcattgatcattagagaaatgcaaatcaaaaccacaatgagatacatcacatcagtcagaatggcccttattaaaaagtcaagaaacatcagatgctggcaagattgtgcagaaataggaatgcttttacactgttggttggaatgtaaatcacttcaatcattgtggaagatg

SEQ ID NO: 98244 - DNA, 593 bp, Homo sapiens
tctttaggagtatatttcaagagaatatgagatcagcctactcattcgatccggctaatttttttgtatttttagtagagatgggatttcactgtgttagccaggatggtctcgatctcctgacctcgtgatccgcccgccttggcctcccaaagtgctgggattacaggtgtgagccaccacacccagccagatccaatattttaaaaggataatcaacataaatgaatttaggttttttgtttgtttgtttgagttggagtctttctctgtcaccaggctggagtgctatggcgcgatcttggctcactgcaacctccgactccctggttcaagagattctcctgcctcagcctctcaagtagctgggattacaggcacgtgccaccacgcccagataatttttgtatttttagtagagacagggttttcactatgttggccaggatggtctcgaactcctgaccttgtgatccgcctgcctcggcctcccaaagtgctagtattacaggtctgagccaccgcgcctagccgagtttaggtttatttgaggaatgcaagatagtattacatgataatctaacgatgtaatt

SEQ ID NO: 98245 - DNA, 552 bp, Homo sapiens
ctccatgtctaatgattaccagggacacagactcatttcggaatctaaagcccaagatgccatgtgaccccgatttgtctagcctgacagactgctgctgtcttggctggctctgacctctggggaaatggcccaacctagcaccttaggtcctctcgtccttggcaaggggtgggcggacaactgacaggtgagctgccccttggataacaagaacagcggcttgaattcagaggtccctgcctgatctcttcttgcacccagtctagctgctcctccacatggttctggaagtttccatatccctggccttggaatgtaggttgttatcccagatctcttggctccaggtgagaacttcagagcttgcagcctgggttcaaatccttcctctacctctttcttttctttttattcttttttctttgaaaccgagtctacctctgtcacccaggctggagtgcagtggcacgatcttggctcactgcagcctttgcctcctgggttcaagcaattctcctgcctcagcctcctgagtagctgggattacag

SEQ ID NO: 98246 - DNA, 424 bp, Homo sapiens
cctgtgtgcattttctggggttcatctgggggacatctggctttcacaggattctataaggcacctgtgacccttcccctccccattaagaaatacttccctaagacagaatgaaaaggtacaacacagtcttgcctgaagcccgggcactcaactagtaggaccagctggtcagggaccaaagctagcacctgcaggagccccctgagagaaaacatccaggtccaagcaaaaaacagcctgactgcagtgtgctggccatggaagcaagagaaaaacagccacgctgctcatcctgcccatcctggggcgagcacagacctgggagacagctggtgcacagcagtctgcgggcggcaatataccacagggtgctcctgtctctggatccccctgccctatgtggccttacagccatcactgt

SEQ ID NO: 98247 - DNA, 473 bp, Homo sapiens
atgccaagatacattatgcaggagataccccctgcagaaatgcactaggctctccctaatcagagctgtacctcaagtcagatcctaatttgttgctgggggagagggggaagaacagggctattaataaacagcgcaaataattaggctttatgggaatttggttgttttcttacatactagatttgctctcaatcctttctcaaacgtgtcctgctcgattgccccgcagccagcggcttactgcattgattgcccactgggaagctttctggatctggaatgggagaagggctggacaacatgcttgtttgtaataacggctcttgttcactgagcatcccctaaggccaggctctgagccaggcagtgagctgacatgatttcaccgaatcaccaaagcagctggtagggtagctattgtcagttccactttaaagataaggaaactgaggatcagagaggtttcatag

SEQ ID NO: 98248 - DNA, 418 bp, Homo sapiens
gcacctcctcctctatctagtctcttagctcttctattataatttcagcactccattaaatcacttgttatttgtctaccttctctgctggattcgaaattgagaataaggtcagaaggatgacatttcttcttatctctgtacccgtggtgcctatcacagggcctggtaaacactggttttcaaatacgtttggtgaattgaatagaacttttcagagaaaatcaacttacagaagtctccaagttcacataattggaaagaaaaaggaacagattccaatcccctatcagccaccaactgattaacccaggacagcagacataggtaaactgataagaggagggactcaaagtgaagcagcttcattgtctggggaaatacctgcagttcatcatcttgcaccaagaagattaag

SEQ ID NO: 98249 - DNA, 352 bp, Homo sapiens
aaaaaactttttgaacccatgtctcattgtaggtctcctaaaggaaagtggcccaaagtccaaatacttcaataccgttcgtctctgcctgataacaaagtgttttgtttttgtttttaccctcggacaagccagtcagctgatctttgtcctaatttgttcctggtagaattgaacaagatgtttgcagaagcttcctctagtttgaaaattgtattgattttttttccccatagtaactcacagatggcttctcaggttggaaataatggtgtccatgtttaggtaccacgtgttagatcagatttgtactcatggatctgtgattattttaactttttcttgttattta

SEQ ID NO: 98250 - DNA, 526 bp, Homo sapiens
ggtttggccatgttggtcttgaactcctgacctcagatgatccatccgcctcagcctcccaaagtactgggattacaggcatgagccacagtgcccagccctaaggtgatctttctgagatgccatctgcttcaaatcttgaaaagcattgccaagcctaagtaatcagagagtgaccttgggaccacgtctcaacaatcaactggggtgcttgttatctctctaggtccttggcctctccagatccactgcagttctctagtcctggggaactgaattttaaaaggtcccctgtgacttttatgtatattaaattttaatttattcatttctaaaataattataatatctacttccccagggttcatgtatgacttgtttttatttttcatttagatgaaaaacagtgacaccaatgctatgattcctgtccgggactcctccttcctctgggcctctaacgtttagatgcttaacactgtacggtggtacattcattcattcgcttaataaaaatggatggctg

SEQ ID NO: 98251 - DNA, 405 bp, Homo sapiens
agtagagacggggtttcaccatgttagccaggatggtctcgatctcctgacctcgtgatccgtctgcatactcggacctcccaaaatgctgggattacaggtgtgagccaccgcacccggcctggtaagcatctttagacatttttatagcaatttgaaacagtaatttttgggctgtcaaaaaagtctggcttatatttttatgtctttttctagtcaatgattttgaaattttattttacaagagtattggtctgcaacggtttagaaagaaagatacaaactggcccttccatgcagtctgagaagccctgtattggaagtttccttggcctaacaggagagaaagacttctgacacacagcttcaacaatgacctgattaacctaaaagtaggtgcagcgg

SEQ ID NO: 98252 - DNA, 254 bp, Homo sapiens
agtagagacggggtttcaccatgttagccaggatggtctcgatctcctgacctcgtgatccgtctgcatactcggacctcccaaaatgctgggattacaggtgtgagccaccgcacccggcctgatgaaaaacagtgacaccaatgctatgattcctgtccgggactcctccttcctctgggcctctaacgtttagatgcttaacactgtacggtggtacattcattcattcgcttaataaaaatggatggctg

SEQ ID NO: 98253 - DNA, 513 bp, Homo sapiens
tctccccagaagcatcaatatttactgaattagagtatttcattacctgttataaaaaacaaacaaaaaaaccttccattatactaatttataaaggaatcaaaacaaaatgggttggcgggtccaggcacggtgtctcacttctgtaatcccagcactttgagaagccaaggtgggaactcgaggtcaggagttcgagaccagcctggccaacatggcgaaaccctgtctctaatacaaaaattagacgggcctggtgacatgcgcctgtagtcccagctactcgggaggcagaggcacatgaatcacttgaacccaggaggtggaggttgtactgagccaagattgtgccactgcactccaccctgggagacagagtgaaactatgtctttaaaaaaaaaggcggggtgcagtggcacacacctgtaatcccagcactttgggaggccgaggcaggtggatcacctgaggtcaggagttcacgaccagcctaacatggtgaaaccccatct

SEQ ID NO: 98254 - DNA, 911 bp, Homo sapiens
gtttccagggactccagatgatggcacgtggtagaaccatctccttttaaaggtatatagactgctcacttctgggagatggaaggcttaaaattggctataagaaaggaaggatacacttattatctcaggggataaagaattaatagacaaagccttgttctatctccttggggtcatggctccaatgagcttctgaggaccacaaccatctatgttccatgtgtgacatcaggaagaaggggtccccttcaagctctggctcctttgtacttacaggatgggctatcacgatcccagagaaaacagttgacattataaaactgcctttcgaaccacatgattcagcataagaacatgagagatccagctttcggtgtcactatcactgccggcttttctggccttgaaactggccagaagtccttctgcttattaccggcttggattgctagaacttcaaaacaaagtttcaagtgctagaaattcttagtttctctctcatacatactattttgaattttatatgaattagcttttagattcaggttacaaattaatccaggctcattatgtaattaaatgtttgattaggagcattaattaacatattacacagaggcatataattttatgagacaaactctttaattccaatgaagagattcaccatggtaacaaattatctgacccacccaattcaatatgtaattccaaatgatttttcaaattaactaaaaatgctgtcattattaaataggtatattacaatgtatgcactgcactgtagagattttttttaaatacttaggcgaaagatgagagaattctaaatatgctttcataaatacacaaagtaaagatcaaggctgaaattttgaaaaaggataaaaatgttgacaattttgttg

SEQ ID NO: 98255 - DNA, 883 bp, Homo sapiens
gtttccagggactccagatgatggcacgtggtagaaccatctccttttaaaggtatatagactgctcacttctgggagatggaaggcttaaaattggctataagaaaggaaggatacacttattatctcaggggataaagaattaatagacaaagccttgttctatctccttggggtcatggctccaatgagcttctgaggaccacaaccatctatgttccatgtgtgacatcaggaagaaggggtccccttcaagctctggctcctttgtacttacaggatgggctatcacgatcccagagaaaacagttgacattataaaactgcctttcgaaccacatgattcagcataagaacatgagagatccagctttcggtgtcactatcactgccggcttttctgcttattaccggcttggattgctagaacttcaaaacaaagtttcaagtgctagaaattcttagtttctctctcatacatactattttgaattttatatgaattagcttttagattcaggttacaaattaatccaggctcattatgtaattaaatgtttgattaggagcattaattaacatattacacagaggcatataattttatgagacaaactctttaattccaatgaagagattcaccatggtaacaaattatctgacccacccaattcaatatgtaattccaaatgatttttcaaattaactaaaaatgctgtcattattaaataggtatattacaatgtatgcactgcactgtagagattttttttaaatacttaggcgaaagatgagagaattctaaatatgctttcataaatacacaaagtaaagatcaaggctgaaattttgaaaaaggataaaaatgttgacaattttgttg

SEQ ID NO: 98256 - DNA, 424 bp, Homo sapiens
aaataaggctacataattaataaatatagtgcctataaagtttgactttgtttttcctatattgagtccttttatgttttatcatcttaatatctatataatacaaaacaaagttatctgatttacttaatcaataccccattagtggatggtttcattttttctagacattgctattataaaatatgttgccataaatagaatatgtgagtttctaaagattggggctgaatttccaaataataaatctaaaaaaaaaaactactaaatttttcagaaaccaaaattaaataattcattgatttaaaaaagtattcattgagcactactatgtgcgtgtactgttctagacacatgagattcattggtgaaaatagaccccaaaaaggcaaatattccagcccctgtgctgtttctgtgctat

SEQ ID NO: 98257 - DNA, 431 bp, Homo sapiens
ctctgactttctctattcccttaacaattattcctgagttttaaataaatgcatatataatacatatataacaacggcagaacaaaattaatgagttttttttagagtactttaggaaattaattgtaattttatagtcttttaaaacttttaacagtttattagtttcaaatattagtatgtagtggaaaaaatgctgaattggaatagatgacctggctttgctgctatctgattatgtgacacttggcaaggcatttatcctttctgtgtctaagttttttcatatgtaaaatgagaattttaaagtagataaatccttgtgataccttctacctctaatattctattattttctttggagaaaattatgttgtggctttaatttcataaaattcaaattctttattgttaactcttctttgttatta

SEQ ID NO: 98258 - DNA, 268 bp, Homo sapiens
agctgggaagacatacatgagcatgcagcaataaagtgcacaaaccgtcacacaggtacaaggtgcttagggccatggcagaagtagtatctacttaccctggaaccctggaggaggcttttgagctgaatctcagatgagtcagactggagcaggtggagcctgggcggacggtctcagcagagggagtcatctagcaaaggggtgtgctctgggaagggcaggaggattctgtggctggagctcaggcttcaggttcagtgtggag

SEQ ID NO: 98259 - DNA, 320 bp, Homo sapiens
cacatcccctcagcttcatgggtacaatatatactatttgtatacatagttaatagttatacaatgtaataatttctcatccctcacatcccctcagcctcatgggtacaatatatcctattgtacccacgtacagtacagtagtatatattgtacccatgaggctgagcgggtatgagggatgagaaattactacattggtacaatatatactactgtacccatgagttgtacccattaagtaatttctcatcccttacaccccctcagccttgcgagtcttcactattactccatcctctatgtccatgtgtacatat

SEQ ID NO: 98260 - DNA, 297 bp, Homo sapiens
tttaagtattatgctttcagctctgtttcaaacttagtctttatatctctggttaaatatttgggttggcatttaccagggtggtctgtcaatgctgtactttcatgcaaggccactttaataaatgatcttttaaaatttcaaaatattactggatttatgcctaaaatatggtggtggtttgataaatgtttactgaatttgtgcatacatactatatgtcttcctacaatttttgtatttcctctgtgtttctattagccaatgtatgtaccaataaatagcacaagaatccta

SEQ ID NO: 98261 - DNA, 205 bp, Homo sapiens
caaatgtctgcaaaaaatatccatattgatggatcctggctcctcagaatctgaggtgacagcagcttgcagaggacactgctcccccaacactgccttccaagggagacatgccctaccccaaggcctcccttgtcccctccctcctctgacagtcaggtccagggggtcctggagagggcactggcccaccctccacacatgt

SEQ ID NO: 98262 - DNA, 223 bp, Homo sapiens
cctgtaccgtggttcataggccaaaatgagtccgcaggggcgcctcttccaaaagtggacagaggcgtgcctgggggagcaccatctctccccgcatcctaggtcatccactgccttccaagggagacatgccctaccccaaggcctcccttgtcccctccctcctctgacagtcaggtccagggggtcctggagagggcactggcccaccctccacacatgt

SEQ ID NO: 98263 - DNA, 338 bp, Homo sapiens
gtgttaattgagaggtgttgattgagaactgaggatttatattttcttaggggactcccagaactcaaaagcctttgtgaccctgcagtggaaaggagatgacaggtggtgatattgatcattctgggatgggaatccctacccctttcaaggcatgtgacccagaaagctgcccacttttactgttgatgacactggctctgcaccagactcacagagaaaacccagcggcaccacaaaaagctcctgcaaactgcacccaagtgcctgtgagtccagctcttcacccttctggagttggcatgccatgccaaggtccatgcccttgccagctttag

SEQ ID NO: 98264 - DNA, 758 bp, Homo sapiens
ttgagcaccatacgagcccctggttgctgtgagtatgttggaaaaagccagggggatgcctgtgggtgctgttaaggtggtagtgacactcaggctttgcttcccagaagtccctgggcagtgcggagcttctccccagatgacatagagtgggcagttccctgtgaccgtaaccccaaaagaactgatcttccaggaggaatcatcactcactaccacccccactgatacacatcactcatatgcaaaacacacctggggatgtgccctcaggtaccttgttcttatcaacacttgttaccagtctaagggaacttgcttttcctccctcaagacccacgcagagaaaattgaagctgccagaaggtagaaatgatgagggatagatacagattcaaggaggggaggaaggataatgtccaaccgtatgctcgcttgtgtattaccaaacagcattcttagaaaaaacagattgtggccgggcgcagtggctcacgcctgtaatcccaacattttgggaggccaaggtaggcagatcacttgaggtcggcagtttgagaccagcctggccaacatggtgaaaccctgtttctactaaaaagacaaaaattagctgggcatagtggcaagcgcctgtaatcccagctactcgggaggctgaggcaggagaatcgcccgcacccaggaagcagagtgagctgagatcatgccactgcactccagcctgggcaacagagcgaggctgtctcaaaaaaaaa

SEQ ID NO: 98265 - DNA, 2128 bp, Homo sapiens
ggcacgagggtagtgagcggtgtttcaggatgtgagggcccgcaggagccgagtcaggctctctccactgcctgcccgccaccgtgcaagctctggccggcgctgcccacagtccccatggtgggcagcccccgcggcggggacccctgatcggcagcggcatgccagggaagcccaagcacctgggcgtccccaacgggcgcatggttctggctgtgtcagatggagagctgagcagcacgacggggccccagggccagggcgagggccgcggcagctctctcagcatccacagcctccccagtggtcccagcagccccttcccaaccgaggagcagcctgtggccagctgggccctgtccttcgagcggctgttgcaggacccgctgggcctggcttacttcactgagttcctgaagaaggagttcagcgcggaaaacgtgactttctggaaggcctgcgagcgcttccagcagatcccggccagcgatacccagcagctagctcaggaggcccgcaacatctaccaggagttcctgtccagccaggcgctgagcccagtgaacatcgaccgtcaggcctggcttggcgaggaggtgctggccgagccccggccggacatgtttcgggcacagcagcttcagatcttcaacttgatgaagttcgacagctatgcgcgcttcgtcaagtccccgctgtaccgcgagtgcctgctagccgaagccgagggacgccctctgcgggaacctggctcctcgcgcctcggcagccctgacgccacgaggaagaagccgaagctgaagcccgggaagtcgctgccgctgggtgtggaggagttggggcagctgccacccgttgagggtcctgggggccgccctctccgcaagtccttccgccgggagctgggcgggactgcaaacgccgccttgcgccgagagtctcagggctccctcaactcctccgccagcctggaccttggcttcctagccttcgtcagcagcaaatctgagagccaccggaagagccttgggagcacggagggtgaaagtgaaagccggccagggaagtactgctgtgtgtacctgcccgatggcacagcctccttggccctggccagacctggcctcaccatccgagacatgctggcagggatctgtgagaaacgaggcctctctctacctgacatcaaggtctacctggtgggcaatgaacaggccctggtcctggatcaggactgcaccgtgctggcggatcaggaagtgcggctggaaaacaggatcaccttcgagctggagctgacggcgctggagcgcgtggtacgaatctcagccaagcccaccaagcggctgcaggaggcgctgcagcccattctggagaagcacggcttgagcccgctagaggtggtgctgcaccggccaggcgagaaacagcctctggatctggggaagctagtgagctcggtggcggcccagagactggttttggacactcttccaggtgtgaagatctccaaagcccgtgacaaatctccctgccgcagccagggctgcccacctagaactcaggataaggccacccatccccctccagcgtcccccagttctctggtgaaggtgcccagtagtgccactggaaagcggcagacctgtgacatcgaaggcctggtggagctgctgaaccgggtgcagagcagcggggcccacgaccagaggggccttctgaggaaagaggacctggtacttccagaatttctgcagctgcccgcccaagggcccagctccgaggagaccccaccacagaccaaatcagcagcccagcccatcgggggatccttgaactccaccaccgactcagccctctgacagctacccaacatggagggatggcgttggcagtgccagcctccccagcctgtgccaagcttcaacaggggcaagaggaggggccggcccctcctcaggaagctggtatgagtaaggccttgagggtgcaggcaggcagccctgtaccccacccacatagactatactgtacatacagattttgcagtaggcttggggcagctgggtttgtccttgatgtatgatactgttattataataattattattattctgccaaaaaaaaa

SEQ ID NO: 98266 - DNA, 390 bp, Homo sapiens
  misc_feature (14)..(14): n is a, c, g, or t
  misc_feature (70)..(70): n is a, c, g, or t
  misc_feature (78)..(78): n is a, c, g, or t
  misc_feature (102)..(102): n is a, c, g, or t
  misc_feature (107)..(107): n is a, c, g, or t
  misc_feature (113)..(113): n is a, c, g, or t
  misc_feature (373)..(373): n is a, c, g, or t
cccgggtaaggggngttgggaaaaaggggggaccttcaaggattgaagaacaacaaccccccaacaaggntggcaaanccgccctttggtcccccttcaaanaaagncttcancccccccaatcccttgcagccaggccacaatgggggaggtgagtccagccccttggaacaggcttgcccaacatggagggatggcgttggcagtgccagcctccccagcctgtgccaagcttcaacaggggcaagaggaggggccggcccctcctcaggaagctggtatgagtaaggccttgagggtgcaggcaggcagccctgtacccaccaaagcatctgtaataagttttgagtgctggtagctggttgcctatttntcgttttatatcatacg

SEQ ID NO: 98267 - DNA, 2393 bp, Homo sapiens
ggcacgagggtagtgagcggtgtttcaggatgtgagggcccgcaggagccgagtcaggctctctccactgcctgcccgccaccgtgcaagctctggccggcgctgcccacagtccccatggtgggcagcccccgcggcggggacccctgatcggcagcggcatgccagggaagcccaagcacctgggcgtccccaacgggcgcatggttctggctgtgtcagatggagagctgagcagcacgacggggccccagggccagggcgagggccgcggcagctctctcagcatccacagcctccccagtggtcccagcagccccttcccaaccgaggagcagcctgtggccagctgggccctgtccttcgagcggctgttgcaggacccgctgggcctggcttacttcactgagttcctgaagaaggagttcagcgcggaaaacgtgactttctggaaggcctgcgagcgcttccagcagatcccggccagcgatacccagcagctagctcaggaggcccgcaacatctaccaggagttcctgtccagccaggcgctgagcccagtgaacatcgaccgtcaggcctggcttggcgaggaggtgctggccgagccccggccggacatgtttcgggcacagcagcttcagatcttcaacttgatgaagttcgacagctatgcgcgcttcgtcaagtccccgctgtaccgcgagtgcctgctagccgaagccgagggacgccctctgcgggaacctggctcctcgcgcctcggcagccctgacgccacgaggaagaagccgaagctgaagcccgggaagtcgctgccgctgggtgtggaggagttggggcagctgccacccgttgagggtcctgggggccgccctctccgcaagtccttccgccgggagctgggcgggactgcaaacgccgccttgcgccgagagtctcagggctccctcaactcctccgccagcctggaccttggcttcctagccttcgtcagcagcaaatctgagagccaccggaagagccttgggagcacggagggtgaaagtgaaagccggccagggaagtactgctgtgtgtacctgcccgatggcacagcctccttggccctggccagacctggcctcaccatccgagacatgctggcagggatctgtgagaaacgaggcctctctctacctgacatcaaggtctacctggtgggcaatgaacaggccctggtcctggatcaggactgcaccgtgctggcggatcaggaagtgcggctggaaaacaggatcaccttcgagctggagctgacggcgctggagcgcgtggtacgaatctcagccaagcccaccaagcggctgcaggaggcgctgcagcccattctggagaagcacggcttgagcccgctagaggtggtgctgcaccggccaggcgagaaacagcctctggatctggggaagctagtgagctcggtggcggcccagagactggttttggacactcttccaggtgtgaagatctccaaagcccgtgacaaatctccctgccgcagccagggctgcccacctagaactcaggataaggccacccatccccctccagcgtcccccagttctctggtgaaggtgcccagtagtgccactggaaagcggcagacctgtgacatcgaaggcctggtggagctgctgaaccgggtgcagagcagcggggcccacgaccagaggggccttctgaggaaagaggacctggtacttccagaatttctgcagctgcccgcccaagggcccagctccgaggagaccccaccacagaccaaatcagcagcccagcccatcgggggatccttgaactccaccaccgactcagccctctgacagctacccaacagtccaggacagctgcatggcacccggcgggccgagcatgccatgggtccgctctgcatgccctgtctgtgccatgagtgtccctggccccttcctgccatgggcaggcccgcaggaagagccggtaggggtggaaaggggactcagatgagacacaccccacagctgccaccgccttgtccctcaacaagctcacccccaatcccttgcagccaggccacaatgggggaggtgagtccagccccttggaacaggcttgcccaacatggagggatggcgttggcagtgccagcctccccagcctgtgccaagcttcaacaggggcaagaggaggggccggcccctcctcaggaagctggtatgagtaaggccttgagggtgcaggcaggcagccctgtaccccacccacatagactatactgtacatacagattttgcagtaggcttggggcagctgggtttgtccttgatgtatgatactgttattataataattattattattctgccaaaaaaaaa

SEQ ID NO: 98268 - DNA, 369 bp, Homo sapiens
tgggcaacatgagtgagaccctatctcttaaaaaaaaaaaaaattgaagaggagataatactttcaaccttattctatgaggccaggattaccctgataccaaaacagataaggacccaagaaaagaagaaaagtacaggccagtattattggcgaacatagatgcagaaatcctcaacaaaataccaggaaaccaaattcaacaacacattaaaaagatcattcaccatgatcaagtgaaattcattccagtgatataagagaatgattcaacacatgcaaatcaataaacatgatatatcacattaacagagttaacaaaaaccacatcattgtttcaacagatgctgaaaaatcatttgataaaat

SEQ ID NO: 98269 - DNA, 814 bp, Homo sapiens
aaactctgccaatgtgtcagtggtggacctgacctgccgtctggaaaaacctgccaattatgatgacgtcaagaaggtggtgaaccaggcatcggagggccccctcaaggaattctgggctacactgagcaccaggttgtctcctccgacttcaacagtgacacccactcttccatcttcagtgagggggctggcattgctctcaacgaccactttgtcaagctcatttccttgtatgacaatgaatttggctacaccaacagggtggtggatcatggtccacatggcctccagaaagtaagacccctggaccaccagccccagcaagagcacgagaggaagagagaggacctcattgctggggagtccctgccacactcagtcccccaccacactaagaatctcccctcttcacagtttccatgcagaccccctgaagacggaggggcctagggagcctgacctcgtcatgtaccatcaacaaagtcccttgtgctcagccaataataataatacaggtataaagtattattgaaaaatgctaagagagtggatgttgtttgtagcacaaaatgcaactctactaggtaacgcatatattaattggatagacttagtcatttcacaatctatagataaatcaaaaccttatgttgtacatgataaatgtgtataattttatctgtcaattaaaaataacaaatttactaatggtaatctaataaagtaatgtttaagcaggacattcagcacttataatttctgtgtgtaaatatctaaaatttttcatcttgaatgatacagagttaccacg

SEQ ID NO: 98270 - DNA, 229 bp, Homo sapiens
ctcactctgttgcccaggctggagtacagtggtgtgatcaaggctcactgtagccaactaccaggtttaagcaatcctctcacatcagcctcctgaatagctgagaatataggtgggtactaccacgcttagctgtttttaaagtttttttagagatgatggtcgggcgcagtggctcatgcctgtaatcttagcactctgggaggctgaggcaggcagatcacctgag

SEQ ID NO: 98271 - DNA, 307 bp, Homo sapiens
tgtgcccggccacaccaacaccttttggatgtggagcctctccgtgaggctagtgctccttcccttgtctctctctggaaagtgaggcagtggtcaccttctgagctctttctttctccaattatgttcagctcttctaggctctagatcttgaaaatcacaatttactttctcttttagaaagctaagcttttcctaggagctttaagatcacatttagttgttcaaaagataatctgtctctttctcagccgttccttgaatgaaactgagggcaggagctgcctcagggcttgtggtgggacag

SEQ ID NO: 98272 - DNA, 265 bp, Homo sapiens
gagaaagacagccaaaagttttgacaaaggttttggccatcaggccctttcgagatgatttccccacatgagctttgctgacagctcaaacccaactgtgggtcatgggtgcaaaggagccctttgccgggttgagttcatcttacacccttgcagacggttccttccatttgacctgcaatgagaagaccacaaacagctatagccacactagaatagagccccttgttgggggatacatagttctctgttaagaaaacatcac

SEQ ID NO: 98273 - DNA, 331 bp, Homo sapiens
tttcattatgcaaatgatttccctacctggccggtgccatgttgcctgcttctttactgcacacatggttgacaaagacaagggaagaggggctgggcaccgtggctcacacctgtaatccctgccttggcctcccaaagtgctgggattacaagtgatccacctgccttggcctcccaaagtgctgggattacaggagtgagccaccgcacttggcctctgttacacttttaaatgcacacaccctatgttccagcagcccaacccctggcattttcttctaccaaaatactctcatgtgtactatgtagtaagatatttgttgcaatgt

SEQ ID NO: 98274 - DNA, 370 bp, Homo sapiens
tctctagttttgcatgtggctgaatggtggaatgtctgttttcttttctcaggcaaaattagctgcttggtgctttccccagttgttagggttgaatgagcctcataaagtacaagaatatgtcctaacagtcgtaaacaggaatgttgtgggatgtgcaaaaatcctcatgttagtgacaatttttaattacatgctctgcatcccagatttagtgagtctatttctgatggatgtcagctgctgcctgccttacaaaagtctcgaaacctggagggctttaaatgtaggtggaggctgaggtacctaggggtttgccgagtgccaaagactggctttaactccattgccgaggcaggtgctgacatat

SEQ ID NO: 98275 - DNA, 313 bp, Homo sapiens
ggttgaatacagtgtacataacattgaagaatgtttccaattctaaaatttggaaggatggtgtttaaaggcactgtcgttagttatctcaacaggtggtagctggtaattgataattatatttaaagtatgtgtattcattgtggttggtagtaatacagcatttttatctgcagatctcaaagcatgtgtgaataaatatgcattatttccctattttaagtagccagagactcactgaacgttaattagatataagcagacagagaaatttcatgtccgctgcttgcttgatgctactaaaaaaaaaaaa

SEQ ID NO: 98276 - DNA, 393 bp, Homo sapiens
aaccccctctctaccaaaaatacaaaaaaattagctgtgcatgatggctgacacctgtaatcccagctacttgggaggctgaagcagggagaattgcttgaacccaggaggcagaagttgcagtgagctgagatcgcaccaccacactccagcctgagccacagagcaagactccgtctcaaaaaaagaaaaaaagaaagaaaagaaagcaggcattagccacctatgtagcagatggaaataaaccaatgctggcagtttgcctgctagaaatatactgaatgcagctgggcacagtggctcgtgcctgtaaacccagcactctgggagaccaaggcaggagcatcactacctcgagaccagcctcagcaacacagtgagaccttgtctcta

SEQ ID NO: 98277 - DNA, 213 bp, Homo sapiens
tcaaaccaaacacttaagttttgtgcatttattatttggaatatatctcaagagaaagcagttgattatttatcacagtgacagcagagagaaaggacaaaggttatcacaaatgtgattagcaagaagacaagagatgtgaaggatagacaatagaattaaaatgttgaataattgatcttctcaaataaggtaacaggagaagtacaacag

SEQ ID NO: 98278 - DNA, 488 bp, Homo sapiens
ccgaggccccgccctcattctctcccagctttgcaaaccgtcagcacaggaaagaggatgaacatggatgtgagtgaggaaaacaagagtgtgtgcttagctttcgtgtgtggctttgcatctcactggccctgcccatacagacccggcttccggtggctcctaaccaagaatgttcccagtggcatcctattttcaaaacaagaaactcttggacaaataaattcaagtttctatgtaaaattctgaattttatgtccagaaaaccccccaaaagacaatatcatagtcatcacagttcaattttttttttttttgagacaagatctcactctggcacccagggtggagcgcagtgatgcaatcatagctcactgcagcctgcaactccttggctcaagtgatcctcctgcctcagccactcaagtagctaggactaaaggcacttgccactgtgcctaggctggtctcaaactcctggcctcaag

SEQ ID NO: 98279 - DNA, 338 bp, Homo sapiens
tgttatgtatatgtgcatatacatgtttttgtatatgtgtgtgcgtatgtgtgtatccccacaaaaataaagagaatgccataaggtccattagcagacaaatattttgcgtaaatgtttggaaggctaacagaacaatagtgggtgaagctgggcagaaaatttgcagactagggaatcagtgttgcagctcagtagaaaacttatcttctcatcacaatcctaggatgtgtcatgatttggacatatcatatggcagaaaactggaatgagacatgagggtgaactagaataaagtagaatggaagtctgtagctccctttcccatgctgtgtttg

SEQ ID NO: 98280 - DNA, 288 bp, Homo sapiens
aaaataaaaattatgcaattctgcagggctttttctccacctatgagcagcttattttactatctaaactgctgtccaatagagtagccactagctacatgtagctaattataattaaataaaaaactcagtttctcagtggaataaaccacatttcaggtactcagtaaccacagtagccacaaattggacagcacagatatggaacacttccatcactgccaggagtgttattgggcagtgatgatatagaactcttttgcagaaaattttttttcttgtgccaat

SEQ ID NO: 98281 - DNA, 406 bp, Homo sapiens
agaccatctgcatagagggcttagcatagtgactggtacttagcaaatgctccataagttatgattgctggcactgacatgctctccagagtggccctcgggacaggggccctcagccaccaaatcctagacagggctgcctctgacagaggtgcaggctatgactgcatggctccagggcatgccactcaccctgcagtacccctggccttgggtggttgttaccacgcttctccaggaggtggcggtaaagctcttttttttttttagttatctttgttttctaggcaaaagagcagagtgaaagcatctgtctgctgatttctccaccagtctctccctgtcgacctgcacagggacacaagtgcaatccaatactgagacaaggactactgtggctctctag

SEQ ID NO: 98282 - DNA, 774 bp, Homo sapiens
tggggtgggcctggctttagaacccttaacccataaggaccacctgtaaagctgctctgtggggggtggggaagatgtcctcagcgagacgccgagataggagggctggttgtctgggccacagcagtggcgtcgatttttagggacctgatctcagggacaagaaattgtctcagaacccccgggaggaggttcagatgagggtcaggtcgtggctcaagagagctggacccaggcctgctgtgcaggaaggtgggaaagaagacaaagggcccattgtttccgcctctcaggacactgggcctcgagtctgctctcccgtttcatgggcatgaccctgggaaggatgcccagcaggaggagtggcccagactggccccaactcttgtttccagcacagtgtgctcagtgggacagcggacccagcccagtctgtgacccggagccgctggcggctgggctgggcagggagagtgcagcccaaagccgagaagccagacctgctcaccccattcagaagagctgcctctcccacccccagcccactgcccccagagggctactgggaacccggagggtcacctgggctttccaggggtagacaaaaagtagaatttcccagtgctgttatgtgaataattggggatgattgaattcttagggcttttcttactgcccttcacccacctcctcttaccccatgatgggccctgggagcaaaaaggagataaccacagtgtcccttgcccctctgccacgccccacaccaccacg

SEQ ID NO: 98283 - DNA, 100 bp, Homo sapiens
aaatcagacacaaagagcatatattctgttctcttcctccatttgcaagtttccaggcatggggtccactcatgtgtgatacagccctgcctgtgacaga

SEQ ID NO: 98284 - DNA, 335 bp, Homo sapiens
ctgcccattctttcactttaaaacccatagtaaatctggcatatcttttcatcttgatgatatagacataagtagttgagctgcttctttagttgacagttataagggttataaaactgatatttacttcatatagccgtgttaaattactttcaacttttctggtccataatctaccaagttgtgaaattttgacatgttagccctcttgtgtactgatagtatacctttaattcataagtctagaatcactactgagtggcagagtaacattcttctgtctcatcatattttctaaaatggagtcattaactgccacatattcagggagatac

SEQ ID NO: 98285 - DNA, 335 bp, Homo sapiens
gccgtggaggcagagagagcagctgcaggagcttggctccacagaattcacctccacaacaaacagggccatgcctgtggctcacttgggactggcaggaggaccctgatcctatgtaggtcctatgtgcagcagggggaccgcaacaccccagcacagtggctgctgcctccacactgtgtctgcaaacagatactccaggatctcaagtgtttcattttttttttttaatccaaaaacaacttaccatccaacccatttcagataagttggggagcagtggcgattccagctttaatggttgagttgaaaagggacacctaagccgggtgcgg

SEQ ID NO: 98286 - DNA, 368 bp, Homo sapiens
ttgttattatcctaacagggccaggaccagctacgttatttgaggtgcccagagcaaaataaaaatacaggaccctttgttctaaaagtattaagaaatccagtatggctactatagagcattaaaccaaaaacagggctctgtgtgactgtgcaggtgacatgcccatgaagccagtactggacaaagctaaggtgaagacctatttaaaaaactggataatagattccatccttcaaagaactgaccataactaagaacatgggcaaatattcagacagttttattcgcctaaaaacaacactgatgctctgtttgcattattttttatttatttattttttgtttgtttgtttgtttgtttgttt

SEQ ID NO: 98287 - DNA, 248 bp, Homo sapiens
cttgggacatatgcccagtggataaaggagaatgtgtaagtgcactaatagttgtaaaagccaccaggatatcatggctctagaatccccctcagtgcctaccagcctccccaggcaccatccaacaccagaaccacaaccacagcactggggggacagagccctctgggatttctgattcatctctattagtttttaagatccaaggaacaccttttaggtttccttggtcttgttcccgtcaatgt

SEQ ID NO: 98288 - DNA, 292 bp, Homo sapiens
tgcatgcctgtaatcccagctactcgggagactgaggcgggagaatggcttggacctgggaggtggaggttgcggtgagctgagatcgtgccattgcactccagcctagacaacaagagcgaaactccatctcaaaaaaaaaagaaaagaaaatagctgatttactgtgttaataatatagcccagcctgggcaacatagggagaccccgtctctacaaaaaattttaaaaatgagccatgtgtggtggtgcacacctgtaatcccagttactctggacagggctaagttgg

SEQ ID NO: 98289 - DNA, 392 bp, Homo sapiens
tttatatgtgtgaaatacaagtactttcttttttttttttttttttttttgagacggagtcttgctctgtcacccaggctggagggcagtggcgcaatctcggctcactgcaagctccgcctcccgggttcacgccattctcctgcctcagcctcccgagtagctgggactacaagcgcccacccccacgcccggctaattttttgtgtatttttagtagagacggggtttcaccgtgttagccaggatggtctcaatctcctgacctcgtgatccacccgcctcggcctcccaaagtgctgggatgacaggcgtgagccaccgcgccaggccacaggtactttcttgtatctctggtttgtacctctatggttacacattgcaaatatttc

SEQ ID NO: 98290 - DNA, 509 bp, Homo sapiens
cgtaggtactttgaagatgtttccacttcccttcgaagatgttcaatgtccgtacatagaatgaaaggtgccaccttctccagcatgagacatatccccatgtgatcccttaccacgcagactcctggctgagttaggaagaaagaatagaagtcaatgcattccatttgttttcaaggcacacccaaaaagtatgaacttagatatatcacagagcttccaatttacctgcctgtatttacaaaataagtgtatgatttctcccgaaacattattttttgcaagttacatgccaataaccaccactgaacataagctgatatttttgctgaatgaaggattgtgaattatccttgtagctttctttgacttcattacacatttcaattacttctctaaacactgactgccgccataaaatatctttagttcttttcccctatgaaatgtgctgccaataataatattttactagaaaataatgcaataaattagcatgatcacaacct

SEQ ID NO: 98291 - DNA, 741 bp, Homo sapiens
cggctgtcgaaagaggagcacgacgtgaacttccaccgacaatcgtttaaatactgcaggcgaaggacgggttcttattgttccttcaggcaaaccggcagctgagtccagcttgtgaacttgaacttgaacttgctgaagaagctcccggcggccctctgctggccgccgcctttgccagagggagaggctggagtcaccctgttggaacccatttctggggctggcacctgttgggctgcccggccgcgcgtacctggtcccatcgggggctctgcccactccgctgatgacgcgggtagaagggaggccgcagggacactctggggggactgtgccgggcgggcaccccccagctgctcactgtggggtgcggcaccgaggcctggttgggctgcaaggagaccgactgggattcccgggctggtggccggggagacggggtagaggtgagaagcaagagctcaggaggcctcaggccccagcgctgtggggctgccgttgtcgttctgggtggaggtctggccaaaccggcttttgccccgagtgaggaattcctgctcattttggtgttagtggagaggtcgctgttcacagcgggggtggggttcgtcccctccaggctagtagggagctggctggtgcattgctgtgttgctgcccttctgccctgtctcctgatcctgttcagactctgggtggctcctttgagtcttctcaggccgtgaaagatgggaaagg

SEQ ID NO: 98292 - DNA, 244 bp, Homo sapiens
ccgccccagcctcctgagtagctgggactacaggtatgttccactgtgcctggcattctgagctttctttatttggcttttgaaaatgactcaggtcccacctaaagttatcactcactacaagaagaattaaaggaaagcaaatgtctaaaacatctaattcacataagagatcagtggtttgccagtgcagaggaagcttaatagaatgaattaagactctaaaggtaattctaaacaaact

SEQ ID NO: 98293 - DNA, 756 bp, Homo sapiens
gatttatgtgtaggatttactttgtaatttggggctgagaagagaaacctataaatttctttttctcttttttgatgaacatttttttatctgacattattctctttaaaaattgtgggccttcttgtttaatgttttaaattgtttttactacctcctcacatgtatagtagatatattacaatattatattgcaatatttatatatagtgggaaggcaaaataaaattgataattcaaaactgcaaaaatggtcactgctggatggactgcttgttttaggaactgttttgatgaatgtgtcatttagttgggtgatttaaaaaaatttggaggcaatgcaaccttacagtttatgttttactgggaaagaaggagcattctagcaccattgacttgtaaatgcagtttatcaatatttcataatttgcatgactttcttttacaattacctagcaacagttcttctctgcagtgttccttcaaaaaaccccgcagggacagacacagtagagtgaccaccaaaatagcagcaataacagttatgatcaatattctaaaatatgtaaaggtcccaactcagggagacattaaaacctaaatgccttctggtttccagatctgtataattaaattctgactgatgaattttcagcaatgcaatggagctagtctctcttctttaagagattagggaactagaatttggtttcatctgaaatttcattctgaaactaggtgaattttgctttctta

SEQ ID NO: 98294 - DNA, 382 bp, Homo sapiens
gattaagaggccagctactaaaacatttccagtgcagaaactgcgaagtggaggagcagaactggacgggagctctgagaccatttcactaagtcccctttattttacggaggagaacttgaggttctgcagccaggtgccccacctctcagactaggcttcctaagaggttctaacatgcttaggagctcaaccatccctgaaatggctacaaaatcccactctcctgggactgactttatggaaatattctgaagttagaaacaagatggtaactctccccacagtcacagccccggaaggcgggcagctgagacctggctgggggccaggaaggggtggttccagcttcagtcattcatgctgacccagctgcccccga

SEQ ID NO: 98295 - DNA, 266 bp, Homo sapiens
ctggcctgctgggctacgcatccaccccccaccccccagctgggattcttgtgttctctgtgtttgaatgaggctgtgcatacaggagttgtgaatgcaggtcaccccaggaccctccattcattaaggagagactccctgcgatggcaaggaaagagcgggaactttgcatttactgaacttcagtttactcccagctccacccccagcctgtagtgtggcttcagagatttacttcataacctctctgtgcctctgtttcccta

SEQ ID NO: 98296 - DNA, 811 bp, Homo sapiens
agcggagaatgtcttctgctcagtgcccggcactagtgtgtgtcatgtcccggctgcgtttctggggcccatggcccctccttatgtggcaactattgtggctactagttaaggaggctcagcctctggagtgggtcaaggacccgctccagctcacctctaatcccctggggccgcctgactcctggtcttcccactcctcccatttcccacgggaatctccccatgcgcctactctcccagcagacccgtgggactttgatcacctggggccctctgcttcctcagagatgccagccccatcccaggaatcgactgaaaatttggttccattcctggacacctgggattcagctggagagcagcccctggagccagagcagttcttggcttcacagcaggatttaacaggacaagctgagtccacaggaaagactccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagt

SEQ ID NO: 98297 - DNA, 377 bp, Homo sapiens
actggaagagagcggaaaatgttgctttccaaatccttgggggatttaatctgtgctctcccagtttcaggagcttatgttgtgagggtgagatgactcctcattaagcagtatacaaatagattattggtagtcttctgtcatctcccacgaaacacaacctccccctcatcacctgacagccctccactaaccaccctataaacaagagggaactgagtctccttttcaaacacctctcctaagctagactgcagaagctgggagggctgagtcatcttcctcttgaaagaaaacccgtgtaacaaagccacagaagtatgctttctgtgcatatcatttgtttcaacacatggctgcttttataggatgccaac

SEQ ID NO: 98298 - DNA, 785 bp, Homo sapiens
agcgtggggtcaggtggcctggagtgggggtgggtagtcagtcaggaatgagaggtggctttttattcatgaagaagaaaattcccagggaacaggatggcaaacgagaaggaaggctattgtgtatgagtgtacaggttgtactctgcacactggggtttggaagaggagacacaccatatatattccccaagtcatgaaagaaataaagaaaagacaaagataacctaggtcaaacaatgaaagaaccaaaaatggaaagaggaagaaagtacatgaagtcgtgaaacaaaatcctgaagagttttctgagactcgaatgagattaaaaggcatgaagaactccagaaatgcaggctgcaataattattactctgatcgtcaatagaatccagaatgcaaccatccagaagggcaggctttggctgcagtgttgcagggagcgccagattgcaagccaaaagaaatggagatgtaggaaggatgctaccacggggaggcgggtgttctctggatgcagaagatgatatacagtcatcagttacacacaaatgtcagggattcttcactcaaaagaaaggagaaagccaccactttgaaagaaaggaaatagtcaatatatttgacaacctgtatggaatggacctgaccaatgggaacagtgacacgagctgaaattcacttcagcttttggggttgctgccacacttgggtaagagacctaaagatcaacttttctttaacctgcatcattaatcgtataaaccttccagctcacaggtatc

SEQ ID NO: 98299 - DNA, 519 bp, Homo sapiens
gcggccgctactactactactactactactaaattcgcggccgcgtcgatcattatcattcttttttttttttctttttttgagacagagtctcaccgtgtcacccaggctggagtggagtggcacaatcttggctcattgcaatctctgcctccagggttcaagcgattctcctgcctcagcctcctgagtagctgggattacaggcacacaccaccatgtccggctaatttttgtatttttagtagagatgggatttcatcatgttggtcaggctggtctcgaactcctgacctcgtgatctgcccgcctcagcctcccaaagtgctgggattacaggcatgagccactgagcccagccacattatcattcttaataaacccactttaagtaaaacttcctcattctttttcctaagagtctttgtaaagatgaaaatcaaatattaactaattcttctgagcaacaatattcaagcatcttggagctaaagggtaaaggagacacagtgagagggc

SEQ ID NO: 98300 - DNA, 465 bp, Homo sapiens
ggtttcagcgagagagtgagtgacagtgaatggcagccacgtgagagtcacagctgggcagcttggccaccccagactgacggggtcaagagggggacccccccccaccgcacttgacacaaaagagcccagagccccggcgaagatgaagggggtggagccgggggtatctggttccccagacactcttctctccgctccccaatccgaatggactgctgtccctgcacaggctgggggagcgaggggacgagctcctgccttattccaggaagtggtctgcgtggactgtggccaccacctgcccctactcatcagcagcccacaaacattcacaagacccctccctcgcgtgccaccgcatgcccctcagttggcgggcacctaagtctccgcgggtggaggggggtccgatggacaccgtcctcactctgcctgtccaagtcctgagcggagggggcaggc

SEQ ID NO: 98301 - DNA, 419 bp, Homo sapiens
ctgaagttatatttacaggtatcatcttgtaaccagacctaggtttggctgctcatcactgaaagccaaacacaggaagcaagggttggcaggaggaaaaacaggtttagtttgagaaccagcaaactgaaaagatggtgaactagcatcctaaagaaccatcttaaattttaaaacttaccgtaaggttttttaaagggaaacttggtatgggagagtgggaagggtgcagggtgcagggtctgtgtgtcttgtttgatggttatcttaggtagtcacaactcccgaggtctgattggcattattttgacttgagcagatggtggtggactacttattcccagtaactccccctaagcaggaggattccacaatgggggctctgagactggtttgtttcaagattagcctctgggatt

SEQ ID NO: 98302 - DNA, 567 bp, Homo sapiens
tgtctacagtatcccatatattcatgttctaaaaatgcaaattcatataaaccaaagtaatacttgtttttttgaaacaaataaacctaacattttaaaataattccatgaaaatctaaaatttaaatctaaatgtaaaatgcaatgtatttttagaagttatttatatattcttgattttagttctttgccagttatatggtaataaatatcttctcccaatttgtaagttatcttttcactttctttcaggtacctgttgaagataaattcttaattttaatacagtaaacttattggtcttttatcattagcgttttaagtctttcttaagaaatactttcctactctaatatcagaaacatacttatgtatattttctactgaaaggtttaaagttttacttttgacatttaagtcacgaatctttctgactgggataggggcaagagggaaggtaagaaaaaatgatatatacacgtattataactaacatgtacacatacatgcacatgcacacaaacactagttaagcccccaacctcattatgatcttaaccttcacta

SEQ ID NO: 98303 - DNA, 766 bp, Homo sapiens
ctcagactgaaataatgcacataagctgcatggtatgaaatttctgaaggggcattcttccacagcccaagaggtgtatcaggaagctggcccttcagggacaggaacacctgtgcaccacatctctgcgatgatgcgacctggtgcctgtgacacatccctgcacattgctgtgggggtaaccaaaaatggagctgtgggagccagtggagggcatgctggcgtatcaggggcagcagcacccggggcggcggttgggggaatggaatccaatatgaagatggttctttctttctctaacactttactgcatgccctggtgtcacttttctcagcatggcttctccctgcactccttgcttccaaatgctcagtacttcctgtccacccaggtgggtcacagcacaggccttggaggaagccgactaagctgggtttgaatgattgcttctgcaagctaacagccatgtggccttaggtgagttatgggacctccccatgcctcagtttcctcatggacaaagtgggggctgacaataccatcctccttacttcaccgtgggggtctagagtgtgctgcagaagtgcctgggtgagacctgcttccggttcctctttaagccatacgaaggggtgttccggatctaacagattctcccttctcaggagtacttgcattttaaaagatgaccctggggctgcttcatacagcacaataaattgactagagcgaagctccggtgggaagcagtggggtaaagatatt

SEQ ID NO: 98304 - DNA, 263 bp, Homo sapiens
catgtttgtcgtcttttctggggccaggggcaaatatctttagaacaattagttcttcaaccataacattttggactgaaatatcctcattctccaaagaactgtgtatacatatatatatatggttacacagacatagaactgtgtgtgtgtattactacatatcctggatccaatgagatggcacttttttgttaatttttgttcccacttcattttactgaaactctaaaatacattaattttaaaaccttttttaaacg

SEQ ID NO: 98305 - DNA, 256 bp, Homo sapiens
tgtatttttagtagagacggggttttaccatgttggccaggctggtctcgaactcctgacctcaaatgattcacctgcctcggcctcccaaagtgctgggattacaggcgtgagccaccgtgcccggccagattaaacaaagattttaaaataaaacacaaaagcacaagcaacaacaaaacacataaactggacatcatcaaaatttttaaaaactgtgtgtcaaaggacagtatcaaataaatgaaacaaaccc

SEQ ID NO: 98306 - DNA, 412 bp, Homo sapiens
gctacatgatgtctcatggttcttttcagactctttgattacaccactcacttgacttcacactctgaatattcctgatcctagtgacaaaagttatagtatatttaagtccccaaaagttcatcatcattcctaagttcaaactaagtaattccctagtaaggaatttcccaatgtgagaatgttatagcctccaagcctttcagaacctgttaagtaaaatccccagagtttaaaaaaaaaaaaaaatcagaatttttaacaagggtgccagttcaaagctggaaactaaaatttcatgaatataaatgtgcaccctcccacagaaaaaaatacgactgtcactgaaaaatattatctatgtaacgagaattgttcattaattttcaaatgtagatgacaggttatccct

SEQ ID NO: 98307 - DNA, 351 bp, Homo sapiens
tatagtttttatttttattccagaatttcctaatatctttaattagatattattcacacaaagattctcacaaaagaagttccatgtcacatacattttgaaatccctacatattatctttctttttaagcttcctagtgcatattaacataaaaagactccataaagtcttgaaataaaagaatgctggtgagcaaggattagtcagggttttcaaaagatattatcactgtatacgtgcttcttcattaatatacagttcaggagaagaacagttggaaagactcctgttagtgagttgatgatccttatagtgcatagcacaatgcctggcactcaatggacgtatgt

SEQ ID NO: 98308 - DNA, 1138 bp, Homo sapiens
cttattatacgcatgtgcagctagacatttaacactgcttcagcttcattccataaattttgatatgttgtgtcttcattttcatttatgtcagggtatttttttatttcccttttgttttcctctgatccattggttatttagtagagtgctgctcaatttccatatgcttgggagttttccaaattttttcctgttgatttctgtcttattccaatttgtcctgctataacaaaatacttaagactgggtatttaataatgaacagaaatttatttagcacagctctggaggctgggaaatcgaagaatgagggggcagcatctggcaggacccttgtgctgcatcatcccatggtgggaggtggaaaggcaagagagagcaaggggaggccagacctgcccttttataacagtactcctcctgtgataatgaacacatttctgtgataatggcattaacccattaatgagcacataaccctcatgacccaaacacctcttaaagttcccacctcccgacaccttcaaaatggggaattaacttttagtatgagttttggagtgaacaaaaattcaaactatatcaattcctaatttcattctattgtgtagggagaacataatttatgtattatatccttttaaatttagagaggtttgctttatagcctagcatatggtggtgtgttctagagaatgttctatgtgcagttgagaagaatgtatactttcttgttgtgtggagtgttttatagatgtttgttaggtctagttgtttataatgttatatcttttatttcctagttgattttctgcttggttattcattatagaaagtgagacattgaagtctccaactcttatttctgtcagttgtgtgctttgtgtattgtagtgttttgttgttgggtgcatacatatttgtaattgttagcttttcctgatagattgacccttctatagttataaaatgtctctaggaattttttgttatgtctattttgtatgagattagtatagccactccagctttcttgtggctgctgtttgaatgatgtaccttttctcatccttttactgtcagtctatttgtatctttgaataaaaggtgtatctcctgtggacagcaaaaagtt

SEQ ID NO: 98309 - DNA, 342 bp, Homo sapiens
ggccttccccaagttccctcagttgggctaggggaacgttatggatctagtttgattttgtcatgtgtcctgctagccactgtgtttttaaattagaatctctgcgagatcacactgttggaacaacacacaaattgtagttttaaatcagtaatatgatctaattagaaatgatgttttcatttcctgtattattaaattgagtcacctgactatcttaaaatgctttttaaatctattacactatataatcagtacatgctgtgtgaatgtggttatgcttaataaaggaggctgacttggaacctcataagaatttcaccaaagaaactaccattaaga

SEQ ID NO: 98310 - DNA, 565 bp, Homo sapiens
agtatgtatgttgcttcagcccttaatttgcaaggtggtgaaaccactatgggcctggccaaatcagcaagaagggggctggaggaagggcagctgtcttggggtacactgggactggaaggagctgccttcctgaagtcctccttgcttctctgaagttgtcccagcacagctgtggcttccgggagaggaatgtcagggccctgataaggaaatgaagtggagcccgcacctgcccagaatgtgaaatttcttcagcagcctctgaccgggctccagatgggcaagtgcagcccctcccacacctgctgagtttgatctccctcctcctggatgctgtgaggcttggcacctgcccagccaggcactcaggaaacctgctgggggtctctgagcgcccaccagggtaaaccaaggtccctttcttgtgttaaagagaagaactgggatggaagcgtgcccagggctctttggaagcacccaggaggggcaatggaaggcttcctgggaagagggtttctgggttgcattttaaaatacacacaggagttagctaaaaaaaaaa

SEQ ID NO: 98311 - DNA, 261 bp, Homo sapiens
gaatcaggtgacaagcagttgtgaggaaactagcaaagtatctagttatagagctattatttcctaaatcaagagtgaaaaataaaagattttttccctagaaattaacatgcatgctccattcatttgccagagtctctgctccaacaacatcctggccttcaaaatgctcaaagggatgaatcaaggacaattcacatttaagggactacggaagagaaagttgcattacatgacccaggtctttccccaaccattcca

SEQ ID NO: 98312 - DNA, 745 bp, Homo sapiens
acagaatcaggaatgcctaattataaaatcttctagctagttaggaagcattatgtgggggttaatatgtagttaacaatgaagaaaattttagaagttattatatttttacactcttaatagtttaaaaaatactggccagacgcagtggctcacacctgtaatcccaggattttgggaggccgaggtgggcggatcacttgaggtcaggagtttgagaccagcctagacaacatggtgaaatcccgtctctactaaaaatacaaaaattagccaggtgtggtagcgcatgcctgtagttccagctacttgggaggctgaggcacgcaaatcgcttgaaacctggaggtggaggttgcggtgagccaagatcttgccactgcactccagcctgggtaacagagcgagactccatctcagaaacaaaacaaaacaaaacatgttctgtatgatactacagttgtggatacgagtcattatacatttgtcaaaacctacagaatgtacaccaagagtgaactctaatgtaaactatagacttgaggtgacagtggcgtgtcagtgttggttcaccagtcatagtaaacacatcactgtggtttgggaagttgacagtgggggaggttgtgtgtgtgtggtggcagggatatatgggaactctctgtatttctgctcaactttgatgtgaacctaaaactgctgtgaaaaataaagtttattaatttaaataaatgcagcacatgcc

SEQ ID NO: 98313 - DNA, 204 bp, Homo sapiens
ctctacaagaagattcttaaaggctgggtatagtgtctcaaacctataattccaacactttgggaggctgagttgtgaaaattggtcacttaagcccacaagttcaagaccagcctgggcaacgtagtgagatgctatgtctataaaaaaatttttttttttaaaattaggcatggtgggccaggcgcggtgactcatgcctgt

SEQ ID NO: 98314 - DNA, 134 bp, Homo sapiens
gtctgtctccaccttagtgctgcttttccctgcatgccttcaatcttcagtaggaaggagatagccacaagctgctttgggctgacatcctatcagcttagcaagaagtaaagtcaggtggtatagaagacatc

SEQ ID NO: 98315 - DNA, 296 bp, Homo sapiens
caccctgctgaggtcaatttcgtcactgatgcctcgggtcacataggccctgatgacccagatttcacacagaggtcagtacatcggtcaactttcctcccaggaggggccggggctggtgggccatgcccactccgtgccacatgcctagcattcagagctttgtaaggaagccctgttctaaatgctcaggtcccacccttccttgtcaagagaagccatgggcttcctgctcctgtgtcacagtgtgccacttgaagggtggctcttccccattcttcttccatgggggccag

SEQ ID NO: 98316 - DNA, 678 bp, Homo sapiens
agtacaacttccgggtcgccaggcaagggggtgtggctagggaaggggagaggcgagctatgatgtaagcggcgcgcgccgaagtggggccagctagcaggcgtcgtggcggggccgcgcttttgggccgcgagcttgaggtcccgcttctcgacggattccttctggctccgcgaaggaacttgcgtcccttctctaagtcttcggataaaaccaagacctaggcctacagatgtatgggagcagggccagggagagagagacttcgtttttcccattcattcatgcatccgaccaacactgactgagcctgcgtcgggcgcggtgcctggctggcggtcccagggtcactaagacgcaacccggcgctggaggtgcttgcgtcgagcagggccggcacaggattgccagtcgtggctgtcctgtgcggtggagccacagggctgtcgcgtcgtccctgtgcgtgggtggcccagtgtgttggatatgacctgagagatgacagatgtgagatgacacgacagggagatctgaggaggtccccagagaactgggaactgcgtgtcaccagtctagagattcggagacagttggatctatggacccatgtcttcctttttcttgtcgaactcccttctttcacaggagcacaccatttttagtggtttcttaagatga

SEQ ID NO: 98317 - DNA, 418 bp, Homo sapiens
agaactcttaaaggtcatgcaattctgcctgaattacttttatctattatatggttcttggggataagattgttctatatatctgtgttgcagaaatggaaggttctctggaagtatttgtaaattaaacagaaattacaaatattttaattgtcaactaactaaatattattttacaattcctaaaccttcagtatattgataaggtacacattattttacacaagtatgtccctatattcaaataaaatttcaatatatttacaaaaaaaatgcccccaaaattgatcaaaactgtaacatcctatttcaaaataagctaggacacttttaaaaatgatgaaaaacataaaagagccatgtaagtcagaattagaaaaattctgaaaggcgacagagctccagaaaaaatttaaaa

SEQ ID NO: 98318 - DNA, 263 bp, Homo sapiens
cttccaggcatgaggctctcccttcaaaaaaaaagaaaaaaataactccctaccactagtttaactcataggcaggcaattatgatatgcttctgagtctttcttcagaggaaaaaaaaatgaaaacaaagtatggttctgtaaaagataattaagtcagccatatatttttataggcaaatatgaatagctctcaattaccagttgtaatggaagtcagagatatcaaaattcataagtaattcataaactgtatttcagct

SEQ ID NO: 98319 - DNA, 716 bp, Homo sapiens
cccctagcctttgggtcatccctggcttgaaggtggggtttcactggggacccagctcttcccgcccggaaacctcttagcctcccaccgccatcaatataccggctgcggtgcccaggctgtccacgctaaggggtgcccacaggcccatgccgagccaccctcagccccgcagcctccctcacgttctcgttagtgcccagagtctggagggggctgaggcggctggaggctggtgtgtcagcagccctatatcacgcacatgtctgtctgggtcgcaacagttccccgggctcagccacaactttgcttcacaccaaagcaagccctgggagcagggagaggccagggaacatgagcaagcacttcctagcctgcaaggtcagggtgtttcccaggcccccaagagcacagggctgcccaggtccagagccacagctgggccgctgcaactgcacctgggagcatggtgggagcatggtgctcgcgtcccgccagctctgtaaggtgcagggttcttgcctgtttctggccccggctggttctgtgaagcatgcaggccggactgcacctcccccactgcagctggcgctctcgcagtggccactccagagggggcaccactgccatcaaaagttagctgtatcagccaggctggaatgcagtggtgcaattaaagctcaccatggacttgaacgcctgagatcaacagactt

SEQ ID NO: 98320 - DNA, 434 bp, Homo sapiens
accttaaccctcaaagccctggactggacagggagcagctgtactggcagctgagccagatgaccaatggcatcaaagagctgggcccctacaccctggaccggaacagtctctacgtcaatggtttcacccatcggagctctgggctcaccaccagcactccttggacttccacagttgaccttggaacctcagggactccatcccccgtccccagccccacaagtaagtaccagtcaatggcatctctccctcaacttcaccatcaccaacctgcagtatgaggaggacatgcatcgccctggatctaggaagttcaacaccacagagagggtcctgcaggcttagtcccattttcaagaactccagtgttggccctctgtactctggctgcagactgacctctctcaggcccgagaaggatggggcagcaa

SEQ ID NO: 98321 - DNA, 126 bp, Homo sapiens
agggagggagaggtcaactttagaggactgatctacttcatgtcaaaatacacagcaacttcttgtgtctctccagtgccttccacaagaccctgcccctcctgcggtatccccattccctgctct

SEQ ID NO: 98322 - DNA, 369 bp, Homo sapiens
ttttgagatggagcctcgctctgtcacccaggctggagtgcggtggcatgatcttggctcactgaaacctccatctctcaggttcaagcaattctcctgcctcagcctcccgagtaactgggattacaggcacctgccaccatgcccggcttatttttgtatttttagtagagacggggtttcaccatgttggccaggctggtcttgaactcctgacctcaggtgatctgcctgccttggcctcccaaagtgctggcattaaaggcatgagccatggctcctggccgtaagtgattcttgaagcttcaaatttttaatttagggacatggctggaaacccatgttgatcattcgagaataactattatc

SEQ ID NO: 98323 - DNA, 226 bp, Homo sapiens
gagcaaggaactgaggcctccccagggcagaacatgtgtcagagtggaaaaggctttggaacttggcattagagatgggactctggagaacttaattaagctcttcgaacctcaattttcttacattgtaaagtaggtcataatacccaccttagagattctgtttgggagttagatgagagagcagatgtcaagtaccttgcacggtgccgggtgcatggtagta

SEQ ID NO: 98324 - DNA, 668 bp, Homo sapiens
tgttgaaacgtggaaaaagggaggaggaagaagactggtaagaggcatgaaaagcttgtatgggcgtttttgagactgctaagagcagcatcggggtgtagcaggcagtaggtatgcagaccttgtatatactgggagttgggtacttagtagttgtaagtgtttgggatgaatatggatggaggcgtgtggtgatgggtatagtatagaatacatttcagttccaggagtattgtgcttggacagcgttgtatttgattgagcaaacttttaaccaaaatactttatagaaacaggataaacagcgttcaactttctcttaagaacagaatctacaggtctggggaacagaggaagaaacaacccaaaattaaaactgtaaacgtttgttttaatacagcttatgtttttaagtaaaaatagcattaattattcacacatttgtagatactgttacctagatctaaagttttagtgctaccccataatcattttaattatttttttcagagaatttatctgatttttgtcctttctgtgaagtttgtttcatttttttaaacgtaaattatttcatgattccatttccacattctcagcacatttttaaaaaattgataacactgtatgttttttattatgtacaatatagtttttgaagtatatat

SEQ ID NO: 98325 - DNA, 265 bp, Homo sapiens
aaaaggttcatcttttattcctccaaacactttcatttaaatcaagaggatgggatgtggttattgctgtgtttttaggcagaatcaacggtttctgggtctgagatggtgcatacaccctctcagtccctgtatcctgagatggagtcacctaagaatccacagcaagtcctaaccagggatgggtctgggtgattaaggaaggttggcttcagaactgggccaggggcactgctttgcttttgctgttttgatcagctctctg

SEQ ID NO: 98326 - DNA, 527 bp, Homo sapiens
cacaatgcctctccctcctcccctgggagtggagccaggctgacctctctctggctccatactggaaatgtgtgtggcaatggcagcattgccctttaccccatgcccaatactgcaatggcaccttaggctgtgtgtgtgtcagacagaaaaataaaacatcagatttttgttaattttgggtgatgagtgaggtcagggatagttattattttgagactgctatttttttttctcttttttaaaaacagatggggctgggcacaatggctcatacctgtaatcccagcactttgggaggctgagggaggtggattatttgaggccaggagttcaagaccaccctggccaacacggtgaaaccccgtctctactaaaaatacaaaaattagccaggcgccgtggtgcatgccagtaatcccagctactcaggaggctgaggcacaagaatcacctgaacccaggagacgaggctgcagtgagccaagatcacactattgcacatcagcctgggtgatagagtgaga

SEQ ID NO: 98327 - DNA, 166 bp, Homo sapiens
cctctcactccagccttctctctcaaactgggtagtatcctggtccttccatttactagctgtgtgaccacgggaaagttactcaacttgccttagtttcctcatgtgcaaaatagaaaattgcctatcttataggcttactgtgaggataaaacacatttaaaga

SEQ ID NO: 98328 - DNA, 439 bp, Homo sapiens
tatcgtagccaagagaaaatggagtttctttgaacagcatctgtctcccttcactgctggtaatttgtgtgttattattaatcactgtttttggaatctctgggtaaataggcactaaataagcccaaaaatatgagcaaaagttgtctgttaattcattggccactgcagaaaggagtactaaagcccagaaaagagttctgagcttccttctatctctcactagcgtgttctctctaatttgcattccttaaaaatgagttgcacttgctttagtggcatgtatattttttaaaaatacagataagtttagtgtggctcctgtataaaaatgactctcaaaaaatagtaataaaaggaacatgctctccaagggagctatgtgcagctcttggcccttggatgcctgtggctgggagtctgaatctgtctgcccatg

SEQ ID NO: 98329 - DNA, 222 bp, Homo sapiens
aggttatacacattgcacaaatcctacagataataagtagtagaccttagccgggtgcagtggctcatgcctgtaatcccagcactttgggaagccaaggtggaagaatcacctgagaagtttgagactagcctagtcaacctagtgagacccaatgtttagaaaatcatagacctagagttgaacccaaacaggttggctccgagctggtgctgtaatgta

SEQ ID NO: 98330 - DNA, 458 bp, Homo sapiens
tacatttaatattcatttaatccaagaacttcattttacaaattgggaaattaataaccaaagacataaatcaggtaagacttgattaatgaaatactgaatagaatactaggtagatcttatgcagtggttactggggaccaggcccttatccatgtgagctgcagactcattcaatcctctcagcagccggcatggtaggtgtgacttctgccatagtgtttgttctgtttccaaatatattaacagagatgtacagaagcagcagtacagactttagagctgatgaagaactcattgatcacctttctcaatgtccacttttatgagtaaggaaacagaggacgatgcatatttgatgacttgcccaaagtcactagcttctaagactaaaattccagcatcctggctgttttccaggtgttctttcatcacattatgttcccctcatctgtgaa

SEQ ID NO: 98331 - DNA, 391 bp, Homo sapiens
tcgagctcggaccgcccgatagccgaaggtaagatcacagcctctcctgatttacgacgggattagcaccttggctaagcgttctggaagccttccgttggctatagagcgtgccgagtacagtagcagtggtagtgccacccccagcttcccctcatgttaacatctcatataataaattattgttggtacaagactacagaactgggcacagtggctcacacctgtaatcaagaactttgggaggccaaggcaagcaaatctcttgaggtctggagttcgagaccagtctggacgacatggtgaaaccgtgtctctattaaaaatacgataattagccaggcgtagtggtgcgtgtctgtagtctcagctacttgggaagctgaggtgg

SEQ ID NO: 98332 - DNA, 430 bp, Homo sapiens
gttagatgtcctgtcacttgttttcttggattgaatgtaatagaaataagaactgtggctacctatttttctaactagatgttagaggaatttaatacattttctccagaatgtcttagtatgattttctgctaattaattttgccaataaaatatgctctttagggctgggcgtggtggctcatgcctataatcccagcacttcgggaggccgaggcagaaggatcacctgaagtcaggagttcgagaccagccaggcctacatggcaaaactcttctctctactgaaaataaaatagctaggtttggtggcgcatgcctgtatactcaggaggctgaggcacgagaatcgcttgaacccagggagcggaggttgcagtgagccaagatcgtgccactgcattccagcctgagctacgaagcaaaactc

SEQ ID NO: 98333 - DNA, 713 bp, Homo sapiens
  misc_feature (35)..(37): n is a, c, g, or t
tcaaggaaggaaggcacgttagcaaggaaagaggnnngaattcggggttacccacagttcaaagatcaaaacaaaatggtaactgccaagtactccgtatcataaagaagatgctatatcatccatgcggccagtgtcaaaccactgtgaaaataattctgcctgcgttacccagtatgcctgcctccagactgtatacgggagttgatgaacttggagtgtggggaatatttcagagacagttttcagtgttttgtgaatggaacatacacacgcacacatacatgcatacacacacaggtgtacacacatacacacaaaaagcgcggtagttttttttctatcaccacaggcaaagagaacacgctttagaagtacttcttagagagcttttaaatgttctctggaatttgggagacagaaagactagtatatatctgtattatatatggcatataggataacatatgtagcaaaaatagatatagatacatagatatacgagagagcaaataaattagaaagttatttatctagaaattgtagattgagtaaataataactattctacactcatataaggacactgttcagctattaatattaaaattatggtacatttatatttattaatagataaatactcgtaaaatatttgtaactaaaaacatcagctatttgtgcttcatattcataatgtatgtatacaaata

SEQ ID NO: 98334 - DNA, 393 bp, Homo sapiens
tgagacagagtctcactctgtctcccaggctggagtgcagtggtgcaatctcggtttactgcaagctccgcctcctgggttcatgccattctcctgcctcagcctcccaagaagctgggactgcaggcgcccgccacctcacctggctaattttttatatttgtagtagagacagggtttcaccatattagccaggatggtcttgatcttctgacctcatgatccgcccacctcagcctcccaaagtgctgggattacaggcgtgagccaccgcacccggccaacactcagtgtctttatctgggccaaacagatcaggcttgttgaacactggaagtggatcaagatttcatggggaccccagcacacccaggcccaggcagaggactcttc

SEQ ID NO: 98335 - DNA, 253 bp, Homo sapiens
gggttggggggagcacaggccctcgggagccagaaggggactggggctgtggctcaggccatggacagagcagaggcgcagggacctgaagaagcagagggagaagcctggccaacatagcgagaccccatctctactcaaaagacaaaaattagctgggtgtggtggcgtgtacctataatcccagctactcaggaggctgaggcaggagaatcacttgaacctgggagggggatgttgcagtgagttgaga

SEQ ID NO: 98336 - DNA, 463 bp, Homo sapiens
ataagcaaaacacacagaatgtcaggtggtgagagagaactacggagcaagagtgagaaggagagggagtgtgggcacagcatggggaaggctgcattttcagtaatgacgtcaggaaaggccttgctgagaaggggagaattgcgagaaaccaggaggagaggggtaagttgtgattatttgccatcaaggattctgagttgagatcaacaaatgtgaaggcgcaggggcaagagtctaccggcatgtttgaggaccagcaagactccagtgtgatggggcagagccagtgaagggagaagcagcaggagctgaagtcagagaaataataagcaacacattacacgggcccagcaagccactggggctttgactttcatgatgagtgagataggaagtcattcaagggctccgaaaagagtgtcaggattgacttagaatctaaaacttgctttggctgctg

SEQ ID NO: 98337 - DNA, 522 bp, Homo sapiens
attaaaatcttcggttctctgaaagacattgttcatagaatgaagaaacaagctacaaactggaagaaaatatttgcaaatcacaaatccaacaaaagacttatatccacttaaccaaagatgatatataatgtaaataaacccataaaaaacagatgctcaaaatcattacccattaacgaaatgcaaatttaaatcatgatgcaataccactacacacctagaatgacaaaaattaaaaatactaacaataccaagtgctggtcaggatgtggaactactagaattttcatacactgccagtaaaactgcaaaatggcataaacactctggaaaacagtggcaatttcttataaagttaaacatacacttaacaaatgacccagcaatcccactctcaggtattacactagaggaataaaaactaatgttcacacaaaaacttgtacgtgaatgtttacagcagttctattcctaatcaacacaactagaaaaaaaaaacctaaatattcttcaaagaat

SEQ ID NO: 98338 - DNA, 329 bp, Homo sapiens
gaagaactaccagaccgttttcacagtggctgcaccattttacgtttgtatcagcagtgtacgggagttccagtttctccatatcctcaacacttgttatgatctgttttattacagccgtcctagtgggtgtgaagtgtacctcattgtggttttgatgtgcatttctcgacaaccagttgtgttgagcatctccttgtgtgttgtgtatttttatacatcatagacttcagacctagaaattaatggaaacgtcctgatcatctagcttgacccttttcttttccagataaaaaggcttattgggttcagagagatgcgggtggtga

SEQ ID NO: 98339 - DNA, 225 bp, Homo sapiens
aagcatgtgtgcatcagataggagctgcgagggagcctggagaattcaaaacagacttcacgagagggacagtccgcctttgattttattagcattactgtcatgctgatcatgcagttatgaaagagagaaaaaagggaaaattttgacctaactactaggaaaattccacaaaattggcacaatctcaatcagttcacacagaaccacagctgccacaaccca

SEQ ID NO: 98340 - DNA, 292 bp, Homo sapiens
tcaaggacagagtgatttcatgacatctttctttttctaataaaatttagtgatgattttgtcaacagaattaaccgttccaggatgcgagatgccatttaactacttaactatttcactatttagaatcctgaattcttcagatttcccttgactatacctcattctatgtcctataactttaaaataaagtaatttattaaataaatgaccttttaaaaacaaatgcagtggatttacctggaaaaagttaaagaacattataatattacttttccttacacaaaaggta

SEQ ID NO: 98341 - DNA, 148 bp, Homo sapiens
cgggaggtagaggcatgatcatgccacttcactgcggcctgagctacagggactctgtctcaaaggaaagaaaacaaacaaacaaaaagccatgtagagctgggctatccaatacttgaaggtagccagtggacacgtggggccattt

SEQ ID NO: 98342 - DNA, 622 bp, Homo sapiens
agacgatgcagtgaacccactgggtgaatctgacaattatgtgtctgggggttactcttctcgaggagtatcttggtggtgttctccgtgtttcctgaattgaatgttagcctgcctggctaggtgggggaagttctcctggataatatccggaagaatgttttccaactgggttccattctccccgtcactttcaggtacactaatcaaatgtagattgggtcttttcacatagtcccatatttctgggaggcttggttcgtttctttttactcttttttctctaaacttctcttctcgcttcatttcatttattggatcttcagtcactgatacactttcttccacttgatcgaatcggctactgaagcttgggcatgtgtcacgtagctctcgtgccatggttttcagctccatcaggttgttttcggcttttggctattatgcagaatactgctatgaatgctcatgtacaaggtttttgtgaacatacgtttttaattcccttaggtatacacctaggagcggtattcataagtaattcattatttcttgtattcactggtatgctggtaaatatttaacaccagttttcacttggtagggttggggatctctgatt

SEQ ID NO: 98343 - DNA, 831 bp, Homo sapiens
accgaggcggggctccccaggatcccacggtcccgctcaggccagacgcagaggcagtcccagcccgcgatgaggacgtggggtcgtgaccgctgggccacggtgaagggggcagccctgctggacccgctagctgggccgacgctttcccacccctaggggtttgctgggccctggccgcaaacttgtggggcgccgtcctcggggccactgcccggccaccctcacacccttgggccctcagctctggtgcattggtccgggctccgggaggcactgagacgtccccctagggcgctgcagggaagcgagggccaggcccttccaggtccccggtcctcccgggcaggatggaggctgctgaacgctcctcaagcttccaagtcagccgtggctgggcgggcggcagcagggaaggtttgggctccgccatgcttgcgagccagcagcctggcctcgcctgtccgcagcagggggcaggtcagctgcccgccctgaaagggaggaccagggcccagattctccctgcgacaagccgcgtcttccttggccactgggccctagatggttggcaccttgtgccccttctcagctgggagagttcctgccccacacactcaaggattctgagttctccttggctgctagacctctggtccctctgaaaggctcgagagagaactcccccagggcctgctgtcctggcatccgctgggaaataggattcaaggacctgctgtggctcagcctagaaaaaaggaggggaagcaggacccactcctcggcccccggtctgctgtgcgcctttgggattccttatttcttaaactg

SEQ ID NO: 98344 - DNA, 873 bp, Homo sapiens
gcacatccccaggatagtgttaaccgtcacctttacgcatggcactcagaatgcgcagagtggtgtgtgcatgcagcaacgtgtatacaccctgtgcatctgggaggtcctccagtcatctctggccgcgtcctgcggagggtgctgcagcctctacctggcctctggctctttctttcctttcctttctttctttccttctttctcttcctttctcttcctttcctttctttcctttctttcctttctctttcctttctttccttcctttcttccttccttccttccctttcttctttcttttctttccttcctttccttcttccttcctttctttctttttcttctttctttctctctctctttctttctttctctctctctttctagagtcttgctctgtcaccacgctggagtgcagtggagtgatctcggctcattgcaacctctgcgacccagcttcaagcgattctcctgcctcagtctcccaagtagctgggactataggcatgcaccaccacaaacagttaattttttttgtatttttagtagagatggggtttcaccatgttggccaggctggtcttgaactcctgacctcaggtgatcccccccaccttggcctcccaaagtgctgggattacagaggtggctcttttaattgactcctctccaggcatctctccttccagccacagagcctggcctgatggtcccagggccccagggccccaggtgaaggcctctctcctcccccactcaggtctgaccagctctgtttccatcctggtgtgggcacaaggtctcttgctgcagctgggccagtttgctgaccttctcagctccttctcttagactggagaggcctggaag

SEQ ID NO: 98345 - DNA, 222 bp, Homo sapiens
tttagtgggtctggggtgggcgcggcccccggctaacggggcgggtctcctcctctaggcgcaggagtgcgccgggctctccaggcctccccggctaggtggagcgtgacaccgcaaagcacaccgtcctcccgaggcggggcccaggcggcaccagcccctccccagatggaagtgcccggcagacagctgcccaagacctcacagaacaaagatggacat

SEQ ID NO: 98346 - DNA, 599 bp, Homo sapiens
aaaaataaggatgtttattaaggacatttctagcccacagctagggctcatactcggctctatgagcactgtccgacctcatccccattcaatgtgaatgacattagggaggccgggccacaggtagatcccactgcctggctaaaggggccatagcaaggggtccctcccatgcaaggggtctctcccatagccaggtatagaatagatacactgctgcggatgaagagggaaatctcactggactaatacattcccctacaccctgcctggaccctctcattcctccccacctcccaagatgatgggtcaaaggtacctagcactattatgtggggtaccaaaggaagcccctttattttgtcccagaactgtgggaaaaggatacccttcccttctcagccatctcaggcctgggggctactgaggtagagggggaggggccaggccactctaatcccccttgtgggccctgctctggacctgccccttagggaagcagggggcattttgctggtatgggaggctgggacatcagcccagactggaatgctgcagttcttcccgaagccacgagggcactggctgtccaagccggc

SEQ ID NO: 98347 - DNA, 383 bp, Homo sapiens
tacatcctggtagagggggaacgtccggacctaatcattttctatgtgtgattttatatatatatatttaattttagtctaggtgcagtggctcagacctgtaatctcagaactattgtaggccatggggaggatcgctttgagcccaggagttcaaaaccaccctaggcaatgtagagggatcctatctctacaaacataaaaataaaaatgaaaacattatctaggcatggtgacgtgtgcctgtacgctcagctacttgagaggctgagatgagaggatcacttgagcccagaaactccaggctgcagtgggctacgattacaccattgcacttcagcctgagtgacacagcaagatgctatccctttaaaaaataaaaa

SEQ ID NO: 98348 - DNA, 590 bp, Homo sapiens
tattttattactaaaatgatctttagtataaacatctttaaagctaccttgatttttaaaataatccttcctcaatttagaaaaattctaaaatggcggagcatgttggctcaagcctgtaatcccagcacttggggaggcctaggcggtggatcacctgaggtcaggagttcaagaccagcctgaggcatggagaaaccccgtctctactaaaaatacaaaattagctgggcttgatggtacacgcctgtaatcccagctactctggaagctgaggcaggagaattgcttgaacctgggaggcggaggttgtggtgagctgagattgcaccatcacactccagcgtggacaacaagagcacaactctgtctcaaaaaaaaaaaaaaaattctaaaatacagattaaaagataaaaccacacaaatccagtttcctggagatcaccattgtcagcatttggtttacgcaaaaacattattattttctctgtaaatggatacatgtaaataattgcatgtgtaatatctgtttgccacaggtctgtacacactattccaaaccctgaacctttcattgacaaacatgactg

SEQ ID NO: 98349 - DNA, 226 bp, Homo sapiens
gtgggctgaggctgaagcccctgcttttccacaggtgtctggcaggaaaagggtggggaaggagagtgggatccaggcaaggcagagagagcacactaagactagaaggttgcctcctcacccacggcccccaccacccaccgcctgcctttgggccataaagcaatgaggggccctcatagctgggcagaccctggaccccagcaaaggggagtgggcaggcagt

SEQ ID NO: 98350 - DNA, 367 bp, Homo sapiens
tgctcccattttatttgcatttccctctcaattttcagttagttcaattacttatttattgagtccttttctttgtctagttttgtgcttctttgtcaattggtactgttcttcacatttggtatgcaggccgcctgggctctgccttcatgactaactcatgcactcttttaataaaaataaaaattttcatggtgaaaccccatctctactaaaaatgcaataattagctgggcgtggtggcaggcgcctgtaatcccagtgggaggctgaggcaggagaatctcaaactcaggaggtggaggttgcagtgagccgagattgcaccattgcactccagcctgggcaagaagagcgaaactccatc

SEQ ID NO: 98351 - DNA, 454 bp, Homo sapiens
ctatccaaatatctgcattcctttaaaatgtgaactatttgctgtgattaaccaaaggtagattatgtcatcagtggacattttagctttatggaaacaaattattaagaaatgaatagaaaggtgtctttttctttgtgtagtgcaaaagcctaaagctatcagtcaaaggcctaagaaatccacatttgaaaaacgtaaatcatgattggtaagaatacattcatctgatagtattgagaaaagttgaaaaactgttagccttccataacacattaaacattttatgtatggatggctgaaagtattgagaaaagctgaaaaactgttagccttccataacacattaaacgttttgtgtatggatggcttaggacaataaacaacatcattaaagtaaaattatgtcagtctgttcatattaacttatttaaatcaatgaaaattttgatga

SEQ ID NO: 98352 - DNA, 149 bp, Homo sapiens
ccatcgtctttgtctgcatcagcaaactttggatgaaccattgagtgccgaattccactgggcactggggacacagaaaggataagactgggtccttgagtttatgtgggggtatcaggggatgctcagtaaatgaaacccactcaagt

SEQ ID NO: 98353 - DNA, 460 bp, Homo sapiens
ttagtagatttgggttttcaccatgttggccagaatggtctcgatctcttgacctcgtgatctgcctgcctcagcctcccaaagtgctgggattacaggcgtgagccaatgcacccagccaatgcatatgttttttaataagtgtttctcatacttttccttaatctcctttatcgtactagcatcttattatttactgttgatacaacattctgatttcccctctaagcccaaggtaagctgcttcttactaaaaaccaatcattttagaaacaattaaacatgaccaagcaaagactgagctttatggtcacactctgttatgtaaatgaggtaatttaaaacaaacttagtgtttttttcttttatatttaagcttatattgttttacctagatgtttaagcaactctgccaaatgtacagttcacactgtatcataaatactattacaaatttatt

SEQ ID NO: 98354 - DNA, 375 bp, Homo sapiens
gtgaggggatccttacagacgtaggcagagaggggctgatgacaggtggaggagagggacgagcaccctttcaaagggagctgtccgggatgacatgggggtgctgtgtgtgagataaggaacactgacggagggccagctttggtgggcgcagggaggaggggctgggcacatcgagtctgaggtctttaaggtatgccaagtggagaacgtcaagaacaagagagctggatgttcatgttcagaaatccaaggtgggtgcggagagaatatggagtgagggcaggaggatacaggttagagactccacaaacctttactggtggtccagaagaggcagtactaggaaggagacagagaaggaacagccagaag

SEQ ID NO: 98355 - DNA, 207 bp, Homo sapiens
ttcttttgctcaagggttcacaagggcagcagactgatctgcacaagagggactgagcctggctgcggccgcacctgatgcctgtgcacacctgtccctggtggtctctcctgtggtgacttcttttgctcaagggttcacaagggcagcagactgatctgcacaagagggactgagcctggctgcggccgcacctgatgcctgtgc

SEQ ID NO: 98356 - DNA, 566 bp, Homo sapiens
atatctatcccccgctccctgtccttgctcaggactcagcatttaacagtggagagaaaagtaagactgaaagccaaaaactatgatgattctgagcatggtttgatactcccaagattttcagaaatgtagttgacatccagtcttaacaaacattcctgagaacaaggcattttcccacagggtgtttaggggtacttaaatacataaaacagggagtggtcagtcactaggattaagatcaaaatgacaattctgagaagaaagtctcagtagtcattagatttttctctttaatcagaaacaaagcactgaaatggatttaagatgtcccaattaaaactgttaagaataccaaatatgagatcaccaaaagattaatgtctcatctcagtttatgccttcttgcttcaaatgccagaaaggtgttcgaattccaagaactagatcctatatgtggatatctttttgaatccatgagcgacaaaaagagaagattccaagttctctcttcatactgcttaacctatctggtggatctgacattactggccattcacaccttg

SEQ ID NO: 98357 - DNA, 437 bp, Homo sapiens
caagaggccaggagatggaggctacgataagcgatgatggcgccactgcgctccagcctgggtgacagagtgagaccctgtctctaaaaaaaaattaaaagtatctgttcagatgtttaccaatgctattcatccgagcagacttttctcccagaaccaccagtgtgtaagaatcctcttttttttttttcttttctttttctttttttgttgcatgtttcccctatgaccctgagtccaaaagaatgttcagggggacagccaaggcttcaaagtggttactgtttcacctgttacaaacaaaatgttggctaggcacagtggctcactcgtgtaatcccagcactttgggaggccgaagtgggagaatcagttgaggccaaaggtggagaccagcctgagcaacagagtgagaccctatctctactaaaaaagga

SEQ ID NO: 98358 - DNA, 372 bp, Homo sapiens
aagatcagcaccactgcaatccagcctgggtgatagagcgagactccatttcaaaaaaaaaaaggaaacggacagacacacacacagcccatcccagggcggacccagggaccaggatagaagaggccaggtcccagccttgtaaggcacagcggctcaacccagaaggcagacagtgagcgaagacagaccagatcttgcagaaggtgggctacccgggccccaagtccaagccgaggaaggacagaggccactcaccaggatgtaggcttccagctgtaatgaagacacagatgcagtgagcaaatcttccagcaaaccccaaaccctttcaacatgctcatgcatggcctcggtccccgggacaggcag

SEQ ID NO: 98359 - DNA, 300 bp, Homo sapiens
ccaccttgtcaggaactcagttgtcaataatttctttatttgtgatacaagcagggatggggaaagagaaatgagcagacttggaagcttctccgaggccctagagaatacctctgggctccgaacaccagacgccaggagaaaggagggtggttgatgactccccactctttctccagcccctgctcctctgtttctccccttcacccactgcagcttcctcaggtcctgggtcccgtgccatcatctcttcgaatgacctcctttctatccctgttaataaaggagcatcagctaagt

SEQ ID NO: 98360 - DNA, 421 bp, Homo sapiens
ttttgtatttttggtaggggcggggtttcgccatgttggccaggctggtcttgaacttctgacctcaggtgatccacccacctcggcgtcccagagtgctgggattgcaggcgtgacaccacgccgggtcaacacctgttagttttgagacaccttgaaagctagacgttgtcccacaaagagaagatactgtgtaagaaaactcttaaaccaaacaacagcttatagacctccagctccttaacagtttctagacattccatttcaggacaatgaagtcttcctacatcagatgcggctctaggttgcccacaagcacttggcaccagggacactgcactttaggaacaaagtccccaccactagttcttgcagctttgttgctgaacctcatagtaatccttgctaaggcctacccagt

SEQ ID NO: 98361 - DNA, 400 bp, Homo sapiens
tgaccggagccctggcctgctagagagagatccactggcctcctttcattatgtcttgggctttggtcaatacatttacagagagactggagaacatccaattagatgattagaaatgggtaaagaggccggacacagtgacccaaacctgtaatctcagcactttgggaggctgagacaggtggaccacttgagcctattagttcaagaccagcctaggcaacatagcaagaccctgtctctacaacaaacacaaaaaatcagccaggtgtggtgatgtgcacctacagtcccagctactccggagactgaggtgggaggaatgcttgagcccaggcgaccaaggctgctgtgagctgagattgtgccactgcacggcagcctgggcaaaagaacaaga

SEQ ID NO: 98362 - DNA, 443 bp, Homo sapiens
tttgaagacccccagagaagaacagaatcaatatgagaatacagtttcttcacctgcctgtcttatggctccaacctgcactctttgaccaatcaacaatctccacactttggcacactccaaaacccttaaagacactatccccaaactcctcagagagtcggatttgaggtttcctcctgtctccttgtttggtggccctacaattaaacctctttctctgctgcagtctggtgtcttgggcatatttaaaattgcctttgcaaagattatgacagtgagagaagtctagcaaggctgactccctcttgcttctagccccccaggctggctgtcctcactcattcctgggcataggccaagctaaccatgggaggaatttagtttacagtttaactttgaagaaaggatgataatagtccctctctaaaactgatcccctc

SEQ ID NO: 98363 - DNA, 348 bp, Homo sapiens
cagatggaggcagtggctggagtgaatgaacggcaacacttgctggcaaccggcagaagctgagagacagggaacaggctctcctccagagcctccaggagccaggcctttggacaccttgaatgtgggcttctgggagaccatgcgtttctgttataagcagcccagtctctggcagtttttacggctgccccggaacactcatctatacctgtctgacaaggtcaagctccaaggaagggattctttacatatctacattgtttgcagattttacaataatcatttattcttgcatggctgatcattgttaaccaatacaaataaaataataaagaaatgacccac

SEQ ID NO: 98364 - DNA, 384 bp, Homo sapiens
cctccagctaaattttgtatttttcatagagataggctttcaccaggttggtcaggctggtctcgaactcctgacctcgtaatctgcccccatcagtgtcccaaagtgctgggattacaggcatgagccaccacacccagcccctccaactatttttatataacatttgttatgtctacaaagcaatttatgaagaggagctaaaagaggagaataaggtcagttcatttatatctaatctactgactttccacctccctccatctctttcatcatgattaaagaatagcaaacattaacaagtacttcaaaggagcagtgcactatgattgcacctgtgaatagccactgcactccagcctgagcaacacagcgagagctctt

SEQ ID NO: 98365 - DNA, 435 bp, Homo sapiens
taaaagctttgatgaagtcttggtttgcttgggctgtgtaggttggaggctcagcctttgtttctccctcctctggtgcccagtggtggtgtttgtgtccgtgaattttcaacctctgtagtttgtttgtagttatgaccactgttgcaccgaacccttaccgagggccaggccctgtgctaagcacttgccagtgtggatttattaagtcttcatgacagcaccatgtagggggagctgcgtccctgtgttgtacttgggacgcgatctgacctcaggcacttcaggctcctgaagggtctgcagtctcgtctctgcctgggaaaccacgatttgcagcatattccacagacctcatgctcatcaccaggatgcttcccgggactgctgcctgagatttctaagttcctaatgtggttcatgcttctggtgagt

SEQ ID NO: 98366 - DNA, 346 bp, Homo sapiens
catcatagcaacaaagggctatgtactatactcaggaaaaccatttatttgcactggaggcaactgttcttgagagaggaaaagtaaattgtccaagatgtaacatcttataaatagcaaagcaaggatgaaaattattatattttactaaatcagtatgagaatcctgattcttcattattatatccccaacactctatcagtttgttgaacaaatcaacaaataagcttgaataaaggatccacatctcaattctcctccaccattctatattgcccttcatccctacattaaaatgattatttctgctttttttctttaacaatttatccctaaagtaactag

SEQ ID NO: 98367 - DNA, 291 bp, Homo sapiens
ttgagacagttgcaccgtttaacaataattcctgaattttatttttcttcctttccttctttctttttagtggcttgtacctgatcaattgctaatactgtttaaaattgataggcactttttggtctggtaatctgatttttttgtggaacatcattaaaagaacaattgagagatttatagccatagaaaattgaggcttctattactcaagatagaagttagcgtaagtctgatctgagttttccactgtttttttttgttgttgttgttataagccttggtgtgggt

SEQ ID NO: 98368 - DNA, 289 bp, Homo sapiens
cttcaggcggaaactcttgtcacacttgggacactgaaaaggcttctctcccgtgtgcgttctgatgtgctcgatgagctttgagtgtttcacaaagcccttgccgcactcacaggagaaaggcatctccccgctgtgcagcagctggtgggccttcatgtcggccttcacgcgatagcgcttgtcgcactccggacactggaagggcctctctcccgtgtgcaggcgctgatggctgagcagctgccccttcaggcggaagctcctgttgcactctgggcactggaag

SEQ ID NO: 98369 - DNA, 430 bp, Homo sapiens
ggatttaattattagtaatagaactgtaatggaagaaagttaaatttatttgattaggtatctgcattataaatgtttgaacttggaagtcatatttcttcttcaaaagcagacatctttcatgctgttaatgtttatacattttagtgcttggataaagctattctgacacactcaattagttctttcaaaaatgcatctctttgctgtccctccccctccccctcaaaagttctagaagctgtgggaaaagttcagttgtctatctactgaacgtagtccaaggaatacccgtgggtttgttcactgctcggggagctggacgtgtgccgctctgacttcctttgcacatccttgcttccctgaatttgcatttattgcctaactagcatcccgcaaaaaggcctttcctggctgcctgcgaattggc

SEQ ID NO: 98370 - DNA, 343 bp, Homo sapiens
  misc_feature (174)..(174): n is a, c, g, or t
  misc_feature (188)..(188): n is a, c, g, or t
  misc_feature (228)..(228): n is a, c, g, or t
gcgtatatacacttatcaattattatgccaatggactagtacagctggaggtgctcatggtgacaccgcacaggacttcctgcctgctagaaatcatctacccgcgtgtcctttcccctttctggggcaaaagccactgcgggcatgtacccaaataaacctcttaatgcgttngttaaaattagttnggacatctgagtttccctctgaagaaatggaaaaagtgtnggggtggtatagctgataccacccacctacacgttggatgaacatatccaaacaaacattttcttctctcccaaatgccgctcccctttctcatctccgttaataaaattatcat

SEQ ID NO: 98371 - DNA, 706 bp, Homo sapiens
actgcactccagcctgggcggcgggagagactctgtctcaaaaaaaaaaaagaaaaagaaaaaatgtcaacgtcactcatatcaaaataagataccatttttcttctgtcagattgttaagtgtcaagaaatttgataaaagtgttactaagcacctatgtggagaaataggcgctctcatacatggcttgtaatttaaacctctgaggagggcactttagaaatatttattccaaatcatcagtgaacatttcatttgctgctacaattccacttctaagaatttatcccatatattatgtgaatcttaggtgtaatgacaattattagaatttcataattctttgagcagccaatgtgtgttctaagagtgtcctacaccaactgctttagtcctgacagcaaccccatggggagagtcctggcactttgtattttgcagacatgactggaggcacaagagtagttagagcaagtcacaagctaacaaatggcagaggagtcagacctggctgtcccagaatcctcagttctgacactgcaataccttgcttcctggtgcagcagcatctgttctagaaaaagctggagacagtcttgtggtccctcagtagaggctgggttaggtatattatggcacacccatctagtggcatgccccatggcccttcatgaaagggaggccctttctgtattgctgcatttc

SEQ ID NO: 98372 - DNA, 467 bp, Homo sapiens
tctccaaccggtgtttcaagtacctgcagccttgaccgtacccaatacagtgctaactgagatctgtggtctaacagtgacataagtgacaggtttacctgagatctgacatttttaattcttggaaaatgcattcaaacgttgtacacaaataaccttgtacacccatggttggaggaaacacttggtgacattaggacttactgtgatagccaacaaatcagtgtgtgaacgcaggccaaccggagggtcccatgagatgcaccagcagaggtggcatgcaaggtctgagggacctggcactttttttttttttttgagacggagtctcgctctgttgcccaggccggagtacagtggcgcgatctcagcccactgcaacctctgcctcccgggttcaagcgattcttctgcctcagcctcctgagtagctgagattacaggcacctgccacgccacctgactga

SEQ ID NO: 98373 - DNA, 310 bp, Homo sapiens
ttccagaaagaaagaaacagtttttggacctcatctttttcagttgctcatccctagagcttagcaaaatgcttaatacatggtcggtacctaatatatgtttggtttttttttttttttgaatgtacaaatgaggcttttatgaaactttttttaattgggaagtcgtttgaatgccaaatttctgatttttataatttgctttccaaagttttaatgttgtcttgcctagccctaaatcagcagtcaatattatattagagattcacttttattgattctttccaaattattcatcttaattttcatg

SEQ ID NO: 98374 - DNA, 336 bp, Homo sapiens
tagagagatacagaaatcccataatcttacacaaacataaaattgccagactgtgagaatagattagacataggtggtgacttaaaaaagggtgttcaaattagtctcaagtgtgagatttgtcaactgcattggaattgggtccatttactgaggtaaataagagtgaataaataacatgtttggcaggattgatatggggttattcttgagatgttgcccttgaggtatctttaagacatcggagtaggaatgtgaagtatgcaattggatatatgaggcagaaagcgtctgggctggaggtttaacattgagtcaagtgggaagatgctatta

SEQ ID NO: 98375 - DNA, 375 bp, Homo sapiens
agagaccaacaaacttcacaagggaagtgtttatcctacctcaagagtttgagcacatgtcctctgaacccaaggcagcccctgatccacagagaataggagagacagtgccttaggtccagtgggagcaggtacgggctgctatgctggggagtctaggacaacatgagaactagtgcagctgggaggcaggcaggcagtggggctctgcctggcaccgatccacaggtcaccaaaggctttccaagtcctcacttctgccctggaagcagatggctgcgacagccaggtgtgcagaagcccgctgaggcctacaatgagcacatcagcacctcatgatggctctgaccctgagaacagaagcaacccatggcc

SEQ ID NO: 98376 - DNA, 881 bp, Homo sapiens
cccggggaggaaggcgccccaggcttttggacaagcccgggtttattggatgtggtaaaacggtgtgtacccgcccggacctttatgggaattgttcaagggagctttccccgcctgtcttaggcccgatagtttatagcttcacttgaaggagtaactttcaaccttgccagcatcactggtatgatgtatatttaattaaagcacacttttccccgaccgtatacttaaaatgacaaagccattcttttaaatatttgtgactctttcctaaagccaaagtttctgttgaattatgttttgacacacccctaagtacaaggtggtatggttgtatacacatgctgccttcttggggattcaaaaacaggtttttgattttgaatagcaattagtgatatagtgctgtttaagctactaacgataaaaggtaataacattttatacaatttccatatagtctattcattaagtaatctttttacagttgcatcaggcctgaacccgtccattcagaaagcttcaaattatagaaacaatactgttctatacgagtgaccgattatgctttctttggcctacattctttattctgcggtgaagttgaggcttataagttaaaacaaaggaactaacttactgtccaccagtttatacagaactcacagtacctatgacttttttaaactaagatctgttaaaaaagaaatctgtttcaacagatgaccgtgtacaataccgtgtggtgaaaatgaattcagacttattaaatgatgaacttgttaaatcttctcagtgtctatttatcagcacaatacacacaggagaactgttgatggcatattgaatagattttcctgaataaattgctctggaaacca

SEQ ID NO: 98377 - DNA, 820 bp, Homo sapiens
  misc_feature (25)..(25): n is a, c, g, or t
cggcgggccgctgcactccccgcgngcatccgtgcgccgcccgaggctgtctaaggagtcggcggccattttgttcttctcgtggttccagtggggagagaaggaggaagtagggagcggggtggcaggggggggacccgccgcggctgctgccaccgccgccaccaccgcctctgctcgtggcgtgggaaaggaggtgtgagtcccgggcgcgagccggcggcggcgccgctgcgggagggtcggcggtgggaaggcgatggcggatttagataaactcaacatcgacagcattatccaacggctgctggaagtgagagggtccaagcctggtaagaatgtccagcttcaggagaatgaaatcagaggactgtgcttaaagtctcgtgaaatctttctcagtcagcctatcctactagaacttgaagcaccactcaaaatatgtggtgacatccatggacaatactatgatttgctgcgactttttgagtacggtggtttcccaccagaaagcaactacctgtttcttggggactatgtggacaggggaaagcagtcattggagacgatctgcctcttactggcctacaaaataaaatatcctgagaatttttttcttctcagagggaaccatgaatgtgccagcatcaacagaatttatggattttatgatgaatgtaaaagaagatacaacattaaactatggaaaactttcacagactgttttaactgtttaccgatagcagccatcgtggatgagaagatattctgctgtcatggagttacaccgacttatcatggccaatcgggattgcacatg

SEQ ID NO: 98378 - DNA, 480 bp, Homo sapiens
gcaacgggttctctctatctagctacagcctctcggctgcgccccacttccagcgtccatattgctaatcgatcatggactgtcagttgcatcaggcctgaacccgtccattcagaaagcttcaaattatagaaacaatactgttctatacgagtgaccgattatgctttctttggcctacattctttattctgcggtgaagttgaggcttataagttaaaacaaaggaactaacttactgtccaccagtttatacagaactcacagtacctatgacttttttaaactaagatctgttaaaaaagaaatctgtttcaacagatgaccgtgtacaataccgtgtggtgaaaatgaattcagacttattaaatgatgaacttgttaaatcttctcagtgtctatttatcagcacaatacacacaggagaactgttgatggcatattgaatagattttcctgaataaattgctctggaaacca

SEQ ID NO: 98379 - DNA, 1192 bp, Homo sapiens
ggatacatggtttttaactcttacaatatgcatcccatattgtaactcgatacaataagctcttgtagattttaatggtctgtgaacagtgcaggtttcctagagaactacctcacactgagcatccttatcttctcagctcagtcattataagccatcaatcataacatcgctcattattgtcatcaactgggggaagcccatagaagagttttttaaatcactggattttattttacagtgttctgtataatataattgtttccatgtactgtttaaacctactgcaccccatgcattactgcatgtaattctagtgtgtatccagttgtcctttttctgtgtttttttcttttaaccaaaagtaaataaaatataatcatagatttcagtttttatgtcaggattattgaatttctctgtagacaaatggaacttttgaaggggtagtatccttttaaaagttctgctttcttcattttttttttttcctcattgaataggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtggttgaagatggatatgaattttttgcaaagaggcagttggtcactctgttttctgcgcccaattattgcggagagtttgacaatgcaggtgccatgatgagtgtggatgaaacactaatgtgttcttttcaggtagagcatgctttcaacatgatttccttttaatatgtttacactttgctgattgaaaaatataattgctactttttgcctagtgttcacttatgctgagtaggctaagtttttattttcccttaaccagtgtgtattatagttgaataatgtgtggatcccttgtaaaagaaaaaattaattatggcaccttttcccagtgttgaattataaatttttgcattgcatattggctccttaatgcttatggctcttttactgtaaatctaaaaccttaatgacaatgtaatgttcagctaaaattaaatccccacttgaatgtgaaaagta

SEQ ID NO: 98380 - DNA, 2496 bp, Homo sapiens
  misc_feature (25)..(25): n is a, c, g, or t
cggcgggccgctgcactccccgcgngcatccgtgcgccgcccgaggctgtctaaggagtcggcggccattttgttcttctcgtggttccagtggggagagaaggaggaagtagggagcggggtggcaggggggggacccgccgcggctgctgccaccgccgccaccaccgcctctgctcgtggcgtgggaaaggaggtgtgagtcccgggcgcgagccggcggcggcgccgctgcgggagggtcggcggtgggaaggcgatggcggatttagataaactcaacatcgacagcattatccaacggctgctggaagtgagagggtccaagcctggtaagaatgtccagcttcaggagaatgaaatcagaggactgtgcttaaagtctcgtgaaatctttctcagtcagcctatcctactagaacttgaagcaccactcaaaatatgtggtgacatccatggacaatactatgatttgctgcgactttttgagtacggtggtttcccaccagaaagcaactacctgtttcttggggactatgtggacaggggaaagcagtcattggagacgatctgcctcttactggcctacaaaataaaatatcctgagaatttttttcttctcagagggaaccatgaatgtgccagcatcaacagaatttatggattttatgatgaatgtaaaagaagatacaacattaaactatggaaaactttcacagactgttttaactgtttaccgatagcagccatcgtggatgagaagatattctgctgtcatggaggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtggttgaagatggatatgaattttttgcaaagaggcagttggtcactctgttttctgcgcccaattattgcggagagtttgacaatgcaggtgccatgatgagtgtggatgaaacactaatgtgttcttttcagattttaaagcctgcagagaaaaagaagccaaatgccacgagacctgtaacgcctccaaggggtatgatcacaaagcaagcaaagaaatagatgtcgttttgacactgcctagtcgggacttgtaacatagagtatataaccttcatttttaagactgtaatgtgtactggtcagcttgctcagatagatctgtgtttgtgggggcccttccttccatttttgatttagtgaatggcatttgctggttataacagcaaatgaaagactcttcactccaaaaagaaaagtgttttgttttttaattctctgttccttttgcaaacaattttaatgatggtgttaaagctgtacaccccaggacagtttatcctgtctgaggagtaagtgtacaattgatcttttttaattcagtacaacccataatcatgtaaatgctcattttctttaggacataaagagagccctagggtgctctgaatctgtacatgttcttgtcataaaatgcatactgttgatacaaaccactgtgaacattttttatttgagaattttgtttcaaagggattgctttttcctctcattgtcttgttatgtacaaactagtttttatagctatcaacattaggagtaactttcaaccttgccagcatcactggtatgatgtatatttaattaaagcacacttttccccgaccgtatacttaaaatgacaaagccattcttttaaatatttgtgactctttcctaaagccaaagtttctgttgaattatgttttgacacacccctaagtacaaggtggtatggttgtatacacatgctgccttcttggggattcaaaaacaggtttttgattttgaatagcaattagtgatatagtgctgtttaagctactaacgataaaaggtaataacattttatacaatttccatatagtctattcattaagtaatctttttacagttgcatcaggcctgaacccgtccattcagaaagcttcaaattatagaaacaatactgttctatacgagtgaccgattatgctttctttggcctacattctttattctgcggtgaagttgaggcttataagttaaaacaaaggaactaacttactgtccaccagtttatacagaactcacagtacctatgacttttttaaactaagatctgttaaaaaagaaatctgtttcaacagatgaccgtgtacaataccgtgtggtgaaaatgaattcagacttattaaatgatgaacttgttaaatcttctcagtgtctatttatcagcacaatacacacaggagaactgttgatggcatattgaatagattttcctgaataaattgctctggaaacca

SEQ ID NO: 98381 - DNA, 2400 bp, Homo sapiens
  misc_feature (25)..(25): n is a, c, g, or t
cggcgggccgctgcactccccgcgngcatccgtgcgccgcccgaggctgtctaaggagtcggcggccattttgttcttctcgtggttccagtggggagagaaggaggaagtagggagcggggtggcaggggggggacccgccgcggctgctgccaccgccgccaccaccgcctctgctcgtggcgtgggaaaggaggtgtgagtcccgggcgcgagccggcggcggcgccgctgcgggagggtcggcggtgggaaggcgatggcggatttagataaactcaacatcgacagcattatccaacggctgctggaagtgagagggtccaagcctggtaagaatgtccagcttcaggagaatgaaatcagaggactgtgcttaaagtctcgtgaaatctttctcagtcagcctatcctactagaacttgaagcaccactcaaaatatgtggtgacatccatggacaatactatgatttgctgcgactttttgagtacggtggtttcccaccagaaagcaactacctgtttcttggggactatgtggacaggggaaagcagtcattggagacgatctgcctcttactggcctacaaaataaaatatcctgagaatttttttcttctcagagggaaccatgaatgtgccagcatcaacagaatttatggattttatgatgaatgtaaaagaagatacaacattaaactatggaaaactttcacagactgttttaactgtttaccgatagcagccatcgtggatgagaagatattctgctgtcatggaggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtggttgaagatggatatgaattttttgcaaagaggcagttggtcactctgttttctgcgcccaattattgcggagagtttgacaatgcaggtgccatgatgagtgtggatgaaacactaatgtgttcttttcagattttaaagcctgcagagaaaaagaagccaaatgccacgagacctgtaacgcctccaaggggtatgatcacaaagcaagcaaagaaatagatgtcgttttgacactgcctagtcgggacttgtaacatagagtatataaccttcatttttaagactgtaatgtgtactggtcagcttgctcagatagatctgtgtttgtgggggcccttccttccatttttgatttagtgaatggcatttgctggttataacagcaaatgaaagactcttcactccaaaaagaaaagtgttttgttttttaattctctgttccttttgcaaacaattttaatgatggtgttaaagctgtacaccccaggacagtttatcctgtctgaggagtaagtgtacaattgatcttttttaattcagtacaacccataatcatgtaaatgctcattttctttaggacataaagagagccctagggtgctctgaatctgtacatgttcttgtcataaaatgcatactgttgatacaaaccactgtgaacattttttatttgagaattttgtttcaaagggattgctttttcctctcattgtcttgttatgtacaaactagtttttatagctatcaacattaggagtaactttcaaccttgccagcatcactggtatgatgtatatttaattaaagcacacttttccccgaccgtatacttaaaatgacaaagccattcttttaaatatttgtgactctttcctaaagccaaagtttctgttgaattatgttttgacacacccctaagtacaaggtggtatggttgtatacacatgctgccttcttggggattcaaaaacaggtttttgattttgaatagcaattagtgatatagtgctgtttaagctactaacgataaaaggtaataacattttatacaatttccatatagtctattcattaagtaatctttttacagttgcatcaggcctgaacccgtccattcagaaagcttcaaattatagaaacaatactgttctatacgagtgaccgattatgctttctttggcctacattctttattctgcggtgaagttgaggcttataagttaaaacaaaggaactaacttactgtccaccagtttatacagaactcacagtacctatgacttttttaaactaagatctgttaaaaaagaaatctgtttcaacagatgaccgtgtacaataccgtgtggtgaaaatgaattcagacttattaaatgatgaacttgtta

SEQ ID NO: 98382 - DNA, 2926 bp, Homo sapiens
  misc_feature (25)..(25): n is a, c, g, or t
cggcgggccgctgcactccccgcgngcatccgtgcgccgcccgaggctgtctaaggagtcggcggccattttgttcttctcgtggttccagtggggagagaaggaggaagtagggagcggggtggcaggggggggacccgccgcggctgctgccaccgccgccaccaccgcctctgctcgtggcgtgggaaaggaggtgtgagtcccgggcgcgagccggcggcggcgccgctgcgggagggtcggcggtgggaaggcgatggcggatttagataaactcaacatcgacagcattatccaacggctgctggaagtgagagggtccaagcctggtaagaatgtccagcttcaggagaatgaaatcagaggactgtgcttaaagtctcgtgaaatctttctcagtcagcctatcctactagaacttgaagcaccactcaaaatatgtggtgacatccatggacaatactatgatttgctgcgactttttgagtacggtggtttcccaccagaaagcaactacctgtttcttggggactatgtggacaggggaaagcagtcattggagacgatctgcctcttactggcctacaaaataaaatatcctgagaatttttttcttctcagagggaaccatgaatgtgccagcatcaacagaatttatggattttatgatgaatgtaaaagaagatacaacattaaactatggaaaactttcacagactgttttaactgtttaccgatagcagccatcgtggatgagaagatattctgctgtcatggaggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtggttgaagatggatatgaattttttgcaaagaggcagttggtcactctgttttctgcgcccaattattgcggagagtttgacaatgcaggtgccatgatgagtgtggatgaaacactaatgtgttcttttcagattttaaagcctgcagagaaaaagaagccaaatgccacgagacctgtaacgcctccaaggggtatgatcacaaagcaagcaaagaaatagatgtcgttttgacactgcctagtcgggacttgtaacatagagtatataaccttcatttttaagactgtaatgtgtactggtcagcttgctcagatagatctgtgtttgtgggggcccttccttccatttttgatttagtgaatggcatttgctggttataacagcaaatgaaagactcttcactccaaaaagaaaagtgttttgttttttaattctctgttccttttgcaaacaattttaatgatggtgttaaagctgtacaccccaggacagtttatcctgtctgaggagtaagtgtacaattgatcttttttaattcagtacaacccataatcatgtaaatgctcattttctttaggacataaagagagccctagggtgctctgaatctgtacatgttcttgtcataaaatgcatactgttgatacaaaccactgtgaacattttttatttgagaattttgtttcaaagggattgctttttcctctcattgtcttgttatgtacaaactagtttttatagctatcaacattaggagtaactttcaaccttgccagcatcactggtatgatgtatatttaattaaagcacacttttccccgaccgtatacttaaaatgacaaagccattcttttaaatatttgtgactctttcctaaagccaaagtttctgttgaattatgttttgacacacccctaagtacaaggtggtatggttgtatacacatgctgccttcttggggattcaaaaacaggtttttgattttgaatagcaattagtgatatagtgctgtttaagctactaacgataaaaggtaataacattttatacaatttccatatagtctattcattaagtaatctttttacagttgcatcaggcctgaacccgtccattcagaaagcttcaaattatagaaacaatactgttctatacgagtgaccgattatgctttctttggcctacattctttattctgcggtgaagttgaggcttataagttaaaacaaaggaactaacttactgtccaccagtttatacagaactcacagtacctatgacttttttaaactaagatctgttaaaaaagaaatctgtttcaacagatgaccgtgtacaataccgtgtggtgaaaatgaattcagacttattaaatgatgaacttgttaaatcttctcagtgtctatttatcagcacaatacacacaggagaactgttgatggcatattgaatagattttcctgaataaattgctctggaaaccaaaaaaaaaaaaaaaaacaaaacaaaacaaaaaaaacaacaaacacacaaacaacaaaaaaaaagggggggagcaacacatagggagcgccccaagggagggcccaaccccagaaggcgcacaccaaatcattatatccgaacccgagggagccccctcagacgaaacacccaccaaaatcaaagaacagcacgcacgcgaacgccgcacacaacacccggcgagccccagtcgaaaaccaacgcagaaccgaacagccccacacacaaaggaccaccagtcgcgaggcgacctgaccaaatgggggaaaaaaaacccaaggaagacaacacccacgagtaaagcacacaagtacaaggatacaacgctcacaacgaccgatctacgagcgaagaaacggccaggtgttacgcaaagaacagaacataaca

SEQ ID NO: 98383 - DNA, 2493 bp, Homo sapiens
  misc_feature (25)..(25): n is a, c, g, or t
  misc_feature (2107)..(2107): n is a, c, g, or t
  misc_feature (2114)..(2114): n is a, c, g, or t
  misc_feature (2127)..(2127): n is a, c, g, or t
  misc_feature (2137)..(2137): n is a, c, g, or t
  misc_feature (2165)..(2165): n is a, c, g, or t
  misc_feature (2172)..(2172): n is a, c, g, or t
  misc_feature (2181)..(2181): n is a, c, g, or t
  misc_feature (2206)..(2206): n is a, c, g, or t
  misc_feature (2215)..(2215): n is a, c, g, or t
cggcgggccgctgcactccccgcgngcatccgtgcgccgcccgaggctgtctaaggagtcggcggccattttgttcttctcgtggttccagtggggagagaaggaggaagtagggagcggggtggcaggggggggacccgccgcggctgctgccaccgccgccaccaccgcctctgctcgtggcgtgggaaaggaggtgtgagtcccgggcgcgagccggcggcggcgccgctgcgggagggtcggcggtgggaaggcgatggcggatttagataaactcaacatcgacagcattatccaacggctgctggaagtgagagggtccaagcctggtaagaatgtccagcttcaggagaatgaaatcagaggactgtgcttaaagtctcgtgaaatctttctcagtcagcctatcctactagaacttgaagcaccactcaaaatatgtggtgacatccatggacaatactatgatttgctgcgactttttgagtacggtggtttcccaccagaaagcaactacctgtttcttggggactatgtggacaggggaaagcagtcattggagacgatctgcctcttactggcctacaaaataaaatatcctgagaatttttttcttctcagagggaaccatgaatgtgccagcatcaacagaatttatggattttatgatgaatgtaaaagaagatacaacattaaactatggaaaactttcacagactgttttaactgtttaccgatagcagccatcgtggatgagaagatattctgctgtcatggaggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtggttgaagatggatatgaattttttgcaaagaggcagttggtcactctgttttctgcgcccaattattgcggagagtttgacaatgcaggtgccatgatgagtgtggatgaaacactaatgtgttcttttcagattttaaagcctgcagagaaaaagaagccaaatgccacgagacctgtaacgcctccaaggggtatgatcacaaagcaagcaaagaaatagatgtcgttttgacactgcctagtcgggacttgtaacatagagtatataaccttcatttttaagactgtaatgtgtactggtcagcttgctcagatagatctgtgtttgtgggggcccttccttccatttttgatttagtgaatggcatttgctggttataacagcaaatgaaagactcttcactccaaaaagaaaagtgttttgttttttaattctctgttccttttgcaaacaattttaatgatggtgttaaagctgtacaccccaggacagtttatcctgtctgaggagtaagtgtacaattgatcttttttaattcagtacaacccataatcatgtaaatgctcattttctttaggacataaagagagccctagggtgctctgaatctgtacatgttcttgtcataaaatgcatactgttgatacaaaccactgtgaacattttttatttgagaattttgtttcaaagggattgctttttcctctcattgtcttgttatgtacaaactagtttttatagctatcaacattaggagtaactttcaaccttgccagcatcactggtatgatgtatatttaattaaagcacacttttccccgaccgtatacttaaaatgacaaagccattcttttaaatatttgtgactctttcctaaagccaaagtttctgttgaattatgttttgacacacccctaagtacaaggtggtatggttgtatacacatgctgccttcttggggattcaaaaacaggtttttgattttgaatagcaattagtgatatagtgctgtttaagctactaacgataaaaggtaataacattttatacaatttccatatagtctattcattaagtaatctttttacccccccnccccccnccccccccatccncaaacccccnaaaaaaaaaaacaaaaccaaccaaaacnaaaaacnaaataaacnaacaataaccaacaaacaataaacngcggagaanttgaggcttataagttaaaacaaaggaactaacttactgtccaccagtttatacagaactcacagtacctatgacttttttaaactaagatctgttaaaaaagaaatctgtttcaacagatgaccgtgtacaataccgtgtggtgaaaatgaattcagacttattaaatgatgaacttgttaaatcttctcagtgtctatttatcagcacaatacacacaggagaactgttgatggcatattgaatagattttcctgaataaattgctctggaaacca

SEQ ID NO: 98384 - DNA, 2442 bp, Homo sapiens
  misc_feature (25)..(25): n is a, c, g, or t
cggcgggccgctgcactccccgcgngcatccgtgcgccgcccgaggctgtctaaggagtcggcggccattttgttcttctcgtggttccagtggggagagaaggaggaagtagggagcggggtggcaggggggggacccgccgcggctgctgccaccgccgccaccaccgcctctgctcgtggcgtgggaaaggaggtgtgagtcccgggcgcgagccggcggcggcgccgctgcgggagggtcggcggtgggaaggcgatggcggatttagataaactcaacatcgacagcattatccaacggctgctggaagtgagagggtccaagcctggtaagaatgtccagcttcaggagaatgaaatcagaggactgtgcttaaagtctcgtgaaatctttctcagtcagcctatcctactagaacttgaagcaccactcaaaatatgtggtgacatccatggacaatactatgatttgctgcgactttttgagtacggtggtttcccaccagaaagcaactacctgtttcttggggactatgtggacaggggaaagcagtcattggagacgatctgcctcttactggcctacaaaataaaatatcctgagaatttttttcttctcagagggaaccatgaatgtgccagcatcaacagaatttatggattttatgatgaatgtaaaagaagatacaacattaaactatggaaaactttcacagactgttttaactgtttaccgatagcagccatcgtggatgagaagatattctgctgtcatggaggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtggttgaagatggatatgaattttttgcaaagaggcagttggtcactctgttttctgcgcccaattattgcggagagtttgacaatgcaggtgccatgatgagtgtggatgaaacactaatgtgttcttttcagattttaaagcctgcagagaaaaagaagccaaatgccacgagacctgtaacgcctccaaggggtatgatcacaaagcaagcaaagaaatagatgtcgttttgacactgcctagtcgggacttgtaacatagagtatataaccttcatttttaagactgtaatgtgtactggtcagcttgctcagatagatctgtgtttgtgggggcccttccttccatttttgatttagtgaatggcatttgctggttataacagcaaatgaaagactcttcactccaaaaagaaaagtgttttgttttttaattctctgttccttttgcaaacaattttaatgatggtgttaaagctgtacaccccaggacagtttatcctgtctgaggagtaagtgtacaattgatcttttttaattcagtacaacccataatcatgtaaatgctcattttctttaggacataaagagagccctagggtgctctgaatctgtacatgttcttgtcatgtttcaaagggattgctttttcctctcattgtcttgttatgtacaaactagtttttatagctatcaacattaggagtaactttcaaccttgccagcatcactggtatgatgtatatttaattaaagcacacttttccccgaccgtatacttaaaatgacaaagccattcttttaaatatttgtgactctttcctaaagccaaagtttctgttgaattatgttttgacacacccctaagtacaaggtggtatggttgtatacacatgctgccttcttggggattcaaaaacaggtttttgattttgaatagcaattagtgatatagtgctgtttaagctactaacgataaaaggtaataacattttatacaatttccatatagtctattcattaagtaatctttttacagttgcatcaggcctgaacccgtccattcagaaagcttcaaattatagaaacaatactgttctatacgagtgaccgattatgctttctttggcctacattctttattctgcggtgaagttgaggcttataagttaaaacaaaggaactaacttactgtccaccagtttatacagaactcacagtacctatgacttttttaaactaagatctgttaaaaaagaaatctgtttcaacagatgaccgtgtacaataccgtgtggtgaaaatgaattcagacttattaaatgatgaacttgttaaatcttctcagtgtctatttatcagcacaatacacacaggagaactgttgatggcatattgaatagattttcctgaataaattgctctggaaacca

SEQ ID NO: 98385 - DNA, 1801 bp, Homo sapiens
  misc_feature (25)..(25): n is a, c, g, or t
cggcgggccgctgcactccccgcgngcatccgtgcgccgcccgaggctgtctaaggagtcggcggccattttgttcttctcgtggttccagtggggagagaaggaggaagtagggagcggggtggcaggggggggacccgccgcggctgctgccaccgccgccaccaccgcctctgctcgtggcgtgggaaaggaggtgtgagtcccgggcgcgagccggcggcggcgccgctgcgggagggtcggcggtgggaaggcgatggcggatttagataaactcaacatcgacagcattatccaacggctgctggaagtgagagggtccaagcctggtaagaatgtccagcttcaggagaatgaaatcagaggactgtgcttaaagtctcgtgaaatctttctcagtcagcctatcctactagaacttgaagcaccactcaaaatatgtggtgacatccatggacaatactatgatttgctgcgactttttgagtacggtggtttcccaccagaaagcaactacctgtttcttggggactatgtggacaggggaaagcagtcattggagacgatctgcctcttactggcctacaaaataaaatatcctgagaatttttttcttctcagagggaaccatgaatgtgccagcatcaacagaatttatggattttatgatgaatgtaaaagaagatacaacattaaactatggaaaactttcacagactgttttaactgtttaccgatagcagccatcgtggatgagaagatattctgctgtcatggaggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtggttgaagatggatatgaattttttgcaaagaggcagttggtcactctgttttctgcgcccaattattgcggagagtttgacaatgcaggtgccatgatgagtgtggatgaaacactaatgtgttcttttcagattttaaagcctgcagagaaaaagaagccaaatgccacgagacctgtaacgcctccaaggggtatgatcacaaagcaagcaaagaaatagatgtcgttttgacactgcctagtcgggacttgtaacatagagtatataaccttcatttttaagactgtaatgtgtactggtcagcttgctcagatagatctgtgtttgtgggggcccttccttccatttttgatttagtgaatggcatttgctggttataacagcaaatgaaagactcttcactccaaaaagaaaagtgttttgttttttaattctctgttccttttgcaaacaattttaatgatggtgttaaagctgtacaccccaggacagtttatcctgtctgaggagtaagtgtacaattgatcttttttaattcagtacaacccataatcatgtaaatgctcattttctttaggacataaagagagccctagggtgctctgaatctgtacatgttcttgtcataaaatgcatactgttgatacaaaccactgtgaacattttttatttgagaattttgtttcaaagggattgctttttcctctcattgtcttgttatgtacaaactagtttttatagctatcaacattcagaatggtaacaccattctgatgttggagcggccgc

SEQ ID NO: 98386 - DNA, 1763 bp, Homo sapiens
  misc_feature (9)..(9): n is a, c, g, or t
  misc_feature (13)..(15): n is a, c, g, or t
ggggggggngggnnnaaaactaacggctaggtagcgaggccgggtgttggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtggttgaagatggatatgaattttttgcaaagaggcagttggtcactctgttttctgcgcccaattattgcggagagtttgacaatgcaggtgccatgatgagtgtggatgaaacactaatgtgttcttttcagattttaaagcctgcagagaaaaagaagccaaatgccacgagacctgtaacgcctccaaggggtatgatcacaaagcaagcaaagaaatagatgtcgttttgacactgcctagtcgggacttgtaacatagagtatataaccttcatttttaagactgtaatgtgtactggtcagcttgctcagatagatctgtgtttgtgggggcccttccttccatttttgatttagtgaatggcatttgctggttataacagcaaatgaaagactcttcactccaaaaagaaaagtgttttgttttttaattctctgttccttttgcaaacaattttaatgatggtgttaaagctgtacaccccaggacagtttatcctgtctgaggagtaagtgtacaattgatcttttttaattcagtacaacccataatcatgtaaatgctcattttctttaggacataaagagagccctagggtgctctgaatctgtacatgttcttgtcataaaatgcatactgttgatacaaaccactgtgaacattttttatttgagaattttgtttcaaagggattgctttttcctctcattgtcttgttatgtacaaactagtttttatagctatcaacattaggagtaactttcaaccttgccagcatcactggtatgatgtatatttaattaaagcacacttttccccgaccgtatacttaaaatgacaaagccattcttttaaatatttgtgactctttcctaaagccaaagtttctgttgaattatgttttgacacacccctaagtacaaggtggtatggttgtatacacatgctgccttcttggggattcaaaaacaggtttttgattttgaatagcaattagtgatatagtgctgtttaagctactaacgataaaaggtaataacattttatacaatttccatatagtctattcattaagtaatctttttacagttgcatcaggcctgaacccgtccattcagaaagcttcaaattatagaaacaatactgttctatacgagtgaccgattatgctttctttggcctacattctttattctgcggtgaagttgaggcttataagttaaaacaaaggaactaacttactgtccaccagtttatacagaactcacagtacctatgacttttttaaactaagatctgttaaaaaagaaatctgtttcaacagatgaccgtgtacaataccgtgtggtgaaaatgaattcagacttattaaatgatgaacttgttaaatcttctcagtgtctatttatcagcacaatacacacaggagaactgttgatggcatattgaatagattttcctgaataaattgctctggaaacca

SEQ ID NO: 98387 - DNA, 2217 bp, Homo sapiens
ggatacatggtttttaactcttacaatatgcatcccatattgtaactcgatacaataagctcttgtagattttaatggtctgtgaacagtgcaggtttcctagagaactacctcacactgagcatccttatcttctcagctcagtcattataagccatcaatcataacatcgctcattattgtcatcaactgggggaagcccatagaagagttttttaaatcactggattttattttacagtgttctgtataatataattgtttccatgtactgtttaaacctactgcaccccatgcattactgcatgtaattctagtgtgtatccagttgtcctttttctgtgtttttttcttttaaccaaaagtaaataaaatataatcatagatttcagtttttatgtcaggattattgaatttctctgtagacaaatggaacttttgaaggggtagtatccttttaaaagttctgctttcttcattttttttttttcctcattgaataggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtggttgaagatggatatgaattttttgcaaagaggcagttggtcactctgttttctgcgcccaattattgcggagagtttgacaatgcaggtgccatgatgagtgtggatgaaacactaatgtgttcttttcagattttaaagcctgcagagaaaaagaagccaaatgccacgagacctgtaacgcctccaaggggtatgatcacaaagcaagcaaagaaatagatgtcgttttgacactgcctagtcgggacttgtaacatagagtatataaccttcatttttaagactgtaatgtgtactggtcagcttgctcagatagatctgtgtttgtgggggcccttccttccatttttgatttagtgaatggcatttgctggttataacagcaaatgaaagactcttcactccaaaaagaaaagtgttttgttttttaattctctgttccttttgcaaacaattttaatgatggtgttaaagctgtacaccccaggacagtttatcctgtctgaggagtaagtgtacaattgatcttttttaattcagtacaacccataatcatgtaaatgctcattttctttaggacataaagagagccctagggtgctctgaatctgtacatgttcttgtcataaaatgcatactgttgatacaaaccactgtgaacattttttatttgagaattttgtttcaaagggattgctttttcctctcattgtcttgttatgtacaaactagtttttatagctatcaacattaggagtaactttcaaccttgccagcatcactggtatgatgtatatttaattaaagcacacttttccccgaccgtatacttaaaatgacaaagccattcttttaaatatttgtgactctttcctaaagccaaagtttctgttgaattatgttttgacacacccctaagtacaaggtggtatggttgtatacacatgctgccttcttggggattcaaaaacaggtttttgattttgaatagcaattagtgatatagtgctgtttaagctactaacgataaaaggtaataacattttatacaatttccatatagtctattcattaagtaatctttttacagttgcatcaggcctgaacccgtccattcagaaagcttcaaattatagaaacaatactgttctatacgagtgaccgattatgctttctttggcctacattctttattctgcggtgaagttgaggcttataagttaaaacaaaggaactaacttactgtccaccagtttatacagaactcacagtacctatgacttttttaaactaagatctgttaaaaaagaaatctgtttcaacagatgaccgtgtacaataccgtgtggtgaaaatgaattcagacttattaaatgatgaacttgttaaatcttctcagtgtctatttatcagcacaatacacacaggagaactgttgatggcatattgaatagattttcctgaataaattgctctggaaacca

SEQ ID NO: 98388 - DNA, 1471 bp, Homo sapiens
  misc_feature (25)..(25): n is a, c, g, or t
cggcgggccgctgcactccccgcgngcatccgtgcgccgcccgaggctgtctaaggagtcggcggccattttgttcttctcgtggttccagtggggagagaaggaggaagtagggagcggggtggcaggggggggacccgccgcggctgctgccaccgccgccaccaccgcctctgctcgtggcgtgggaaaggaggtgtgagtcccgggcgcgagccggcggcggcgccgctgcgggagggtcggcggtgggaaggcgatggcggatttagataaactcaacatcgacagcattatccaacggctgctggaagtgagagggtccaagcctggtaagaatgtccagcttcaggagaatgaaatcagaggactgtgcttaaagtctcgtgaaatctttctcagtcagcctatcctactagaacttgaagcaccactcaaaatatgtggtgacatccatggacaatactatgatttgctgcgactttttgagtacggtggtttcccaccagaaagcaactacctgtttcttggggactatgtggacaggggaaagcagtcattggagacgatctgcctcttactggcctacaaaataaaatatcctgagaatttttttcttctcagagggaaccatgaatgtgccagcatcaacagaatttatggattttatgatgaatgtaaaagaagatacaacattaaactatggaaaactttcacagactgttttaactgtttaccgatagcagccatcgtggatgagaagatattctgctgtcatggaggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtggttgaagatggatatgaattttttgcaaagaggcagttggtcactctgttttctgcgcccaattattgcggagagtttgacaatgcaggtgccatgatgagtgtggatgaaacactaatgtgttcttttcaggtagagcatgctttcaacatgatttccttttaatatgtttacactttgctgattgaaaaatataattgctactttttgcctagtgttcacttatgctgagtaggctaagtttttattttcccttaaccagtgtgtattatagttgaataatgtgtggatcccttgtaaaagaaaaaattaattatggcaccttttcccagtgttgaattataaatttttgcattgcatattggctccttaatgcttatggctcttttactgtaaatctaaaaccttaatgacaatgtaatgttcagctaaaattaaatccccacttgaatgtgaaaagta

SEQ ID NO: 98389 - DNA, 1071 bp, Homo sapiens
  misc_feature (25)..(25): n is a, c, g, or t
cggcgggccgctgcactccccgcgngcatccgtgcgccgcccgaggctgtctaaggagtcggcggccattttgttcttctcgtggttccagtggggagagaaggaggaagtagggagcggggtggcaggggggggacccgccgcggctgctgccaccgccgccaccaccgcctctgctcgtggcgtgggaaaggaggtgtgagtcccgggcgcgagccggcggcggcgccgctgcgggagggtcggcggtgggaaggcgatggcggatttagataaactcaacatcgacagcattatccaacggctgctggaagtgagagggtccaagcctggtaagaatgtccagcttcaggagaatgaaatcagaggactgtgcttaaagtctcgtgaaatctttctcagtcagcctatcctactagaacttgaagcaccactcaaaatatgtggtgacatccatggacaatactatgatttgctgcgactttttgagtacggtggtttcccaccagaaagcaactacctgtttcttggggactatgtggacaggggaaagcagtcattggagacgatctgcctcttactggcctacaaaataaaatatcctgagaatttttttcttctcagagggaaccatgaatgtgccagcatcaacagaatttatggattttatgatgaatgtaaaagaagatacaacattaaactatggaaaactttcacagactgttttaactgtttaccgatagcagccatcgtggatgagaagatattctgctgtcatggaggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtattgattttgaattttacatgtacacttaagagcatgtgtgtgagcacaattctccttgttga

SEQ ID NO: 98390 - DNA, 1067 bp, Homo sapiens
cggacgcgtgggtcgacccacgcgtccgtgcaaacaattttaatgatggtgttaaagctgtacaccccaggacagtttatcctgtctgaggagtaagtgtacaattgatcttttttaattcagtacaacccataatcatgtaaatgctcattttctttaggacataaagagagccctagggtgctctgaatctgtacatgttcttgtcataaaatgcatactgttgatacaaaccactgtgaacattttttatttgagaattttgtttcaaagggattgctttttcctctcattgtcttgttatgtacaaactagtttttatagctatcaacattaggagtaactttcaaccttgccagcatcactggtatgatgtatatttaattaaagcacacttttccccgaccgtatacttaaaatgacaaagccattcttttaaatatttgtgactctttcctaaagccaaagtttctgttgaattatgttttgacacacccctaagtacaaggtggtatggttgtatacacatgctgccttcttggggattcaaaaacaggtttttgattttgaatagcaattagtgatatagtgctgtttaagctactaacgataaaaggtaataacattttatacaatttccatatagtctattcattaagtaatctttttacagttgcatcaggcctgaacccgtccattcagaaagcttcaaattatagaaacaatactgttctatacgagtgaccgattatgctttctttggcctacattctttattctgcggtgaagttgaggcttataagttaaaacaaaggaactaacttactgtccaccagtttatacagaactcacagtacctatgacttttttaaactaagatctgttaaaaaagaaatctgtttcaacagatgaccgtgtacaataccgtgtggtgaaaatgaattcagacttattaaatgatgaacttgttaaatcttctcagtgtctatttatcagcacaatacacacaggagaactgttgatggcatattgaatagattttcctgaataaattgctctggaaacca

SEQ ID NO: 98391 - DNA, 361 bp, Homo sapiens
cttgaggatcccggtcattgctatacctatacgagtgaccgattatgctttctttggcctacattctttattctgcggtgaagttgaggcttataagttaaaacaaaggaactaacttactgtccaccagtttatacagaactcacagtacctatgacttttttaaactaagatctgttaaaaaagaaatctgtttcaacagatgaccgtgtacaataccgtgtggtgaaaatgaattcagacttattaaatgatgaacttgttaaatcttctcagtgtctatttatcagcacaatacacacaggagaactgttgatggcatattgaatagattttcctgaataaattgctctggaaacca

SEQ ID NO: 98392 - DNA, 2542 bp, Homo sapiens
  misc_feature (25)..(25): n is a, c, g, or t
cggcgggccgctgcactccccgcgngcatccgtgcgccgcccgaggctgtctaaggagtcggcggccattttgttcttctcgtggttccagtggggagagaaggaggaagtagggagcggggtggcaggggggggacccgccgcggctgctgccaccgccgccaccaccgcctctgctcgtggcgtgggaaaggaggtgtgagtcccgggcgcgagccggcggcggcgccgctgcgggagggtcggcggtgggaaggcgatggcggatttagataaactcaacatcgacagcattatccaacggctgctggaagtgagagggtccaagcctggtaagaatgtccagcttcaggagaatgaaatcagaggactgtgcttaaagtctcgtgaaatctttctcagtcagcctatcctactagaacttgaagcaccactcaaaatatgtggtgacatccatggacaatactatgatttgctgcgactttttgagtacggtggtttcccaccagaaagcaactacctgtttcttggggactatgtggacaggggaaagcagtcattggagacgatctgcctcttactggcctacaaaataaaatatcctgagaatttttttcttctcagagggaaccatgaatgtgccagcatcaacagaatttatggattttatgatgaatgtaaaagaagatacaacattaaactatggaaaactttcacagactgttttaactgtttaccgatagcagccatcgtggatgagaagatattctgctgtcatggaggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtggttgaagatggatatgaattttttgcaaagaggcagttggtcactctgttttctgcgcccaattattgcggagagtttgacaatgcaggtgccatgatgagtgtggatgaaacactaatgtgttcttttcagattttaaagcctgcagagaaaaagaagccaaatgccacgagacctgtaacgcctccaaggggtatgatcacaaagcaagcaaagaaatagatgtcgttttgacactgcctagtcgggacttgtaacatagagtatataaccttcatttttaagactgtaatgtgtactggtcagcttgctcagatagatctgtgtttgtgggggcccttccttccatttttgatttagtgaatggcatttgctggttataacagcaaatgaaagactcttcactccaaaaagaaaagtgttttgttttttaattctctgttccttttgcaaacaattttaatgatggtgttaaagctgtacaccccaggacagtttatcctgtctgaggagtaagtgtacaattgatcttttttaattcagtacaacccataatcatgtaaatgctcattttctttaggacataaagagagccctagggtgctctgaatctgtacatgttcttgtcataaaatgcatactgttgatacaaaccactgtgaacattttttatttgagaattttgtttcaaagggattgctttttcctctcattgtcttgttatgtacaaactagtttttatagctatcaacattaggagtaactttcaaccttgccagcatcactggtatgatgtatatttaattaaagcacacttttccccgaccgtatacttaaaatgacaaagccattcttttaaatatttgtgactctttcctaaagccaaagtttctgttgaattatgttttgacacacccctaagtacaaggtggtatggttgtatacacatgctgccttcttggggattcaaaaacaggtttttgattttgaatagcaattagtgatatagtgctgtttaagctactaacgataaaaggtaataacattttatacaatttccatatagtctattcattaagtaatctttttacagttgcatcaggcctgaacccgtccattcagaaagcttcaaattatagaaacaatactgttctatacgagtgaccgattatgctttctttggcctacattctttattctgcggtgaagttgaggcttataagttaaaacaaaggaactaacttactgtccaccagtttatacagaactcacagtacctatgacttttttaaactaagatctgttaaaaaagaaatctgtttcaacagatgaccgtgtacaataccgtgtggtgaaaatgaattcagacttattaaatgatgaacttgttaaatcttctcagtgtctatttatcagcacaatacacacaggagaactgttgatggcatattgaatagattttcctgaataaattgctctggaaaccaaaaaaaaaaataatattcactggctcgccgtttaccgtcgtgctgg

SEQ ID NO: 98393 - DNA, 2427 bp, Homo sapiens
cggacgcgtgggtcgacccacgcgtccggagaaggaggaagtagggagcggggtggcaggggggggacccgccgcggctgctgccaccgccgccaccaccgcctctgctcgtggcgtgggaaaggaggtgtgagtcccgggcgcgagccggcggcggcgccgctgcgggagggtcggcggtgggaaggcgatggcggatttagataaactcaacatcgacagcattatccaacggctgctggaagtgagagggtccaagcctggtaagaatgtccagcttcaggagaatgaaatcagaggactgtgcttaaagtctcgtgaaatctttctcagtcagcctatcctactagaacttgaagcaccactcaaaatatgtggtgacatccatggacaatactatgatttgctgcgactttttgagtacggtggtttcccaccagaaagcaactacctgtttcttggggactatgtggacaggggaaagcagtcattggagacgatctgcctcttactggcctacaaaataaaatatcctgagaatttttttcttctcagagggaaccatgaatgtgccagcatcaacagaatttatggattttatgatgaatgtaaaagaagatacaacattaaactatggaaaactttcacagactgttttaactgtttaccgatagcagccatcgtggatgagaagatattctgctgtcatggaggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtggttgaagatggatatgaattttttgcaaagaggcagttggtcactctgttttctgcgcccaattattgcggagagtttgacaatgcaggtgccatgatgagtgtggatgaaacactaatgtgttcttttcagattttaaagcctgcagagaaaaagaagccaaatgccacgagacctgtaacgcctccaaggggtatgatcacaaagcaagcaaagaaatagatgtcgttttgacactgcctagtcgggacttgtaacatagagtatataaccttcatttttaagactgtaatgtgtactggtcagcttgctcagatagatctgtgtttgtgggggcccttccttccatttttgatttagtgaatggcatttgctggttataacagcaaatgaaagactcttcactccaaaaagaaaagtgttttgttttttaattctctgttccttttgcaaacaattttaatgatggtgttaaagctgtacaccccaggacagtttatcctgtctgaggagtaagtgtacaattgatcttttttaattcagtacaacccataatcatgtaaatgctcattttctttaggacataaagagagccctagggtgctctgaatctgtacatgttcttgtcataaaatgcatactgttgatacaaaccactgtgaacattttttatttgagaattttgtttcaaagggattgctttttcctctcattgtcttgttatgtacaaactagtttttatagctatcaacattaggagtaactttcaaccttgccagcatcactggtatgatgtatatttaattaaagcacacttttccccgaccgtatacttaaaatgacaaagccattcttttaaatatttgtgactctttcctaaagccaaagtttctgttgaattatgttttgacacacccctaagtacaaggtggtatggttgtatacacatgctgccttcttggggattcaaaaacaggtttttgattttgaatagcaattagtgatatagtgctgtttaagctactaacgataaaaggtaataacattttatacaatttccatatagtctattcattaagtaatctttttacagttgcatcaggcctgaacccgtccattcagaaagcttcaaattatagaaacaatactgttctatacgagtgaccgattatgctttctttggcctacattctttattctgcggtgaagttgaggcttataagttaaaacaaaggaactaacttactgtccaccagtttatacagaactcacagtacctatgacttttttaaactaagatctgttaaaaaagaaatctgtttcaacagatgaccgtgtacaataccgtgtggtgaaaatgaattcagacttattaaatgatgaacttgttaaatcttctcagtgtctatttatcagcacaatacacacaggagaactgttgatggcatattgaatagattttcctgaataaattgctctggaaacca

SEQ ID NO: 98394 - DNA, 1974 bp, Homo sapiens
ttattcagtcacgggcggggttttcaatgttacattacatgtgccgtgggtctgtacaatttccaataaaataaaatatcctgagaatttttttcttctcagagggaaccatgaatgtgccagcatcaacagaatttatggattttatgatgaatgtaaaagaagatacaacattaaactatggaaaactttcacagactgttttaactgtttaccgatagcagccatcgtggatgagaagatattctgctgtcatggaggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtggttgaagatggatatgaattttttgcaaagaggcagttggtcactctgttttctgcgcccaattattgcggagagtttgacaatgcaggtgccatgatgagtgtggatgaaacactaatgtgttcttttcagattttaaagcctgcagagaaaaagaagccaaatgccacgagacctgtaacgcctccaaggggtatgatcacaaagcaagcaaagaaatagatgtcgttttgacactgcctagtcgggacttgtaacatagagtatataaccttcatttttaagactgtaatgtgtactggtcagcttgctcagatagatctgtgtttgtgggggcccttccttccatttttgatttagtgaatggcatttgctggttataacagcaaatgaaagactcttcactccaaaaagaaaagtgttttgttttttaattctctgttccttttgcaaacaattttaatgatggtgttaaagctgtacaccccaggacagtttatcctgtctgaggagtaagtgtacaattgatcttttttaattcagtacaacccataatcatgtaaatgctcattttctttaggacataaagagagccctagggtgctctgaatctgtacatgttcttgtcataaaatgcatactgttgatacaaaccactgtgaacattttttatttgagaattttgtttcaaagggattgctttttcctctcattgtcttgttatgtacaaactagtttttatagctatcaacattaggagtaactttcaaccttgccagcatcactggtatgatgtatatttaattaaagcacacttttccccgaccgtatacttaaaatgacaaagccattcttttaaatatttgtgactctttcctaaagccaaagtttctgttgaattatgttttgacacacccctaagtacaaggtggtatggttgtatacacatgctgccttcttggggattcaaaaacaggtttttgattttgaatagcaattagtgatatagtgctgtttaagctactaacgataaaaggtaataacattttatacaatttccatatagtctattcattaagtaatctttttacagttgcatcaggcctgaacccgtccattcagaaagcttcaaattatagaaacaatactgttctatacgagtgaccgattatgctttctttggcctacattctttattctgcggtgaagttgaggcttataagttaaaacaaaggaactaacttactgtccaccagtttatacagaactcacagtacctatgacttttttaaactaagatctgttaaaaaagaaatctgtttcaacagatgaccgtgtacaataccgtgtggtgaaaatgaattcagacttattaaatgatgaacttgttaaatcttctcagtgtctatttatcagcacaatacacacaggagaactgttgatggcatattgaatagattttcctgaataaattgctctggaaacca

SEQ ID NO: 98395 - DNA, 1598 bp, Homo sapiens
  misc_feature (25)..(25): n is a, c, g, or t
cggcgggccgctgcactccccgcgngcatccgtgcgccgcccgaggctgtctaaggagtcggcggccattttgttcttctcgtggttccagtggggagagaaggaggaagtagggagcggggtggcaggggggggacccgccgcggctgctgccaccgccgccaccaccgcctctgctcgtggcgtgggaaaggaggtgtgagtcccgggcgcgagccggcggcggcgccgctgcgggagggtcggcggtgggaaggcgatggcggatttagataaactcaacatcgacagcattatccaacggctgctggaagtgagagggtccaagcctggtaagaatgtccagcttcaggagaatgaaatcagaggactgtgcttaaagtctcgtgaaatctttctcagtcagcctatcctactagaacttgaagcaccactcaaaatatgtggtgacatccatggacaatactatgatttgctgcgactttttgagtacggtggtttcccaccagaaagcaactacctgtttcttggggactatgtggacaggggaaagcagtcattggagacgatctgcctcttactggcctacaaaataaaatatcctgagaatttttttcttctcagagggaaccatgaatgtgccagcatcaacagaatttatggattttatgatgaatgtaaaagaagatacaacattaaactatggaaaactttcacagactgttttaactgtttaccgatagcagccatcgtggatgagaagatattctgctgtcatggaggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtggttgaagatggatatgaattttttgcaaagaggcagttggtcactctgttttctgcgcccaattattgcggagagtttgacaatgcaggtgccatgatgagtgtggatgaaacactaatgtgttcttttcagattttaaagcctgcagagaaaaagaagccaaatgccacgagacctgtaacgcctccaagggagttgcatcaggcctgaacccgtccattcagaaagcttcaaattatagaaacaatactgttctatacgagtgaccgattatgctttctttggcctacattctttattctgcggtgaagttgaggcttataagttaaaacaaaggaactaacttactgtccaccagtttatacagaactcacagtacctatgacttttttaaactaagatctgttaaaaaagaaatctgtttcaacagatgaccgtgtacaataccgtgtggtgaaaatgaattcagacttattaaatgatgaacttgttaaatcttctcagtgtctatttatcagcacaatacacacaggagaactgttgatggcatattgaatagattttcctgaataaattgctctggaaacca

SEQ ID NO: 98396 - DNA, 1502 bp, Homo sapiens
  misc_feature (25)..(25): n is a, c, g, or t
cggcgggccgctgcactccccgcgngcatccgtgcgccgcccgaggctgtctaaggagtcggcggccattttgttcttctcgtggttccagtggggagagaaggaggaagtagggagcggggtggcaggggggggacccgccgcggctgctgccaccgccgccaccaccgcctctgctcgtggcgtgggaaaggaggtgtgagtcccgggcgcgagccggcggcggcgccgctgcgggagggtcggcggtgggaaggcgatggcggatttagataaactcaacatcgacagcattatccaacggctgctggaagtgagagggtccaagcctggtaagaatgtccagcttcaggagaatgaaatcagaggactgtgcttaaagtctcgtgaaatctttctcagtcagcctatcctactagaacttgaagcaccactcaaaatatgtggtgacatccatggacaatactatgatttgctgcgactttttgagtacggtggtttcccaccagaaagcaactacctgtttcttggggactatgtggacaggggaaagcagtcattggagacgatctgcctcttactggcctacaaaataaaatatcctgagaatttttttcttctcagagggaaccatgaatgtgccagcatcaacagaatttatggattttatgatgaatgtaaaagaagatacaacattaaactatggaaaactttcacagactgttttaactgtttaccgatagcagccatcgtggatgagaagatattctgctgtcatggaggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtggttgaagatggatatgaattttttgcaaagaggcagttggtcactctgttttctgcgcccaattattgcggagagtttgacaatgcaggtgccatgatgagtgtggatgaaacactaatgtgttcttttcagattttaaagcctgcagagaaaaagaagccaaatgccacgagacctgtaacgcctccaagggagttgcatcaggcctgaacccgtccattcagaaagcttcaaattatagaaacaatactgttctatacgagtgaccgattatgctttctttggcctacattctttattctgcggtgaagttgaggcttataagttaaaacaaaggaactaacttactgtccaccagtttatacagaactcacagtacctatgacttttttaaactaagatctgttaaaaaagaaatctgtttcaacagatgaccgtgtacaataccgtgtggtgaaaatgaattcagacttattaaatgatgaacttgtta

SEQ ID NO: 98397 - DNA, 1124 bp, Homo sapiens
  misc_feature (25)..(25): n is a, c, g, or t
cggcgggccgctgcactccccgcgngcatccgtgcgccgcccgaggctgtctaaggagtcggcggccattttgttcttctcgtggttccagtggggagagaaggaggaagtagggagcggggtggcaggggggggacccgccgcggctgctgccaccgccgccaccaccgcctctgctcgtggcgtgggaaaggaggtgtgagtcccgggcgcgagccggcggcggcgccgctgcgggagggtcggcggtgggaaggcgatggcggatttagataaactcaacatcgacagcattatccaacggctgctggaagtgagagggtccaagcctggtaagaatgtccagcttcaggagaatgaaatcagaggactgtgcttaaagtctcgtgaaatctttctcagtcagcctatcctactagaacttgaagcaccactcaaaatatgtggtgacatccatggacaatactatgatttgctgcgactttttgagtacggtggtttcccaccagaaagcaactacctgtttcttggggactatgtggacaggggaaagcagtcattggagacgatctgcctcttactggcctacaaaataaaatatcctgagaatttttttcttctcagagggaaccatgaatgtgccagcatcaacagaatttatggattttatgatgaatgtaaaagaagatacaacattaaactatggaaaactttcacagactgttttaactgtttaccgatagcagccatcgtggatgagaagatattctgctgtcatggaggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtggttgaagatggatatgaattttttgcaaagaggcagttggtcactctgttttctgcgcccaattattgcggagagtttgacaatgcaggtgggtacaagtacccacctgcagagg

SEQ ID NO: 98398 - DNA, 559 bp, Homo sapiens
gagggggtttcaccatgttggccaggctggtcttgaactcctgacctcaagtgatccactcacctctgcctcccaaattgctgggattacaggctcctgccgtctgacttaatttttgtacttttagtagagacggggtttcgccatgttagccaggctggtctagaactcatgaccttaagtgatccacctgcctcagcctcccaaagtgctgggattacaggcatgagccatcatgcccggccaaattactatgaaattctatcctgccagtgctttagaataacttgcattttaaagtacatttgcacattttacatataatgctatatggttgtgtttgggctttgtgtacagatgacttttgttattaagtggaaaaggcctgaaatatgctgttctatgttaagtaaattgatataacctaagaaaagatcttgttgccaattcagaaaccataaccttaaatagcatgcctgggtctcctctgtatctggtttaacatctgcattgaatattggtattttccaataatctccaactagcttatttattttga

SEQ ID NO: 98399 - DNA, 374 bp, Homo sapiens
ctactaggagcttgagctatgtgttgttaaaatacttgaatactgctactactaactaataatagtgatgagaatggaaattttgctttgtggaaaagcgttaaacagttatcaagggcacacataaatttacctattgaaacacgaggaagggccaggtgcggtagctcacgccagtaatcccagcactttgggaggctgaggtgggtggcttacttgagctccggtgttccaaactagcctgggcaacatggtggaaacccgtctctaccaaaaatacacaaattagctgggtgtggtggtgtgcgcctgtggtcccagctgcttggggggctgaggcaggagtatcgcttgaaaacccaggaggcagaagc

SEQ ID NO: 98400 - DNA, 1306 bp, Homo sapiens
tgagacggagtcttgctttgtcgcccaggctggagtgcagtggcgtgatctcggcccattgcaagccccgcctcccgggttcacaccattctcctgcctcagcctcccgagtagctgggactacaggcatctgctaccacgcccagctaattttctgtatttttagtagagatggggtttcactgtgttagccaggatggtctctatctcctgacctcatgatccactcgcctcagcctcccaaaatgctgggattataggcgtgagccgccacgcccggcccaacaacttaatcttttattagctttgcttaagagggccaattaaatcaaagccctttagttccctttaacagggactggagttatgatgcatgtgttacgacttttggcccactgtccatgcaactctaagtgcaggttgatttgctttccagaaatcccaaaggggctgctcttggatcaccgaagagccttacctatatcaaatcaaaaagacattctgggtcagattagactatgctcctggccctacagattgcacataaactatcataaatacagctttttcagggaactagttctaaaactcttacctgctgagaataagtcttaacactaagatgactgtattatatcaatttattattagaatcagacttatacctagcacaattaactattgtgtgggcaaagaacatttaaagggcatagtagaggtaaggagagacacatactcagctagagataaaaatactaagttgcactgattacttaaaatactagtcacaccataaaagtgccctgtagtttcaaaaacacgtaagcaatgaaatgttagccattatgtgttaaactacttaatctcatttctgtgatgtgaatatttttaaccccctttttgtagatgagggaactgacaagtgacttgtccaaggccatatagctgtgagaaaacccatgcattctcttttcagagttcatgctatcactcaactttaaagtaggccaagattaatgttggtaagggtttgtaatctgtaagaatgctaaaaacgtaagtatatatatcattttagatttgacattttgtatcttgccagtttttaggagaacttttcattttgttaagtatgcatgaatatagttgagtatatgagtaactggttcttatgctgctgttttgtatttttaccagcaggaagattgcaaaagttgatgtatgtaaatcttgaaatatttctaagttttatgtataacaaaatatgtattttaataaacttcttttgatattttaaaaaaactgt

SEQ ID NO: 98401 - DNA, 1265 bp, Homo sapiens
tgagacggagtcttgctttgtcgcccaggctggagtgcagtggcgtgatctcggcccattgcaagccccgcctcccgggttcacaccattctcctgcctcagcctcccgagtagctgggactacaggcatctgctaccacgcccagctaattttctgtatttttagtagagatggggtttcactgtgttagccaggatggtctctatctcctgacctcatgatccactcgcctcagcctcccaacaacttaatcttttattagctttgcttaagagggccaattaaatcaaagccctttagttccctttaacagggactggagttatgatgcatgtgttacgacttttggcccactgtccatgcaactctaagtgcaggttgatttgctttccagaaatcccaaaggggctgctcttggatcaccgaagagccttacctatatcaaatcaaaaagacattctgggtcagattagactatgctcctggccctacagattgcacataaactatcataaatacagctttttcagggaactagttctaaaactcttacctgctgagaataagtcttaacactaagatgactgtattatatcaatttattattagaatcagacttatacctagcacaattaactattgtgtgggcaaagaacatttaaagggcatagtagaggtaaggagagacacatactcagctagagataaaaatactaagttgcactgattacttaaaatactagtcacaccataaaagtgccctgtagtttcaaaaacacgtaagcaatgaaatgttagccattatgtgttaaactacttaatctcatttctgtgatgtgaatatttttaaccccctttttgtagatgagggaactgacaagtgacttgtccaaggccatatagctgtgagaaaacccatgcattctcttttcagagttcatgctatcactcaactttaaagtaggccaagattaatgttggtaagggtttgtaatctgtaagaatgctaaaaacgtaagtatatatatcattttagatttgacattttgtatcttgccagtttttaggagaacttttcattttgttaagtatgcatgaatatagttgagtatatgagtaactggttcttatgctgctgttttgtatttttaccagcaggaagattgcaaaagttgatgtatgtaaatcttgaaatatttctaagttttatgtataacaaaatatgtattttaataaacttcttttgatattttaaaaaaactgt

SEQ ID NO: 98402 - DNA, 222 bp, Homo sapiens
ttttattattgatgttggaagttgaaactggccatatctaaatatattcattctgtttcttagtactaatgggatcttttcttagacctgggaaattttctcccattatttcttttgtttcttcccttttttctttcttttccttttctctttctagaactttctagaacaaatctcaggtcccctagatgtttcttccataattgttactatgcttctcat

SEQ ID NO: 98403 - DNA, 363 bp, Homo sapiens
tttttttttttggagaaggagtctcactctgtcgcccaggatggagtgcagtggcgcgatctcagctcactgcaacctctgcctccccggttcaagtgattctcctgcctcagcctcccgagtagctaggactacaggtgtgtgccaccacacccagctaatttttgtagttttagtagagatggggtttcaccatgttggcaaggctggtcttgaactccttacttcaagtgatccacccacctcggcctcccaaagtgctgggattacaggcatgaaccactgcacccagctcctgtcagtcttaaaacaaacataattaccataaaacccagcaacctcactcctggacatttgtcacag

SEQ ID NO: 98404 - DNA, 249 bp, Homo sapiens
tgccattttatttatttctgttttccaaggtgagctctttgggtgtaaaatgcaaagatgggatgaagagacattgcagccctctgattactcacttgggggaagtagatcaaggctatgatgttgcctgacagtgatggttgaaggcagctgagtcctgtcatggaaaatgtaaaggccctcccctttttcatttccctccaggaacttctgcctgtagtaataaagaatcctgtgttcatgcctgtg

SEQ ID NO: 98405 - DNA, 385 bp, Homo sapiens
cctgcttcttccctgtcttccccatctcataaatggcaccaccatctacctagctcttcagtacttctctttccttcactcctcacatccaatctatgagcaagttctgtggaccctatccagaaatgtgtctcatacctgcccacatccttccattgttatagctctcaccttagtccacaccaccattttcttgctagactatagcgggcctcctaactcacttatctgcttttactcttgaccctggaaataactctctataccagagccagaagggctgcagcacttaatgctaaatgcctatccattcttcccttcttctgattctgttctggaaggcaagagacccaactgaaagacaaaacttcccagcctcctcagc

SEQ ID NO: 98406 - DNA, 297 bp, Homo sapiens
aaaacatacacacacacgcaaaatacagagacactaaaaagttttctaaaaaagaaaaactattgctaatcctaatgtagagacctttattgacattctggtacaaatccttccaggattttttcctaccgaaagtagcattatatttttccctcactatcaaaatataagattataggatttgccaaatgatactgcattaatagagatgacttgacattttaaaaaatgatgtcatctgagtggaaataacaatgcatccgccaggcgtggtggctcacgcctgtaatcccagca

SEQ ID NO: 98407 - DNA, 463 bp, Homo sapiens
cttctccattccaaccactactgtgctagtctaggccaacttatttgcactggccagcaatggcatactactggaattactttctaaccggtcctaattgcaatcaaatctattaccccattactgttcttaaaatgctatgttcaaactacatttttgctaagaacctatagttctctaccactgaccacattcacatcaagactaaactcttcttctggttttcaaggctttaaacacacttatccaagcttaccagtccctgaatacctcagctggatctccttactgccctatcccaacccctataggccactgtaagatttcaaagcaactgcaatttgttcctttctcttgtctttctgaggcaatgcctccgtgggagtacctatggacctgtgccagagctctggcagtcttgacagtgctcggaacactgtacaaataggagtcatgtcagtgg

SEQ ID NO: 98408 - DNA, 1092 bp, Homo sapiens
tccgtctctaaataaataagtgaataaataaatgtatactaattgcattttaaaaatcaaagtataggccgggtacggtggctcacaactgtaatcctagcacttttggaggctgaggtggatggatcacctgaggtcaggagtttgagaccagcctgaccaacatggtgaaactttgtctctactaaaaatacaaaattagctggtgtggtggcgcatggctgtaatcccagctactcgggaggctgaggtaggagaattgcttgaacctgagaggtggaggttgtggtgagcggagatcgtgctgttgcactccagcctgggcaacaagagcgaaacttcgtctccaagaaaaaaaaaatatataattcacataagataaaattcaccctctttggccaggcgcagtggctcatgcctgtaatcccagcactttgggaggtagaggtgggcagatcacttgaggtcagggagtttgagaccagcctggccaacatggtgaaaccccatctctactaaaaatacaaaaattagcccggtgtggtggcatacacctgtaatccacctactcaggacgctgagtctgcactcagtccctgggctacagggtgaaactgtatctcaaaaataaagaataaaatgcagctacttaaagggtgtagagttgaacaactgttaccactgtctaattccagaacctttcatcaccccaaaagaaaacccattcccagcagtcatttcccattaagtctcctctagcccctcacaaccactaatctaattcatgtttctatgtatttgcctattctaggcgtttcatacaaatacagtcatataatttgtggcctttcgtgtctgacttgtttaacttagcataatgttttaaggcccatttatgttgttgtatgtatgcatacttcattccattttactgctgaatattgctttgtactgatgccactttttgtttgtcttttcatcacttgacggacattttgtttcttccactttgtggctgttacaggcagtgctactgtgaaaatttgtattaaagttttagcgtgaatatatgttttcagttctcttgggaaa

SEQ ID NO: 98409 - DNA, 720 bp, Homo sapiens
gtatttcactgtattggtcaggctggtctggaactcctgagctcaggtgatccacccgcactttgggaggtagaggtgggcagatcacttgaggtcagggagtttgagaccagcctggccaacatggtgaaaccccatctctactaaaaatacaaaaattagcccggtgtggtggcatacacctgtaatccacctactcaggacgctgagtctgcactcagtccctgggctacagggtgaaactgtatctcaaaaataaagaataaaatgcagctacttaaagggtgtagagttgaacaactgttaccactgtctaattccagaacctttcatcaccccaaaagaaaacccattcccagcagtcatttcccattaagtctcctctagcccctcacaaccactaatctaattcatgtttctatgtatttgcctattctaggcgtttcatacaaatacagtcatataatttgtggcctttcgtgtctgacttgtttaacttagcataatgttttaaggcccatttatgttgttgtatgtatgcatacttcattccattttactgctgaatattgctttgtactgatgccactttttgtttgtcttttcatcacttgacggacattttgtttcttccactttgtggctgttacaggcagtgctactgtgaaaatttgtattaaagttttagcgtgaatatatgttttcagttctcttgggaaa

SEQ ID NO: 98410 - DNA, 606 bp, Homo sapiens
tcagaaagagggatgctcaggaaaactagaaagtccaagcatgacagaaatggtctgtttacatcataagaagaagacagatgaaaaaaaagctttcatatgagcaagtcgtctacaattaaagggaaattatttaaaatggtctttcagagattgggttttgatttttaaaaaaccacttatacactaaagaattggtttgaactacaaaattttcttaaggttattacgtccatataactttctgtgaagggagccgaaggcccatgggacgtgaccaactcagcattccactggaggctatatgatcgaacagcaaactgtttatcatgaatgcaggatgtgagcaaactcacaagtgttcccgccgacagaaggtttgctggaggcaatcactcccgggtgccgaggttatctactgcaacatctagagcctgttgtttgaggaatgcagtcttgcaagcctactctggactaagcagctgaccccttcttccactccccttctcactgtctctttcgcctaataaatatggagggctgtgtaaagctcagggcccttgtccacaagaggcaagcttcccctgaccccttcttccaaatata

SEQ ID NO: 98411 - DNA, 323 bp, Homo sapiens
tgcttattggccatttgtatgtttttagagaatgcccacttcaaattcttttcttatttttcatttgggttggctttttattgttttttgtttgtttgttttgagccagagtcttgctttgtcacccaagctgtagtgcagtgtggtatgatcagggccctctgtagcctctacctcctgggctcaacgaatcctctcaactcagcctctcaagtagctgagattacaggcgcatacgactacacccaactaattataaattaatttaatttttttgtagagacagggtttcacttttgttgcccaggctagtcttgaactcc

SEQ ID NO: 98412 - DNA, 613 bp, Homo sapiens
actccacattccattacatgggtatcaattgcttatttttaattttattttattttgggggtagcttgtgtagttttggaaggggctttaacttctcttagaaatcagccaggataggaagttgggaatacatagaacccacaggaagtccttcctaaggggagtccctgactcctcagaggagaattgactctgtgatcaatgtggttgcattgcttctgctctgggctggcatagaactgggcactacagggcacaacatgcacctctcctccacactgccgagtggggagatttccagagggcttgtaagggtgaccaagtagttgagacatggagccctggaaaacaatagcatgaggagtaccacacacactctcacactcacacatcctcacactcccacacgtgtataggtgttcactcaggcatgccaccaagtgtgggtgacagaaattaatcacagaggccaggcatggtggctcacgcctgtaaccccagcagttttggaggccgaggcgggtggatcccttgagatcaggagttcacgaccagcctgaccaacatggtgaaaccctgtttctactatatatatgtgtgtgtgtgtgtgtgt

SEQ ID NO: 98413 - DNA, 194 bp, Homo sapiens
ttgctaccatttacagaatgatcaatttgatagctatcatacatggctagcaagacactgatttttctaataaaaaaatttttaatgcatacaggtctggtgaacagtttcaatttaacggatgaggccaaggctaaagccagagtaaagtaatcagagccatgcctcaggaacacgatttagctaatagtgtg

SEQ ID NO: 98414 - DNA, 666 bp, Homo sapiens
ccactaaactaagaggagaggtgtttgttctgtccttttagtgaggcgctgagagatttgtgccagaatccacctggtgctcttgggtcaggagttgatgggtctccccgagccgcggctcaggtgtctccctgggctgctttttcttcggttccagaggcgacagttgggagaggaatactctgaagtgctgtgttggtggtggtgttttggttttgtttgcttttcttttaccttttcaaatcaactttatcaaaatatagtttaaatgaaataatgaaaggtatccaatttaagtgtaccattaaatgaggttttttgtttttttctgtttgtgttttcttttaagagactgagtgttgcccaggctggagtgcagtggcatgatcatagctcactgcagcctttacctcctggggtcaagcagtcctcctgcctccgcttccagagtaactgggactataggtgtggtggtaagcacctgtggtcctggctacttaccggctgaggcaggatgattgcttaagccgaggaggttgaggctgcattgagctgggattgcattactacgctccagcctgggagacagagcaagactctgtctcaaagagaacaaagaaaaaacaaaaaactggggggagatcagggcacggggtggggaaaaaa

SEQ ID NO: 98415 - DNA, 834 bp, Homo sapiens
gggaagtgaaggagctgcccatgtggcaggcagagagaacaccatgtctccagagctgaggcagagggaacaggactgtgtgtttgagcaacagctggagaccaggaagctggagtggagggggtgatgtggaaagttggagactgagggattgtcgaagggtgggggctacatcacttagggtgtaacagtggcctgtcttctctttgtaaaggatccctcccactgctgagcaagaaggtgggaaatgggagagcagctctcggagcccagcatgatacccagacaggaggctatgggggctcaggcaggggctggaggcaggcttgggaggggtgggggatgatatggtttggctctgtgttgccacccaaatctcatcttgtagctcccataattcccatgtgttgtgggagggacctggtgggagataattgaatcatgggggcatgtctttcccatgctgttctcatgatgtgaataagtctcatgagatcttatggttttaaaaagggagtttccctgcacaagctctctctctctttgcctgctgccatccatgtaagatgtgacttgctcctccttgccttctgctatgattgtgagtcctccccagtttaatgaaactgtaagtccatcaaacttctctttcttttgtaaattgcccagtctcaggtatgtctttatcagcagtaagaaaatagactaatcccggctgggcatggtggctcatgcctgtaatcccagcactttgggaggccaaggcgggcagatcacctgaggtcgagagttcgagaccagtctgaccaacatggagaaaccctgtctctacta

SEQ ID NO: 98416 - DNA, 961 bp, Homo sapiens
cctcagactttcgagacagcgaacggaccgaccgggactgccagccgctccgggtcaaggactcgccccacccgtgccccccaccaggcgctcccaactcactggtgagcgcggcggcccgggcgctggatgcgggggcggccgcgatggccccgcgcgcgggacagccggggctccaggggctgctgctcgtggcggcggcgctgagccagcccgcggcaccctgccccttccagtgctactgcttcggcggccccaagctgctgctgcgctgcgcgtcgggagccgagctccgccagcctccgcgggacgtgccgcccgacgcgcgcaacctcaccatcgtaggcgccaacctgacggtgctgcgcgcggccgccttcgccggcggggacggggacggcgaccaggcggcgggcgtgcgcctgccgctcctgagcgcgctgcgcctcacgcacaaccacatcgaggtggtggaggacggcgccttcgacgggctgcccagcctggcggcgctcgacctcagccacaacccgctgcgcgcccttggcggcggcgccttccgcgggctgcccgcgctgcgctcgctgcagctcaaccacgcgctggtgcgcggcggccccgcgctgctggccgcgctggacgctgcgctggcaccgctggccgagcttcgcctgctgggcctagcgggcaacgcgctgagccgtctgccgccagccgccctgcgcctggcgcgcctggagcagctggacgtgcgcctcaacgcgctggccggcctggaccccgacgagctgcgcgcgctggagcgcgatggcggcctccccgggccgcgcctgctgctcgccgacaaccccctgcgctgcggctgtgccgcacgccccctgctggcctggctgcgcaacgccacggagcgcgtgcccgactcgcggcgcctgcgctgcgccgccccgcgggcgctgctaga

SEQ ID NO: 98417 - DNA, 263 bp, Homo sapiens
aaccactttatgtaagtgagagtctctcacatccccaaaactttacaattgtagatcccagtcccttcttgtagttttttttatatataccctcaatatattataaattatgtaaaggcaaaggctgtgtcttttttgattaaccattctaaatggttgtggcatcatatttatttattaaagtatttcttaaatgcctaagatgttttaaattctagagatacttttttaagttgcagagatacagcagtgaacaaaacaga

SEQ ID NO: 98418 - DNA, 343 bp, Homo sapiens
ttgtacaggatgaaataccgtatggtgctttataacatggagttgagttgtttctataagaatattatacaaatgtaatactactgggagaaagtagagccagatgttgattggacagattgcaacccccccacccccccactcctcggggccaataattcttaataaggtatgatgttaatacctctaggaaattgccagggattcaggtgacagtgtgtgatgaaaacggtgtattgtgtgctggcctgactgcattaccatgtttgtcttctattgtctaatgatttcttatttcttaaatgctgctgataaaattattgatataatacatttttgacag

SEQ ID NO: 98419 - DNA, 224 bp, Homo sapiens
gggtctcctcatctccacttacttctgggtaggaaagtgggcacaaggtaacccttgcaacctaactgccattccagaacattagtcttccaaccctgaacaaaaagtcctactgctctgaggctatgccatcaggaatttatgtaacatcctctacccccacttgctacagtcatctccaacgtccattcttccatttcctgaacccactcactgaggactaa

SEQ ID NO: 98420 - DNA, 850 bp, Homo sapiens
atctgactcttaacactgatcaaaagcccatgagcttaattttgaaagaaatccaaaaggcttgcccatcatttgatcactcagaagtgctgctgggctctctaggagttggcagtctatgggaagggtcagccagaattgtgtccattaatctggaaaatatcaggatagacataactaggagacttggcacagagggcaggcactgctgagggggcttccagatagaggaaatgagagttaaataaaacctggaagggaaagtggaagtttgccagggagtgaggaggagaaaggtgttccagataaagatgaacaagcgtgggcggtgcaagaaatagcaggactagcccagggaagtgctgtgcttttgaagcaaagcatttggggcataattttagtggcagagagtggatgggcctggagaggttgattggggccatgtcagatctgtaccaggctctgtggaactgcaatccctagggtggccctgggtggccccaggctggcctggagctcaaggccgatccacatagctgactcacaggtgtgcctgagtccagtctcaaacttcagcgtgttctgccagagctggactgaaccacaaggccactttcctgagacgtgctacaagaacctgttagaccaggtcggattacaggcgtgagccaccgcgcccggccgagacggggtttagctcttgttgcccaggctggaatgcaggtggtgccatctcggctcaccgcagactccacctcctgggttcaagcaattctcctgcctcggcctcccgagtaattgggattataggcattgtgcacatgcccggctcatcagatttagtagagag

SEQ ID NO: 98421 - DNA, 478 bp, Homo sapiens
aaccaatattgatacattattattaactctaatctgtactttattcacatttccttagtttttccctaatgtcctttttctgtcctggtattatccagggcaccctattacatttagtcatcatatctctttaggctcatcatctctgtgatcgtttctcagacttcccttgttttagatgaacttgagggttttgaagatagtactgactggtcagatattttgcagaaggacctttaattaggatttgcctgtttttgacatgagtaagatcagggtaatgggtttttggggaggaggaccactgatagggttcggctgtgtccccacccaaatctcatcttgaattgtagctcccataatccccccatgttgtgggagggtcctggtgggagacaattgaatcatgggggtgggtctttcccatgctattctcctgatagtgaataagtctcaggagatctgatggttttataaa

SEQ ID NO: 98422 - DNA, 858 bp, Homo sapiens
ctgaatgggagctacaaagagaatgagaaaagtcaaaggaggctttcttgtcaccttctgccacacctaggccagtgtgaacaaaggccatactctcatcccacctccccaggctgggtaaagtaggtgccatctgagttgcagaggggcaagggtggaggtgttgtcccagccacctgccagtcctgtgactctctgagtccacttatttggaaggacaacaatcctaaaagcaggtacagccagtaaaacaataatgaaatggactatggtatggcagagagataggagaggatgaaggaagacccagctgggtttttgtaatgttcttgcaagaaaaaaaaagtgagggtttgaattagggcagggataatggatatggggaggaaggcacaaattagaaacattcccgagcataatccataggatttaactttacctagatatgagatatgggtgggcaggcagcctcggagactgctccagaatgcttaagttggtggcaaaaccattcactgagacaagaaacacaggtcagggaggagtttagggtagttgagaagaaaagcaaatgtttcttcttgtccaaatttaatttcaagcaacaacaagaatccaactggagctatccaaggaggttaggaatttgaacctggagctgcagaaagaggtaagagctagagagaaagatgtggaggtcacaggcatgtcaatgtcagaccagtgcataggggagtgagggcatcctggggagcagaagagggccaaggaaggaatcccagggaatcccagcatttaggcggcaggaggaggaaatggacacagcaaagagcaactgagatacaaaataaaaggagc

SEQ ID NO: 98423 - DNA, 736 bp, Homo sapiens
acatcagctgaagtctcacagccagcgaatggcaggccagggcaccagggcctaggtctgcctgcctcttccatccaccttctgtcatcacaagccttctgatctccagccctctgatctgccccagtgggaccctcctgcgtctctgctctagttgtagaggacccatcaggcacttagagagaaatgagtggtgttgtgaacattcgactgtgtccatgtggaatccacacacacagtttgcctgaaaatgactgataggatggaaactgacaagtcatcatccgcttcgggcaccagcgatgactggttaacatgaatattgtgttgatttccgctagatagaagaagatgtcacttgtcgttaatggggtgtcacacgtacacttgcctaaaggaaaatgctcttttggtgattgttctcaattttcacctcattttatagccataaaaaagaaaagattcagcagaaaggatgaatccacctaggggtaggatggaaaggcattcttctcatttatttccttctttctttaccagaacaaccaaaacccagtgaaaatgctggtgcaagtcagaagagggggacctgggttctaagagcagccaggtactctgggcttcagatcagagcctcagaatccagcagttatgcccacaaggtagccaaagtccagccagtaccaccggtctctcggccagctatacttgcctctgctcaacaatgatgatttga

SEQ ID NO: 98424 - DNA, 431 bp, Homo sapiens
tacacactgaatactctatttcactttttgttaatgcagctgtgttggatgtaataacaaaattaataattcctccacaagttttagctcgactataagcttgacactgactaatcagtacagagagtcagtgtcttcagtataatgctatgtctagcttatttttttatcctattaaatctatgtgcgggatttctacattaatcccttgttttctcatttatttttaaagcttctaatgtccccaaatttcatctgatttttttctttttaagaatatggccataatgaagtcccactcacatttagattcaaaaacatattttcactggaatttcatgaagtgactgccagctataactttattagaacatttcactcatattgttacctttatcttcctgcttgcttagatgttagttgtgacattt

SEQ ID NO: 98425 - DNA, 399 bp, Homo sapiens
tttgtagaacatgaagaattttactaaaatgaggggaagatgggtgcagaggaaggggaaagtcagtgattgggaacctgtgttacgactattgggaaagagtctaagttggtgaagggtctgagattaccacactttcaagatgacaagtcggcctgccacacattcaagtatgctggcagaaggctcaagagtcctggatcctggatgaatgagctatgacgatgtggatggctggatgtcaggagaagatgatgtcagtgtttggggatcctcaatagttgaaggtttttgttttgttttgttttgtttttgccaaaaacttttggaagagcattgtaatagaatgttattgtctctttctttttaactcattaaagtgttgccacagatgttgta

SEQ ID NO: 98426 - DNA, 323 bp, Homo sapiens
gcagacagtgggaagtgggaacagggagggggttttgttctggggcactctgagaggagcagccccaaatctagagggaagggtccaggctcaagaaggaactgaggacaaactgagtgagaacagctccaccagcccctacccctggagggtgagatgtggcctggaagataggacttctattgagaagctctaagataatcccagcactctgggaggccaaggcgggtggatcacctgaggttaggagtttacaaccagcctggacaacatgatgaaaccctgtctctattaaaaatacaaaaaacaaaacaaaacaaaac

SEQ ID NO: 98427 - DNA, 219 bp, Homo sapiens
ctggataacttgctacagcttctccgtcagcacttgctgttttgttttgcactttgacattctgtagatggtttctttccttaaaccgcatgaaccaacctctgctagcttccaacttttcttctgcagattcctcactctcctggccttcatagaaatgaagtttattaactggcctaatttcagtatcattgtgtctttggaaacaagcaggcccaa

SEQ ID NO: 98428 - DNA, 249 bp, Homo sapiens
ctacggtgtgccggctcaggttgtgggagtactgaaaacttttgccacactgcacacacgtatagggcttctcacccgagtgtgtccgctcgtgcctcttcagtgtgtatgtgcacgagaaggtcttcccacagagcgggcaggtgggtgccacgccgtcgggtgagagccgggcccgggtgctgtctcgctcacggaagtgggcactgaggtgcagctgcagcacgtgggagctgggaaatagcttgc

SEQ ID NO: 98429 - DNA, 1326 bp, Homo sapiens
  misc_feature (1292)..(1292): n is a, c, g, or t
  misc_feature (1298)..(1298): n is a, c, g, or t
agccggagcaactgccggcctccgcccccagccgcagccggtcactggcggcgccttccgcgccaagcttgggggccttttcggggtcctacatggcacggcttccgacccccggcccgggacggggctcgcaggccccagaggggcaggctggagaaggaggaggttaggtgtcttcaggagggttgctgagcccaaggacgcgccatcgccgcggagaaggagccggaccccttgggcggagcgcccaatgtgtggtccctcacgccgtcccgcaccttgctttttagggttctttttccgctttctgagcccttttataccttacgtttagaaggggaaaatcatcctcccacaccttctccccgactttttgccttttttgtcttgaagttacccaaaggtctgtgtattgttctcagtggtcccaagaattactcgaatatagttgttttctgagggaggatggatggagataactatcctgatcccagtgtcactttttaaggcattcgcttcaagagacaagcagtttagaatcaggcagaactggattgcaaaatttatgggcagaccggtatgtgtgaaggaaaatgtctaatcaacaggagaagtatgaagctcagaatatagtcaattcaacagaagagagtgatgatgcttttgatactgtcactattccagttccctcagaagagcctcaagagtcagatcaaactgaagagcatgaatctggaatagaacaattcagtgagagccatgcaatacatgttgaggagcagagtgaccaaagcttttcaagcctggaaccagacaatgaacaactcatggaagaggttatatcaccaagacaagtttcatatactccgcaacatcatgaaaagcaatatgcaatgcagaggccaaatgatgatagtttggcatttctggataaaataaagtctgtaaaggaatctttgcaagaatcagtggaagattctctagcaacagtaaaagttgtacttattccagtgggccaggaaattgtaataccttttaaggttgataccattcttaaatatcttaaggaccatttttcacacttattaggtatcccacattctgtactgcagataagatactcaggaaaaattcttaaaaataatgagactctagtacaacatggagttaaggccacaggaaattgtacaagtgggaaatcttttctacaaatccagatctgtatccagtcagaagaatagatggattaactgatgtctctcaaatcataactgtcactgttcaaactggantgatcnataacacgaggaactgtttgagaatggc

SEQ ID NO: 98430 - DNA, 840 bp, Homo sapiens
  misc_feature (806)..(806): n is a, c, g, or t
  misc_feature (812)..(812): n is a, c, g, or t
agcggaggatacgaccaacagctgagaacgcggcgagtatggaagctgcgtcttaggagcctgggaaagcacttcgacgagaatagtttggtttcgtacacaggaaaatgtctaatcaacaggagaagtatgaagctcagaatatagtcaattcaacagaagagagtgatgatgcttttgatactgtcactattccagttccctcagaagagcctcaagagtcagatcaaactgaagagcatgaatctggaatagaacaattcagtgagagccatgcaatacatgttgaggagcagagtgaccaaagcttttcaagcctggaaccagacaatgaacaactcatggaagaggttatatcaccaagacaagtttcatatactccgcaacatcatgaaaagcaatatgcaatgcagaggccaaatgatgatagtttggcatttctggataaaataaagtctgtaaaggaatctttgcaagaatcagtggaagattctctagcaacagtaaaagttgtacttattccagtgggccaggaaattgtaataccttttaaggttgataccattcttaaatatcttaaggaccatttttcacacttattaggtatcccacattctgtactgcagataagatactcaggaaaaattcttaaaaataatgagactctagtacaacatggagttaaggccacaggaaattgtacaagtgggaaatcttttctacaaatccagatctgtatccagtcagaagaatagatggattaactgatgtctctcaaatcataactgtcactgttcaaactggantgatcnataacacgaggaactgtttgagaatggc

SEQ ID NO: 98431 - DNA, 902 bp, Homo sapiens
  misc_feature (868)..(868): n is a, c, g, or t
  misc_feature (874)..(874): n is a, c, g, or t
agccggagcaactgccggcctccgcccccagccgcagccggtcactggcggcgccttccgcgccaagcttgggggccttttcggggtcctacatggcacggcttccgacccccggcccgggacggggctcgcaggccccagaggggcaggctggagaaggaggaggaaaatgtctaatcaacaggagaagtatgaagctcagaatatagtcaattcaacagaagagagtgatgatgcttttgatactgtcactattccagttccctcagaagagcctcaagagtcagatcaaactgaagagcatgaatctggaatagaacaattcagtgagagccatgcaatacatgttgaggagcagagtgaccaaagcttttcaagcctggaaccagacaatgaacaactcatggaagaggttatatcaccaagacaagtttcatatactccgcaacatcatgaaaagcaatatgcaatgcagaggccaaatgatgatagtttggcatttctggataaaataaagtctgtaaaggaatctttgcaagaatcagtggaagattctctagcaacagtaaaagttgtacttattccagtgggccaggaaattgtaataccttttaaggttgataccattcttaaatatcttaaggaccatttttcacacttattaggtatcccacattctgtactgcagataagatactcaggaaaaattcttaaaaataatgagactctagtacaacatggagttaaggccacaggaaattgtacaagtgggaaatcttttctacaaatccagatctgtatccagtcagaagaatagatggattaactgatgtctctcaaatcataactgtcactgttcaaactggantgatcnataacacgaggaactgtttgagaatggc

SEQ ID NO: 98432 - DNA, 304 bp, Homo sapiens
gtatttttttgtagagacagggttttgccatgttgcctaggctggtctcaaactcctgggctcaagcaatcctcctgtcttggcctcccaaagtgctggtactcacaggcgtgggccacgtctggccctaccttattactttttaactacccattctgctttaggccttctgttatttggtggttcatgaatccatgaactgcacaatgatgatggtattataactgagcttccccgtaatgatgtaaaaaacaaaggtcattcctattttccagttagagccactttgtaagttagattaagt

SEQ ID NO: 98433 - DNA, 167 bp, Homo sapiens
gtttatctgagtccccagctttgttaggcaatgtgcttttatttttatttttgattttgattttttgtgtttatttttattttaaatgaggtctcgctgtattgcacacaatcatcctgaattcctgggctcaagctatcctcctgccttggcctgtcaaaggatag

SEQ ID NO: 98434 - DNA, 295 bp, Homo sapiens
gctgagccaggatttgaatccaggtctgcaaatccaatgcctgtgctctctgcacttcaccggaatgaccttatggaccccagaggtatcagggtttctctggaagcagggtctctcaccaaccagaccagcccagctaagactccatgggagaggggtcacttgaacctgactcctttggtaatatgtggatgtcagtaaccacagcctcccaggaaggaaacccaagaggaggtgggcgggaagaaggaggaagacggttggcctcatttgggaggtgttcacggtggggact

SEQ ID NO: 98435 - DNA, 290 bp, Homo sapiens
aaggtgtgcatcattggggaccatcttggaagctggctatcacaccatccatatgaatgagaaataaaccttctgagtatctgataataataataataacaacaacaataacagaagctcctacttttctgtcttaataatttctatatagaaactcctagtgtaatttctgggctggcacgcactcctggttctcttctttcctccttgcctttattttgtctatcactttcatggaactctttcttcagtctgcactttcaacatgtttccttagtggcttatcttta

SEQ ID NO: 98436 - DNA, 807 bp, Homo sapiens
ttccatgtttccaactgaacccatgttcctccactaatacttggattttcttccaccacggccgttcctgagacagcaagaccagttcctcctccttctgctcctcctcagcccacttgacgtgaagacgacgaggatggagaccttgatcgtgccccactcccacctaatgaatagtctgtagattttctcttccttaggactttcttcataacattttcctttctctatcttactttattataaaaatacagtatataacacagatgcaaattatgtgttaattgagtttttatgttatctgtaaggcttccagtcaacagttggccctcaggagctaagttttgggggagtccaaagttgtatgagtatttttcactgtgtaggggatcagtgcccataaacctcaggttatttaagggtctactgtataaagtaaatattggactcataataacaatagcagctataacatctttgtagcacttagccttggtacaggtgccttcaatatgctaactaatttaacttttaaccaagccagttctttatgtaaaaaaaacgattcatcataatttaatatcttatacatgttccattcaattttctaaatttggctaatataaaataaggtttaatattaccatgatttgatcaacatttcaaaattacatatatttctcttacaaattcattgttattgacatcaaatttataaccacgttattggcattgtttaaccacacagtaaaataagtgtaatcagtgaaaaaaatagaataaaatctatatagtggagaccttgaa

SEQ ID NO: 98437 - DNA, 317 bp, Homo sapiens
cgtttgggatcgtgagaaatgatatgaggggggaaggggaggcggccggctcgattttattcataaagttttttggaaaaagacaacagaaattgtactttgttgagaagactcctagagccaaatagtcacagactcagaatacacagagacaagcaaagatggttccagcaagctctaaggacacagacatgtgaaagaggcgctgaagacacacgaggactgatgcatggtagatgtcatcctgatatggctgggcttctggactcactgcctcctccttctagaacccagcacctccaaggctgggagaagag

SEQ ID NO: 98438 - DNA, 105 bp, Homo sapiens
aaaactgcaattatttttgtaccaacctaatataatctttatattgtcactgagaaactcagtaactgagaggttaagtaacctgcctgaagtaatggaggtgct

SEQ ID NO: 98439 - DNA, 286 bp, Homo sapiens
ggcccatcagttactctgggcccaatatatgtgacatatggtgcgctgagcattttatgtaaataacctattctattttattgagagggtctcactatgttgtccaggctgaagtacagcggcatgatcgtagctcagtgccaaccttgaactcctgggcctaagtgatcctgccttggcctcccaagtagctgggactacaagtgcatgccaccatgagaggctaattttttattttttaattttttctagtgacggggccttgttatgttgcccaggctggtct

SEQ ID NO: 98440 - DNA, 448 bp, Homo sapiens
tgtatttttagtagaaacgggctttctccatgttggtcaggctggtctcgacctcctgacctcaggtgatctgtctgcctcggcctcccaaagtgctgggattacaggcttgagccactgcgcctggcctctgaatggtatttctaatggactcatgggtgggatagatgagattacaagaattgcaatttaggatccgcaatttaggtttgggattgaaactcccctcccctcacccagtataccctaggactaaaggtgaatccagaatcgacagtactcatggggactaaaggccagcttcaaataatctcattccctacgtagattaagaagacctcagattgccggcacctctactctagcttacttgccataattaaagatgaatcttctatggaagaagaaaatatgcagctgagtgccgtggcttacacctttaatccaa

SEQ ID NO: 98441 - DNA, 537 bp, Homo sapiens
aattctgttttagatcagttgggatcaggtgactgataggcacaggaaatgtgcattcccagctggtggtgctggagaaatctggggcttataaagagagaactgggctagtgagatcaggcatcattatgcctaatggtagtgaaaaccttaaccaagaaaaacacataggaaatagcagtggtccagagctatttccctaggaaatccaaaacctaagaggaaaaagtagaatagaacctctaaagagacatctaaagaatagttcaaaaggacacagtggctcacatctacaatctcagtgcttcgggaggccaaggtgggaggatcgcttaacccaggagttcaaggcagtatagcaagaccctatgtctacaaaacacagtgagactccgtctctacaaaaaataaaattagctgggcatggtggcacctacctgtagtcccagctactcgagaggctgaggtgggagaagcgcttgggcccaggaatttgaggttgcagtgagctataattgcaccactgactccagcttg

SEQ ID NO: 98442 - DNA, 775 bp, Homo sapiens
agcagtagctggtaggagagcgcagtcgccccgcgggctcggaggacacatcgtccgggaccaggctctgggaagcgggtgtgcacagcccagcagagtcagggcgcgaccccaaccgcctctcaccatccttgccgtctcctccgagccgagggccggccctcctgcctcgcctgccccgcccctgccccgccccggcccgggccgccgggaccgggagccgggacgcgggtgccgcagcccgaggcaggtaaggggagccccggctctccgtccccggtccgtggcagcgctgagcatcccggccccgcaccggcccgggggcgcgtcaaggtcgagaggcgtgatggcggcagaacgcgctggaggccgatgggactgtgcgactcagggcccggcggagcatagatggccatgagccagtgacgctggacggacggcggcgcgaaccccctgtgactgaccacgcaacctgaacgaacggtgcgcacgaaccacaatcactgaacgacccaagcgcttactccccagcctaacccccagagcgactacagcaccgtcggcaccatccgacgtatcgttgatacctcgcccctagttcccgacgctgggacgcgcgcccctgacagcggccgccacaacacgcggctcatcacgaacccaatctcacaagtagactctcaacgtacacatccgtgcccgaccgaggaccctgaaatggccattccatgagccccctcatggagcctgatcagttctaacatcaccctgacac

SEQ ID NO: 98443 - DNA, 225 bp, Homo sapiens
gggtgccaggctgggcctggaggtgttggggtgcgtgccaggctgcgcctggaggtgggggtgtgtgtgccaggctgggcctggaggtggggggtgccaagctattttggagggtgtccccaccctctgcacacttcacctggctgccacccgtcagaggtaggttatgctggctgtcctgctgccatgaccaccaatgcccctcccctagttgtgcctccagcc

SEQ ID NO: 98444 - DNA, 299 bp, Homo sapiens
gggtaatattggccttgtagaatgaatttagaagaattcctttccttttgatttttttggaataatttaagaagaattagtattagttcttctttaaatgtttggtagaattcatcagtgaagccatgtggtcctggacttttctttgctaggagagtttttattactgattcaatcttgttactcattattggtctgtttgagttttccatttcttcatgatacagtcttggcaagttgtatgtgttgagtaatttatcaatttccattaggttttccaatttgttggagtatgattg

SEQ ID NO: 98445 - DNA, 444 bp, Homo sapiens
caaaccgcaaaaaactgaccccagtgagatggtgtaagaacttgcagagtaaaatgcgcctgagacactcactggggcatagttcagagtctcctgagagggggttattgagcactttagtgagtaggatggggtgggacagtctctcaagtaattggatggcctgacttgacacatgattaagacatatctgtgtcttgaaaaggttttttcacttattttgacctaaggcttgttttcgttgtcttgagacagtttccctctgtcacccaggctggagcgcagtggtaccatctcggtccactgcaacctccagatcttgagttcaggtgattctcatgcctcagcctcccaagtagctgggactacaggtgtgcaccaccacactcagctagtttctgtagttttagtagagacagagtttcaccatgttagctaggctgt

SEQ ID NO: 98446 - DNA, 504 bp, Homo sapiens
ggtgatgggatcagtcatagcccaaacctcagcatcatgcaatatacccaggtaacaaacctgcccatgtactcctaaatctaaaattaaaagttcaaattatattttaatcacaaaaaaactacaaatagcaaataccaaaatatataacagatgtataagtgctccttgggataaatatatgatagacaattaactgtcatcatatccctgtctctgtttccactcatttctatagtgtactcctgtggctcactagtaatataaccacagtggtaacacaaattccaggttcaacggtaacctaagaaaatctgctttcttacttcttgaatattccttataaaaagaacaataagggatgtaaaataaattttttagaaagacagaagacaaagatatttggttggctaggaaagagaacagataaacagacaatatcaagcaaatacacaccagtccatcttaggcctagatggtacccacggtggaataagaatgtta

SEQ ID NO: 98447 - DNA, 685 bp, Homo sapiens
agggtgcgcacttggccggcgagctccccagctggcggcggcggcggctgtgagctggccgcttggtttggagtcggaactcaatccccagaactggatctttaggttccacgttggcggccctggatctagggacgcaactcttggggtcctcccactgcgccgcctggggagcctgctcctgcttcctttcccggctagctggccccgtcctctgaggccgtgcgaattcccgccaccctccctcaccccggagccctgcccttcccgccctatgtggccaaggcttccaggtgcgggcctcgctccacaactcaggaggcaggatcagcggctccattttacaggacagatgtcccacggcttgcagatggctgggccccaggagacggtgctagcccttcctctgagagaaggggtgcaggctgccgccaccgcgcccatcctcctgtacaacctggaggatggcttgtcagaccatcccctggaccaggggccccgctgccctgcccggcggccctgcagccctgcctcggctccagctcccacatcgccaaagaagcccaagatgcaggcacctggggaaacgtttcccactgactggagccccccgcccgtggaattcctcaacccgagggtgctgcaggccagtcgggaggccccggcccagaggtgggtgggtgtg

SEQ ID NO: 98448 - DNA, 215 bp, Homo sapiens
tattgtgctttagtaaatcaagtctcagaatggaattggttccaaataatttgcagggggttcatttcatttcaatttcaaggtggtgaaaaaaaatcactccagaaattctccatgacctcttttttttcttcaaaacacccatctcctccacctatccccttcacccctctttccctctaggtctcgactcctagccgatggctggcccctgg

SEQ ID NO: 98449 - DNA, 120 bp, Homo sapiens
tggggatcagaggagcttcctggagagggacacttcctggagttaggtctggaaggaagagcaggaagataaaggggcgagatggagcagggaggatgttccaggcagagggttcaccac

SEQ ID NO: 98450 - DNA, 362 bp, Homo sapiens
tgcccctggacaagcctatctgaggcttcccttaagtgtgaaatgggtcttcaggggttttaagacactctaccccaagtaagcttatcaagatctgaacatctcaagtgtcccctctcctgggttggtgtgtgtgtgtgtgtgtatactctacttagtgtcccagcatcaggaaccaataagattattacagagttctagttttgagagctagaaagacacccattttcagtattgctagtaagattgtggtagaagtggaaggcatctaagtcatctcttggaattatcacacaaaagtgttaatcaccatggtgtgttccaatgttgactataaaatctcaggagcatcttctcttatc

SEQ ID NO: 98451 - DNA, 418 bp, Homo sapiens
tgataatcactatatgggttatgtcactggccttcacaacatttatctagggaaaatacttttattatcactactttataacagggaatgtgcagcccagaaaagcaaccttccccgcatcacctagctaggaagtggcagggctatgatttcagagtctataactttagaaaaaaaatagttttacagacaaagaaactgaagtgacttgacccagtgaagttagcagagaaggtgccaaaaaacagaggcctttcctagtcattcaacttagtatcctgaccccaatatgtcatcactgctagctggggatgttttaatgccaaataaagaagacgctccatctttgacactcagggaattaaagggtttgaaggcagctttatcagcatcagacactttcttcagcagtaattac

SEQ ID NO: 98452 - DNA, 275 bp, Homo sapiens
gtgtcaactgccccagaagcacagttcagggtccttcgctgagcatgcacctgcactcctgtgagatggagatgtcagaaaaatagcctcatgtagaaggaagatggggaatgtggaagggatgtggcagaggaagcctgggggagcagtccagcatctcaggccaccatgagcagcatggcctcagctgggccccctctgccctcccatcccatcacctccactaggaacattgcttagagcccgccacatgtccccatttcaggatgacccta

SEQ ID NO: 98453 - DNA, 1284 bp, Homo sapiens
tgacttctgccatacagagcaaggtctccacactcctttctcctgtaataattttccatttgaaaattttccttgcaattctcacacctttattatttcatataaattttacaatcaatttttttcttgtctagataaccatgccatttggattaaaattgcattacattgcaacttttgagaaactatgggaggagaattggcaaccttataatattgaatttgctcattaaggaacatagtttctctgtttatttaggtgttatatttttcataacatacatgttggtatttctacccaggcttttctctttgttttgtcatgtaacccatgaatgagactgcactgtctgtgtgattgggcagttgcccaaagtttaaggtgttaacatgcattaattcacttaatcactcctcatttcctccttccctcaacccctgacaaccatgaatctgccttctgtctctagatttgcctattctggacattttatatagatgtgtcatccaatatctggtcttttctgactggcttctttcacgtagcaggattctacggtttattgaggttcattcattgtgtggcctgtatcagtgcttcattcctgtttatggctgaataatgttccactgtatgtacatatgtatgtataccacactttgtatatccatttatttactggaggatatctgggttattgacagtatatttcaggagtccccaagatcatcctcccccttgatctactgctctttgtatcttatatgacctgtgcagaactatttatctggaaattaggtgatggttaactaaatatagttcttctaaagactcattttccgttggtattacatcctgaggagactttaactcaatctcccaatacatttgatcatcaatatcagtattaccacatgacttatttgcatgaggtaatcaaatctaaccagccatgccagtgttacccatattgcatgttgtggtagtagatgcagccccccaaaataaaagtcaaaagatgctggcacattcctgaggttcttctcagccactaacaattggtgtagttcatcatcacctggaatgaccaaaatgtctcccatggaaatgcggctcagctgtgtaggcttccatttaactttgtcaggttccgaggcagggctggcttgagtggtcttgtttccactttggctatgatgaataatgctgctgtgaacattcaggtatacgtttttgtgtggtttcatttcttttaagtatataccttggagtgtaattactgg

SEQ ID NO: 98454 - DNA, 674 bp, Homo sapiens
tggggcaggagctggagaagctcgacatcctgcagtgggtgagacagttgtgcacagtgaagaattgtctcacctcctgcatggctttccaataaacagatgatctgagcttggaacgaactcccctttacaaacatcaacaaagtggtttggagtagtatgaaatatttgtattcacttaaagtggaaagacaatctgcacacctggaggagatatttgcaacatttacaactggcaaaggtttattaccaagaatatataaagaagtcttataaatcaacaagaaagaagaaaaacaacagaaagaaatggacaaaagaaaaagcattttataaaagaagaaatgctcatggccagcaaacatatggagatgttcaaactcatgtgaaatgtaaatcaagacccaataagataagcttttatgtccactaaaatggcaaaatgttaatagctagacaatccaagtattggagaacatacagatccatgggatctcttacatatcgcttataagggtacgcattaggacataggacactcacttagaaaaagtgtggcattatcttgcaaaatcaaacactcacataggctgctgtgcaggtcctgagtctgtttgccctcagatccactctttgctatgcccttatgtcctcagttttccagcaggatctcg

SEQ ID NO: 98455 - DNA, 261 bp, Homo sapiens
aagaatcgagctcggtacctgcatgctctctctgctgtcactcccagaccttattaccccaacagcctgaacaatcccaacagcctcctaactccacaccctgcccccagtttcccccactcaaatctgtgctcacacaaatgccatattcctgttgtgtcaacagccaaaatcactgatgtctctgcacttacatcatctccccgcacctttgtgtggcctctcctccactcaggatgcccttcccatcctcctcacctg

SEQ ID NO: 98456 - DNA, 416 bp, Homo sapiens
tgcacatttgagagagagaactatgggagaagagagagagggtgtgtgtttgtgtacacatacgttttctgcacatggcatgaagaaatgtgaggggccgctgccttgcatggaaggccagcccttgtcacattattctaatggggagccctaaactagcctgctgaactgtttggagaggaccttgacgcaggcagtctggagggaactgtaggtttccccgttaagaagaattgtaaagcagcccttatgggatgggcaggagtgacctggggccaaaagcccagcagaacaagcagcccgaatggggctaagagagaaccctctcctcattacccccacacagtgattagcgcggagcagcttgttcccccccaccgggccggctgcccgaactctgctgtgcaccatgagcc

SEQ ID NO: 98457 - DNA, 1851 bp, Homo sapiens
aaaacatatggaaattctcttttgatcaaaaggagtgtctcccaattagtttacgtgtgttagtattgctgacatattattatcatcacaaaattccttttatatctagatggtatcaaataagaaaaaaatgcatcatttggtcaattgcttattgaagatcccagctgaagcctttctttggtaaagagcgcagaaagagaccatagctattcttggatgagaaccttgcctctactaaatagtttctgcttttcctctctgtagccagacagctcaatagcctagggagagtcgatgaaggatatgcaaattacatttttcccattctcagaacaaagacagcaaccaatgagccagaggtttcttctctctttgaaaccaaatagcacgctgaatttagggctatgacaaaaatgttgttaaagcaagagcaaaatcatccttcctatgggattcttttctcagtgtttacttaattctttttgcagtttgggattgggagtttctagtaatgataattaatgccattttacatgatagcttcaatgcagaaatggtgtgagcctgagttacaaatgacatgactagggatacaaacttcgtctgtactaacatcctaccaagcagattggaaacaaatactactaccactaatattctgatgtaattaataacatctaatagaaaaatagaaacatcgtgcttagcatgaaaccattgcacaatataaacctgctcccaaatggcaaggatttttgctaccaatatttgttcttaattctccagttattttaagtaaataagtttcacatctaactacctcagctactgttgttttatttagaaacatgaaaccatgcactttgtaatcaataagtcttttgtttaacatttcaaaaggatatttggtgcaaagcaattttcaaaaatttgtacatgatatacaccacccaacctcaggaggttgtacttaattttgtttgtttgtttctaaggttggttttgggtaaaatcctcatttccactcaacatcaagataagctgctctatatttgcttaatttgccttaaacattttgtgctcctttccctgttcaatttttttgttttgttttaaatctatctctgaaaaaaaaatggaacaggtggcaggtgaacagcaaatggaagagaatggaccagtaatttctcagtcccctgttgtcaactatctgcatgacattctgattgtgcaaaaatgccattcctgtgcttccccctccattacagaataaggtccgagagaccccacgagtgtgcgtagggaacggtgtagacatttcccccagtatgagcacagtgcctggacctgaatgatcatcttggcagttcttgtgcttttactttgtaaacattgtacaaatgtatttggaattttatttgaaatggagacttaaactagttattaaatttgtttccttcctgtaaatatatatattcaaattccatgtatccaaacatccctttagcgttcagattgtaagtgtgtctttattcgcgggaggccactgtcagcaggcagtgacccccagtgccctagtttgaagcacagtgtgtggagtatttgatgtactacagtaccatagttattttggtctgttaagtaagttgcaatttgtgatgaaatgaagtggaaagtagtacttcataatgaacaaatttccttggttacatggtttttcttgtaaaacttaaagaaaaaaaaagaaaacttgaaattttatatatttggattttgtagttttttttttttatttaatgcaacacaaggtaccaaaatcattaaataaagtacactgtggtcatttta

SEQ ID NO: 98458 - DNA, 444 bp, Homo sapiens
cagtgtctccaatcctatccccctgttagctccagtgcttataagaagaccaagtgctttcccttggcctgggttgctcaggtctccagtggaaagatattctttcagatactgtgtactgatgaaactgctgactcagctggtctgaaggaccccactggcactggctggtctgaaggaccctgctgatcacaacttgcctgaaggaccctactgacatcagctgttgtccaaaggacgccacaagaaactgactcaccaaaaaatgcatcctgatgatttcatcccccttaacccgaccaatcaacaaccccaaatctacacagcccctttccctccatgattcctacaaaactccagcccagaactcctcagggagatggatttgaaggtctcctcccttctacttgcttgatgccctattattattaaactctttgctac

SEQ ID NO: 98459 - DNA, 255 bp, Homo sapiens
acaaaaattaacttaaaatagaacaacgatctaaacgtaacgacctaaaactatgaattataggaaaaaaacatagacaaaaatgtatgtaacactggatctggcaacaatttattggatatgacaccaaaagcacagacaacagaatgacaaattgaacagaacagaggcctcagaaataatgccacacatctacaaccatctgatttgacaaacctgacaaaaaacaagcagtgagggaatggattccctatt

SEQ ID NO: 98460 - DNA, 619 bp, Homo sapiens
actctagaggataaaactacgtcaagtgagcccatggtattgtttcacacagtctaacaacaaagttgagtaggtccaacagggactggaaggcctgcaaagctgaaaatgtttattagttggccacttacagaaaaatgttgctggccccttatttaggaaatcccaccagacacgcatatcttggtctctccacctctttttctccatccctttgcctttttctccttccttccactctccatattgatggctacagttctgtgctttgggaagaagttctacctggaaataccagacacccctccaaaatagtcccattctccttacaaagagccaaaatcttaggaaagacaaagtacttccaaactatatgtcaaatctctttcataatggatcctattgctgaaaatgggatttgagctgatttagtttggagctcagaatgttttgaagggaaagaaaatattagaagacagaacaaatatttcttgggcatctttgggtaagacccagcaccttccactgggtgcttactctgtgaggcaggtgtcaacagctccattttatgcaaagggaagcacccacaggttaaaatccacccagggccacatggaag

SEQ ID NO: 98461 - DNA, 403 bp, Homo sapiens
tctatctctagttctgctcttataattatccccttccttccattttcttcgagtttattctgttatttcttaaagttgtgtgtttagtttattaattttcagccatgtttttcttgtctttaaaaacatttaaggcagtaaatttccttcaaagcactgctttctgtatcccacaagttttgatatataacatttttattattattcagttcaaaaatatttaaatttttattgtagtttcttctttgactcattatttaaaagatatgttcttgccaggcatggtggctcgcacctgtaatcccaacacttttggagggtgaggctggaggatcatttaagcccagaagtttgagaccagcctgggcaaaatagtgagaccccatctctactaaaaaaataa

SEQ ID NO: 98462 - DNA, 309 bp, Homo sapiens
taatagagatgaggttttaccatgttggcaaggttagtctcaaactcctgacctcaggtgatctaccagcctcagcctcccaaagtgctgggattacaggcatgagccaccacgcccggccagaatgacaattcttaaacctacaatgacaacaccctatcccatgatgtctccattttcttgcacgggaactacaatgagaacagtgaccatctctatgtcctaccaagaaatagtcctgttcagtggacagcattatcagccttataaaaatatgaagctggaaagagacaccagtttttagctacc

SEQ ID NO: 98463 - DNA, 501 bp, Homo sapiens
gtcttgctatgttgaccaagctggtctcaaactcctggcctcaagcaatcctcccatcttggcctcccaaagctgggattacaggcgtgacacacatgcctggccctttttttcacaattttaatgtatgtatttttagatctcttggaaattggcctattctccgtagttctaaggagatgaattctgtttgttgcacctgtttctcatggcattttttttccttcaggtgctttgtaaattccactcatcttccgtatttgaccaaaggagcccttggctaatggagatgtccctatggggcaggtcatgtgaatttgcaaagaaccactctgcacagcataagcctataattctaattctaatttatctcaggggactctttgggtccaacagccaagggcagcaagccagctttactagttttactagtctgcttttcaagaacaagttgacagcatttctagtccctggctttctgcaggaaacacagtttcagcg

SEQ ID NO: 98464 - DNA, 325 bp, Homo sapiens
tacagctaggattcctttccagtggcatgctgagcacaggctatggagcagtgttgaaaatgcagtagaatggacctcactatccatggagcctcggacgccctctacagacaagctccccaagctgtggccggaaaaggcagcagaaatacacatgcagaccctttctgggtcatcgtcagggcaaactcatgtgtcccatggaacagatacctccttgcatacaaaatacaggcgagcacctacatgataataagcacattattcaccactatttctgcaagctgctctaaaatcagaggctttggggaataagaaggcaaaa

SEQ ID NO: 98465 - DNA, 285 bp, Homo sapiens
tgctgggattacaggcatgagccaccgtgcccagcttggacatgtgcttttatcttatttccacctaggagtggaaatgctaggtcatatggtgcgcatatatttataagaaactgcctaactcttttccaaagttgctgtattactgtacatttctaccacagatgtttgagagttttagttgctccacattttcataaacacttgatattgtcagtctttttaattttagccattctagtcatagtatttcattatggtttaaatttgcatttctatgatgac

SEQ ID NO: 98466 - DNA, 115 bp, Homo sapiens
tattcagaaagaaatttgataagatttaaagcctacttatgattttttccctcttaactaattaagactggaagaaactttctcaactagtaaatttcatataccaaaagcttac

SEQ ID NO: 98467 - DNA, 783 bp, Homo sapiens
ggtcctatcatcatcatagcgaactcgcctaatctgtaccacattcgggtctcaactcctccagactagctctgcttcttgaagtttcgagaggcttccagaggccagaattcagggagctctgaggcttccatgtaagtttctgggcatccactcgtcgctgttcctcggtgtggtgctgtcgggtctgcagagggcttcctgtcactgtctctcttgcactggttcttggcacagccccagcagcctcatcaccctccactttccagccttgggagcatgggcttggagacttatggagagtcacatggtgagtccagtgaataacagctggtgccagagcccagagctggacgtgcagccccttggccaggggcttttccctcggtttcccactcctggccttcatggagggtcctgtacatgcctttcttgcacacccctggctctgagctccagacatgcctagtatagcccagggccagaggaggcccaaaatgccacaggtgtgttttgtcctaaaataatttggattgatagcagcatttaaaaatcaagagatttttgtgttgattgctccatttctggctcattttaatgggatatcaggcaccacagggtggcattctcatataggggcaggggctgagctgagcagggctgtccttcagacagagcctgtgccttcctgcgaaccacctgctaccttcactcatttacagaacctgccaggccagaagacttctgtatttgcggctctattcttgggcttcggctgtgttg

SEQ ID NO: 98468 - DNA, 490 bp, Homo sapiens
tatattctcaatcactttagagtttcaattaggtgaattattatcaatggttattatcaaatccactgttgtcaggctacctgacaagcataaatataggtagagttaattttaaaattctttagatggaaacctttgaactaaaggtttaatgaatcttcaaatgaaagttgaataacttttcaactgattaaagcctatggggcccagtgtggtggctcacgcctgtaatcccagcactttgggaggccaaggcgggtggattgcctgagctcagaagtttgagaccagcctgggcaacatggtgaaaccctgtctctactaacaacaatacaaaaaattagccgggcatggcagcatgcgcctgtaatcccagctacctgggaggctgaggcaggagaattgctagaacccaggaggcagaggttgcagtgagctgagatcgcgccactgcactccagcctgggcgaatgagagagactccatctca

SEQ ID NO: 98469 - DNA, 906 bp, Homo sapiens
gactgtcctgaccgggtcctggcagagatcagcacgctggccaagatgtcctctgtgaagttgcagctgctctgcagccaggtactaaaggagctgctgggacagggaattgattataagaagatcctgaaactcacagctgatgccaagtttgagtcaggcgatgtgaaggccacagtggcagtgctgagtttcatcctctccggtgcggccaagcacagtgtcgatggcaaatccttggccagtgaactgcagcagctggggctgcccaagagaagccaccggcgggccggcctggtgcccgtggtattaagagaagcgacaaggcccttgtgagaaacgcatctgtgcggtgtcgtgcagtctacgcagtgaatagggttgggcaggtgtgggctggcgggtggactacacccttgagctccagcctgctgcaatccgtggaagagcccatggtgcacctgcggctggaggtggcagctgccccagggacccccagcccagcctgttgccatgtccctctcagcagacaagttccaggtcctcctggcagaactgaagcaggcccagaccctgatgagctccctgggctgaggagaagggtgttccaggacctgtgtggagcgacctgcccgtatggagtcacgccctctgaactgctcttcgggaggcagcctggttctaggatgctgaggccctggcccggactctggcctccagatccccagctgcctcacttctctcttgagaacttggtcagggctcctgaggacctttcccaggcatctacctatccctgtccttggaaaggccacttgttggcctgtttccataacgcaggcacacattaaccagcaagtataaagggacgacgaaagacaaaaatcgaagggacactagtacagg

SEQ ID NO: 98470 - DNA, 383 bp, Homo sapiens
tacagatacgaatcgagccggtacccaaagttaatgaaaaatgattccttaaaaaaaaaaaaaaaccaagggactaaaatgagataaggctcaggtatcaaaaaacaattttaaaaacataaaccaagattgtcttattgtaagtgctatgaatatgaatactggaataacatttgtttgggggaatcaagataccttgagataatacttctactccattaaatactaaatatgtgtgtgtgtgtgtgtgtgtgtgtgtgtatatatatatatattttttttttttttttttttttttttgggggccccgggcgtgtgcacgagaaaaccagaggggggaaactggaaggggggggggcgcgccaaatgggggggaatttccc

SEQ ID NO: 98471 - DNA, 292 bp, Homo sapiens
tagctgggattgtcctcgcgggggatgctggaaggggagcgggatttaagacaatccggcggcatccttggctggctggctggcggccggggtccttgcccatcacttggaacctgcagaggggccccctgtctgcaattctgttcctgcttccatcacggggctctgagtgagggttttggctggtggaggtcttaggtgggaactgccctggccctggacgaaccgcaccaccataaggccccttcaccctacaccgttggcccctgctgcctctccacctcatcctctc

SEQ ID NO: 98472 - DNA, 168 bp, Homo sapiens
atgacctgaaatttgatgtaattgaagaagatctttaagatcttttaaaattaagattaaaagcattttaacaaaatggaaaatgttaattcaaatgattattttgaaataacttttgctttaaatataaaattaatgtatgctctaaacagaaaacatggtaaacgg

SEQ ID NO: 98473 - DNA, 543 bp, Homo sapiens
cctgcgttgaagcatctccagggcagcccttcctcccgcccagccccagtttagggggatactgacccctcccccgacccgtagccccctcttgaggggctccccaggcgtcgggccataggaggtggggagcttctttccttagcttacctgcctttggtgagccttaaggaaaccgctatgactgtcctctggcctgtccattctagttgtgggagagaggtaccctaagttccgctccccctgcttccagaatcggaggatctttgctaggtgtgaaggaacctgtccctcttctcttttagaagtgacagggagtgctgtctgtcgccgttttccttcctcctgtcccacaaaaccagttgtcccctctagccctagaggaatatctcgatttcctttgggggaggggggtcgtctgggtgagaccgttccacacgcacagaagtgtgtgtgcgctcccgcaactccttacttcctctctttcctcaagccagagaaccaaccaggacctcagctgagtttaaagtcacttactagaaa

SEQ ID NO: 98474 - DNA, 447 bp, Homo sapiens
caggtgaaactcaaatgctaatgggggcagttggtaggataggacatacaaggtggggaggcagagagggaaggttattttccagtgctcatgtgagtgggaactgataagggactccatggggaaaatgaagaaacgctttgtatattcctctgaactctagttaggcctaacctgctaaaagtcagactttgtttctgataacgggctgtaccttcatgcccttgtaggtgtaatggccataacgaggggttagagactttgtcctgaatttttaaatgctgatgtaggcatgggaaccaagactttttggccaacatggacccgaagatccatggaggggagccagcttggtattgctgagcgcttgctatgtactggcattgctgagcacctgctgtttgctgcccttacatcatgctgtggaggcatggaaaacagtctgcc

SEQ ID NO: 98475 - DNA, 461 bp, Homo sapiens
tgtgagacagagtctctctctgtcagccaggctggagtgcagtggtacgatctcagctcactgcaacttccacctcctgcgctcaagcaattctcctgcctcagcctcccgaacagctgggattacaggcgtgtgccatcacgcccagctaatttttgtatttttagtagagacggggtttcaccatgttggccaggctggtctcaaactcctgacctcaggtaatccgcccaccttggccttcgaaagtgctgggattacaggcatgagccaccgcgcccggccaaccttaagttttaaaaatgcacaggaattgttagcagtgattacatatttggatagtgcaataccagtgggtattatcttttttgttctttctacttttctggtgttccccaaaactttgtttagtgaacatcctttaaattaaaaaagaaaggaaacacattattcagagatat

SEQ ID NO: 98476 - DNA, 353 bp, Homo sapiens
cagcttatgtcttaccttctcagagaaacattctatcacttgttcctcattctcatttaaaatagcacgtttcttctctagcacatcctgtctcgtcaaactgctttattttattcattgcattcatcactatctgaaatgaccatatgtatgtttccctattaattgcctctccttacttgaatataagccctttaaagggcagggattctttctgtattgtttactgttatttatgagatggaaggataaaaagctgatgaataggaagaggggggaaaataaagcatactttctttgggctccaggtttatgtgggggtggtggtagatagtagacctatcggttccaaa

SEQ ID NO: 98477 - DNA, 584 bp, Homo sapiens
cggtcctgcatttactccatggccagtgatgatgagcattttttcatgtgtctgttggctgcataaatgtcttcttttgagaagcgtcttcttttgagaagtgtctgttcattccttggcagacctgggattgttttcgttcttttctgcgactcagttttcccagcagataaggggtggggtcataacttcactcatcaggggaagtaagatgacttgggagataattgcttgataagcacaagcctagagcaaaaaggacagtaatgagcactgtctcgctatctccctatgcgcgcaagagcatcacaagaccagggcgagagggaggaccagggtgagaaacaggttgtggctaaacgtggaccaaaattgagcaccggcctacagttttcaggttaacgcttttatgtccaggaggccagcagcttcagtcttccattcccaggggactgactgggcctccctggggttggggtggaaggagggaaggtatcacctttgtacttttttttttttttttttgagagggagtctcgctctgtcgcccaggctggagtgcagtggcgcaatctccgctcact

SEQ ID NO: 98478 - DNA, 574 bp, Homo sapiens
tcagcttgaagctcagggctgctgtccagccctgtccactcccctgtcaagggattgtatcatcattgcgaaacaagcatataatcttctacgacttccaagtacatacataatggcacaaaggaattatagtttttcagagctcttccctgaaaccagatgccatgacaagttgctttaaggcaagttacttgccaggcttggtggtgtgcacctgtagtcccagctactctggaggctgaggcaggagaatcacttgaacccaggaggcagaggttgcagtgagccgagatcacgccactacactccagcctgggcagcagagcaagactcaaacaataaataaataaataaatgactcatgaatactgccattgttccagatagcagcagaatccttttctgggaataattatttggtgatttttatggaggatacaatttgctggcatcctagtgaaactgtactcatttttaaaatgtttagtatacaatataaaagactaagatttgaaagactgaaaattgtacatcgttcagaggttatcagtgttcattaaaatgtcactaattt

SEQ ID NO: 98479 - DNA, 353 bp, Homo sapiens
tcagggactggactggcagagaggagtaggagggactcaggttgggggaggcaagaaaaggtgatacaagccttgaatttggctaaaaggtctcagcctagaatggggatgggtcaatgaagcatgatagaaagactatgagaaaatggtattgaatagggaacaagtaagaggtctggtggcacatggacgcgagatgaatctgtcaatccccacaactgagactgaggcaaggccgagtaggtggccctggtattgattaaaaaggagatcggcagctgggcgcagtggctcacgcctgtaatcccagcactttgggaggctgagacgggcggatcatgaggtcaggagat

SEQ ID NO: 98480 - DNA, 249 bp, Homo sapiens
tgaaactatctgggcctggagatttctttttcagaaggttgtggttaaagttttaatctctttaatagttatacaatggttcctatgatctatttcactttgaatgaattttgatagtgtgtggttttcaaggaattgttaaattaagtcaaagttgtcaatttatgcatggagggttgttcattgcaacaacactaatcctttaagcatctgaacatctgtagtaaaatcttctgtttcatttttgtt

SEQ ID NO: 98481 - DNA, 699 bp, Homo sapiens
ggtgagtcccgggaggcgaagccgcggctgctcatagcggttcacttatgtgcagtttggatctggctttcttggttttatagtcatgacgtttgctctgcagctagagaaaggatgtctttgccagaagaattacattttgagcacattccctttcatgggcagagggattcaccaaacgtagaggggcagttttaaaaaaatttcagaggtgttttcttcctctaaagacagcttaaacaacaaaatggtgcgggctccctcatcatgagctggtatgtgttgtgatggtgtacacatcagaaccagctgggtgaggagtagccattagggggctggctcttgtgctctgttcaagttgcatttgtttttgtcttgataatagcgaggagaacagggtgaaatggcatggagggagggtgtcccttataaaggccagggaagggctgagcgcctgtgtaaagagagggcttccttgcctgccttttgactccagagggaaagagatgtgccgtgcctcttgctttagtgtaaggacagaacttccctgttcactagtcagtggagctactttacccaaaaaggtgggttctgtttaagcaggcacagcctgtgggcaatcattttcttgccaagttttgacctctggtgcttagtcacacacaagcagcatgggtgtttttagaattaggtgctgtg

SEQ ID NO: 98482 - DNA, 988 bp, Homo sapiens
ctagttcacatcaaactgggtttcccttgcccgggcctccaggtcccaaggtgctgtctttgcacctgcactccactgtccacatcagactgggtttccctcgcccgggcctccaggccccagggcactgtctctgcacgtgcactgccctgttcgcatcagactgggtttccctttcccggcactccaggccccagggcactgtctttacacctgcactgccctgtctgcatctcttctgtctttctgtgcctcttgcccttagagctccttgtctgtctttcagtgcatataccagaatgtctgtatgtctatgtgaaatctttttgtgggaatgcctgaatttttacgtatgtgactttctggtgtcatccctaaggccaagagtgttaagagttggggtgagagatggtagagttttttatgtttggctctccacattatataggttctaggatatgtccctgaaactacaacgtagctcatacatgggcatttttataagactaagtgtttttatgggtggacctcctgattctctgccatgagctaggcctgagattttacagacctaggactaactgcagtcacctggacaccagagatctgtaactgtcaaccgtaaagagagagagtatatttgcttctttggggttgaaaccatactgacgtaatataaacagaatttggtcagcaccatcaggcaaacatagtctgctcgataaggaaactgtgagagtcaaatggaacttttgaagaatctagaccaagctgaacttccctgccatattcacccctgcctcacgcctctccctgttcacccctggctggctggctgcatcctggggaatgcttctgctccatcggggtacccttcctcctctgcatctcctcaagagaagtgtaaccaagacacatagaagaagcacagactaacacaccttcccccatagtacatcatctccaccctccacagcctcatgttatg

SEQ ID NO: 98483 - DNA, 337 bp, Homo sapiens
acagagagcttgcagtttcagttctgtaaactaagtcacaggtcaagaacagatagaaatacaaacattcacttatccagatctcaaaggatgtgcttagttccaggaagcacaaaatattttcttagttacttgagctcacaaatggtcaaacaaactgaaaagactaacagaattatctctcatttctcacccaagagagtatatcccatcgttctagtaaagatcaccaaatgatcacactatgcagccagagtcccatcattgcagtcaccagtggcaaatgactattggtcatgcttaaatcagaactatggctaaatctgtccaagggcca

SEQ ID NO: 98484 - DNA, 167 bp, Homo sapiens
atttatgttgtgtgaaggtcacgaccaccttaccatatcaagctgaaaatgttaccactatctggacaattggacatgtttcactgggactatattttttctttctgtgtgtgctatgaaggcactggttggctgggttcagtaataaatatgtgaggtctttcgtt

SEQ ID NO: 98485 - DNA, 446 bp, Homo sapiens
tgtatacaatgggatattggtacatatgtacaaagggacattattcagctttaagtgttcatcaagagatggatggatgaagactgtgaaacatgtatacaatgggatattggtacatatgtacaaagggacattattcagctttaagaaagaagaaaattttgccatttgtgacaacatagatgaatctgaaggacattattctaagtgaaacaagacagacacagaaagacacatactgggtaatcacatttatatatagaatctaaaaaggcagaactcatagaaacagaggggataatggtggtttctaggacctggggatgggcatagaagaaatgcagagatgttgaccagagtacaaactttcagttataagatgaacaaggtctggggatctaatgtacagcataggtgtgcaggacagttctctcagtggccttgga

SEQ ID NO: 98486 - DNA, 787 bp, Homo sapiens
ccttgatagtcctgtgacaggcttctagccaagatagactatggaggataaaggggggttatgcatcacttaaaccccactttgtcctcagtcagtgctttcaaatgcccttgctgggtcccataactagccacttactggaaggaaagcaggggttataggccaataaggtgacctggcgttggaattctgaggagaccactgacatttcaatgccccactggccctgttatcacctcttatgccaatgagagacaaaggagcaggagagagagaggggaggaaagaagggtgaaaagggacagaggaaatgtcttaaggtgaaacagatattccaggaatacactcctccctcatccatttgctactttccttcagtactttacaagaaagtaaatattgtgaggagccagatcccagggaaggcacagaaaggaatcctacattaggctgaagcagtatttttggtgctctgctggcatactgaattcttaggatgctactgtggagccaacatcacgctggtcgtttgtattcaagttatggtgatgaagacagtccccgtgtctcaaatctctatgtccaagttattaaattcaggagactggacgcttaccttaaatgaagcaaggtaggaggcagatgactacttaccaagaccatcatttgcataaaggagtcaaagaatcaccgtgtatcagtcagaccacaggctggttgtctctctaaccaagtaacctgatgctattaatacaatgacaactagggatatttagggaaagaaacg

SEQ ID NO: 98487 - DNA, 880 bp, Homo sapiens
ccacctcggctgcccaaagtgctggaattacaggcatgagccactgtgcccaaccttaagtgaatgtttaatcatacacttcccagccatctcttgaaatttatttagggttgccagaaaagatttccacaatggcttatggacctcagatgaaatgtatttcctcaactcttgccttattctctaattggaaggaaattgcttaatcccatataaatgtaaatgctattaacacccatggatatcctaggataaaaaggaactttggctggtagcagtctactttttattaaggtagcagtcatttaccaaacatcagtaaaccagtgagtgggcctttggtgggcctgcaggccctgggcaggagccaggccacagtggcagatgtgctctggggcttggggatgccccggctcctttctccacttgcacctcctcatgtgcctgcccattgtgaattagtcaacactgctttccagctgcattacgagcctttattgactttgcttttcatccctttgacccactttgacaatgtcattagctagggcagccttttcaaaatcaagatctattattttcatttttaaaaagtcattcaagtatgcattgcatgaatgcactttaataaaccaagcctactcattctcatacttctgttttatcctctaaagataaattttctcccaatgctggttttagtgaggaatgaaattttttgtgccaagagtggaaaggaagacctttctatttttctagaaactcagattttactttttcttcaaacatctaatttcaccgcttttcaacaaggacatctgcgatttggtggtgtatctagatgatatctacaatgcttcacatccaagaaaatcagacc

SEQ ID NO: 98488 - DNA, 573 bp, Homo sapiens
gctgacatggagaccgtaatctgcattacgctagaatgcaccaagaacaaacttccagaattccatgccctgtggtttccaggagggggttatcccccatcccaaacacgaaatggctctagagtcagaaaattgcccccacctgggaacagagctgccaacatgttaataccagaaaacccacttctgccagcatagacgcgtccttttgcagtaaacagcaaagcagagaagggatattactgttttagaaaaaagctgcagtcaaacacctcatttttagtatctcagttgcagcagagtagaaataacgtgaatatagctccatccagcagtggaaactgacccatggggagccggcggggagtagggaaggggcccaggaagaaggggcaggtgtgagggaggctgtgcatcctcaagggctacactgtgcttttggttcccactgtgtgttccgaggcaagagcataccctgaaagcaacagccaagcgcgtggagcccaaacccaccagcctgagcactcagtccctctgccaagcccacctgggtgcaacctaggcacggggagg

SEQ ID NO: 98489 - DNA, 567 bp, Homo sapiens
agacagagtctcgctctgttgcccaggctggagtgcagtggcactatcttggctcactgcaaacttctcctcccgggttcacagcattctcctgcctcagccttctgagtagctgggactacaggtgcctgccaccacgcccggctcattttttgtatttttagtagagacagggtttcaccatgttagccaggatggtctcaatcttctgacctcatgatcctccagcctcggcctcccaaagtgctgggattacaggcgtgagccactgtgcctggctggtatgccaaactcttaagatccttgtatagtgtgaggaattcatattgcacattttgaatacatctattccatgttagtattattattcccatttttagatagtaaaactctttttatagaatgcttggaggggtttatccattggttggtggaagtatagcatagccgcagttactgtggtgatgcatcattaagcatttttggaacctaatacagccctaaggttaagaggagaaatacagtatctaatatgaactttgccttcaagaagtttataaaatttct

SEQ ID NO: 98490 - DNA, 191 bp, Homo sapiens
ggttgtagcatatcactgcagacctcaaagacatgcactgtcagatgtcaaggacaccagggtcaagcaaaatgaagagctatgacaattcccaggataattatgctccccaaattcctgttactaaggaagctcaaatatccaatgtgggaaatcaagaggaacatgatataaaaactagccttatctgt

SEQ ID NO: 98491 - DNA, 442 bp, Homo sapiens
ataataggatgactcgactgatttcagatgtgcattcccacaaaaaagttacaaattgagggagagggcatcccttccttgtgtccttttttcagaaaacttctttaaaagttgtggttaaacaaccataacataaaatgtactgtcttggctgggcatggtgtctcatgcctgtaatcccagcactttgggaggctgagacaaggtggatcacttgagtcaggagtttgagattggcctggccaacatggtgaaacctcgtctctactaaaaatacagaaattagccaggtgttggggtggacgcctgtggtcccagctacttgggaggctgaggcatgagaaccgcttgaacccaggaggcggaggttgcagggagccgagagtgcaccactgcactccagcctgggtgacagagcaagactccatctcaaaaaaaaaaa

SEQ ID NO: 98492 - DNA, 249 bp, Homo sapiens
agggagactggaccattacagccaaaagatcctgaggagacacaaccactagctgaaatatggcattgtggaagaaatcctggaacaaaaaaaagacattaggtaaaaatcaaggaattctgaatcaagtatggacttcagttagtaaggtctcaattattagttgtaaaaaaaagtgcactcatgtgagatgttagtaatgagggcactgggtgcaaggtacatggaactttctaatcttctcaactt

SEQ ID NO: 98493 - DNA, 290 bp, Homo sapiens
cacactaggttgttggcctgatatttgggagaattcacacatatgctagatttgacgctgatgggtttgtttttctcaaattacaacatgtcaaattgcttttactattatcaattaattaataaatcaatactttgcatgagaagaaataactgaataagaagatattcaaaagccactataagttacgtcaacatttttcatgttttcagttaatttaattttgaccttcaaattgcaaggaaaattccactgaagttttgaaatttgaaattaaactagtaaaaccc

SEQ ID NO: 98494 - DNA, 360 bp, Homo sapiens
tcaaggaggtaggacagtggagatgaaatgtgcagacacatcttcagtgatgtgtgactgtgagagggaatggaaaattggcggctatgaagtcaaggacgtttggtgcttctcatcaatttacatgagaggtttgtttttttttttttttcaataaagtaaggttattatctcccagtttgtttttggcctttaatttcatttacaaggtttctgacatgggtctaatctattcatcttttccttccaatgcttttaaacctggaaagtctttccccatccaaagatcatataaatgtttgtgtatatttttctagttcaaaatgtttaacattaaattatttaatctatggccgggta

SEQ ID NO: 98495 - DNA, 395 bp, Homo sapiens
ctttcaagtaatggaagcatgaacatatccactattcagctttgttcctgcagatgaacaatgccatggtttgatgaacaaatgggaagaaacctgggcccctaaatgactgtatgaagacactttgcctcctgacccactcaccacagaactagtatataaaagagaaattgactttcaatatcttcaagtcattgtatttttgacattagagtgtacccacatctaaattacatgccctagcatttaattttgatcactcacttctaacttacataatactgttgtgaactactttaaagaatgtcagaaaatgtatatacttaaagacaaactcaaaattaaaaaaataaatgacaggactacaaagagaaataaacaaatgttacaccagg

SEQ ID NO: 98496 - DNA, 121 bp, Homo sapiens
gtcttaaaacaataaataactgattaagaggaaagattttcacacctactaatttatatctgtctccgttatattaagtttataagacacttgtccggtaacactaatatcagcatttcga

SEQ ID NO: 98497 - DNA, 289 bp, Homo sapiens
ttaataagcaaccgcttccacctgcacatgagaggagggcgaggctaaggagactcaagcatgtgatagcgttcagtgttggaaaaagacaggacctggtggggacggtaccaggaagaaacccggatgctgcgtcctcagcgctggccttggatacgagcttcaccgctctagcccgattcttcatttgaaaacccgtgattgtaataattccctgcacatctatcaggactgtaaatcacatgaattaaatattaggtgacaactaataaaaagatgaggcccgtcc

SEQ ID NO: 98498 - DNA, 670 bp, Homo sapiens
ccgtctcaaaaaataaataaataaataaaaaataaaacaaataaataaaagctaaagcattctaggaattacatgtctgggagctactttgctgaatctcttggaagttgttaaggaaaggcatctgagatataccagatcagaccttcatcttctgagcttcccacttgtaaactgaaattttaaattacctggaataggcctcccttctcttaactcccaatttgaaggctgcgattttaaattagatgagaatttacttaactctatttgatacatatccttatgaatgaacatttgttgactgtctactgaatgtgacaggtattgttctaagcactttatttgtaatgacttacttttacaaaacacccctatgagtaatgttctattgtccccttatttacagttgaggaaactgggtacagagagattaagtaactagtctgatgtcacaggtagtattcagctgagcctgcactcataaatatgatactgtcctgcttctcccttgctaatataggcaataaagagctttctgaaggggaagaaatattattattaaactgatttaatgaattactataattgcagtttcaataattagttttgtaaaatgcaactggtatagcagtttttgaagttttctaattttttccttctgttcact

SEQ ID NO: 98499 - DNA, 689 bp, Homo sapiens
tcccatggagagtgagaagatctgatctgtgtttcaaaggtcacttgactgccgagcagctggaggcgagttgctcctttaggagactgctgcagttgcctgggtgagaggctagaggggtctggtctatagcagtggcaggggagatggaaagaagagaatgatttgaggggcattcggggggcaaaatcaacaggacctggggggagacgaagggatcaagaatgatgcccagattctgggtgagtggcagtgctgtggtgcacaagtagtgatgttatgtttccgggtgacctgctgtttagcaggagcccagcctgtggctaagaagtatagagaactgaaactagctccctagggatgggaaaaccaagtgggctgaggataagaacagggccccagggctgggtgcagtcgctcacgcctgtaatcttagcactttgggaggccgaggtgggcggatcacttgaggtcaggagttcgaaaccagcctgatcaacacagtgaaaccccgtctctaccaaaaaatacaaaaattacccggacatggtggcacatgcctgtagttccagcgccttgggaggctgaggcatgagaatttcttgaacccgggaggtggaggttgcagtgagctgagattgccactgcactccagcctgggcaacacagtgagaccctgtctcaaaaaa

SEQ ID NO: 98500 - DNA, 734 bp, Homo sapiens
aaggacacaaaggctacaccctgcaaaagcagtcatctgtcaagaaaaggaaacccttggcagagtagcccaggctaatatgaggattaaagcggcagcggatcataaaacgcaccaatcagcactctgtcaaaacggaccaatcagctctctgtaaaatggaccaatcagcaggacgtggctggggccagataagagaataaaagcaggccacccaaaccagcagcaacaacccgcttgcgtccacttccctgctgttgaagatttgttctttcactcttcacaataaatcttgctgctgctcactctttgggtccctgccgcctttatgagctgtaacactcaccgcgaaggtctgcagcttcactcctgaagccagcgagaccacgaatccaccgagagggaccaacaactccggatggaaggaacaactccagacgcactgcctttaagagctgtaacactcacagtgaaggtctgcagcttcactcctgaagccagcgagaccacaaacccatcagaagaaagaaactccagacatgtctgaacatcagaatgaacaaactccggacacaccatctttaagaactataacaccgcgagggtccacagcttcattcttgaagtcagcgagaccaagaacccaccaattctggacacactatgacaaccactatcttggaatatggtgttaatcactactatgcatattttaatataggtatctataaaca

SEQ ID NO: 98501 - DNA, 1000 bp, Homo sapiens
tttttaaaaggcaagttgttatatgtgctggatagtttttaagtatgacataaaaattgtataaagtaaaatattaaaatacacctagaatactgtataactttaagtcattttatcaacacattgctaatccagatattttcccgcagtttttctttgaataacagagcaattaatttacttttactatgaagagtcatcattttagtatgtattttaagcaatccaccaagaactcagtaggcagctgagaggtgctgcccagagaagtggtgattagcttggccttagctcacccacacaaagcacaacaggctttgaactattccctaacagggcatttattcttttttttttttttttttgtgagacggagttcgcttgtcgcccaggctagagtgcagtggcgcgatctcggctcactgcaggctccaccccctggggttcacgccattctcctgcctcagcctcccaagtagctggggactgcaggcgcccgccaatctcgcccggctaattttttgtatttttagtagagacggggtttcaaccgtgttagccaggatagggcatttattcttgaacttgattcagagaggcacacattaccattctctaatcagaatgcaagtagcgcaaggcggtggaaactatggaattcggaggcaggtgatgcattgggcgagtttattaacatctgtgactctctagtttgaaatttatttgtaacagacaaaaatgaattaaacaaacaataaaagtataataaagaaaaaaaaaaattcactggccgtcgtttacaccgtgtgactgggaaaaccttgcgttccccacttaatggcttgagcacattcccttttgcagctgggtatagcgagagggccgaccgatgcctttcaacattgccatctgatgcaatggcaattgagcgtatttttgttccggtaattttgtaaacaactattttaaccatgggcgattggctcctttatatgttgcg

SEQ ID NO: 98502 - DNA, 247 bp, Homo sapiens
acatttcaacaaaaaatactttccctccaaaaagtgagaaaagtaacgttgttttgcattttgcaaatctcttttatgtctaacttgataaaagatggttggattctcacagttacttctgcattcagtctgttgctatatgtagctttggttaagtatataatgaaaatctagtcggaaaagggagaagtattttaataaccttttcagataactgtgtttggtaaatactaaaactcaacaaacg

SEQ ID NO: 98503 - DNA, 742 bp, Homo sapiens
atccttgctttcgtgccactgtaactgtaagcctgcttcaagctagcccaccccctttttaaagtgtgtataaaagtcaagtgctcggagtcgcttccaagatggccaaataggaacagctccagtctgcagctcccagcgagatcaacacagaagacaggtgatttctccatttccaactgaggtaccaggttcatctcattgggactggttggacagtgggtgcagcccacggagggcaagctgaagtagagcagggcgtggcctcacttaggaagcacaaggggttgggggatttcccttttctagccaagggaagctgtgacagactgtatctggagaaacggttcacgcctgaccaaatattgcactattccaacagtcttagcaactggcagaccaggagataccctccaatgcctggcttggtgggtcccacgcccacagagccttgccactgctagcacagcagtctgaaatcgacccacgatgctgcagctggacggggggaggggcatctgccattgctgaggcttgagtagctcacagtgtcaacaagcagcctggaagcatgaactgggcacattccacctcagctcagcaaggcctactgcctctacctctgggggcagggcagagtagaacaaaaggcaacagacagcttctgcagacttaaacatccctgtctgacagccctgaagagagcagtggttctctcagcacaatgtttgagatcctagaa

SEQ ID NO: 98504 - DNA, 566 bp, Homo sapiens
attcagggaagatggccatgtgcaggtggaggcagagattagagaggggctgtcccaagccgagggacacagaggatgccagacaccacgggacactgagaagggcaaggaagggtcctcccctagggccttcagagggagcacggtcctgacacctggatttctggcctccagaactgggaaggagtaaatccctgttgtatccagctgctccctttgtagtcacttttcacagcagcgctgggaacgaacgcaggcaccaatccagcttgggggccatgtggggtagcagcggatcgggacttccttctaagagaagcgatcttgagccgtgtcacgggtgaggagttaggagttagctcagtggggaaaaggtgaaggcagcactcacggtcatcaagccagcccctgtgggaagcaggctgggtttaaggatttctaacctgggctccttgaactcccagggtccccctacatgtgtgcttcaattttgcaccttttcttggggagaaacgattttggaggaccatgtggccttcacggtcacaaactggcaatgtcaagaa

SEQ ID NO: 98505 - DNA, 664 bp, Homo sapiens
gtggtgatggttgcccaacattgtaaatgcacttaatgcgactatactatatgcttaaaaaaatggatgaaatggtaagttttgtctttttttttttttgagacagggtctcactctgtcacctaggctggagtgcagtggtgcaatctcgactcactgcagcccccacctcccagattcaagcggttctcccacttcagcctcccgagtagctgggactataggtgcacaccaccatgctcattttattcattttataaaaatgggtaattcctagtccctggcccattctcccctacttatagaatgtggtattaaaatattttacccagtttgcaattatatgcttagaaaatattatcctaagaaaaaaagtaagagaagctatgctttaagaaaagatcttttggtatagaatttccacattctcgaaaaagtttccccagattaaaccgattacattttttcgacctctccacatccatacaaagttcacctagtttgtcttacttgttacccggagcataaagccattatctttatttcaaatctcaaaatgattaacagtttcagttgatagaataagaagccagtaatactatggctaacaatcttttttttccactgtgttaatcagaacactgctagagtacttcattcattc

SEQ ID NO: 98506 - DNA, 218 bp, Homo sapiens
gatttgggaaattccacctttcaatctgaaatctggggaaagtcccagaaaacaacggattactatatttctctcatgaaccagactgaagcaaggagtcaggtctaggaccaaggacctcggcactccagggagcccagggcccctcagaaaggtctcgcttggccaccgagagcgtggggccgtagcagttggcaagcgggggaggggggtcacgc

SEQ ID NO: 98507 - DNA, 298 bp, Homo sapiens
ttcgcttggctcttcttatgcactagatacagctacctgggatgcaggtgctgtttcccaaaggcaagcaagtggcagtaacctagctcttcgcggaagaagtaacgagagaaatcttcagacccagaacagggtcctctgcatatgcaggtccccaacggctctatttctcccaggtgggaaggtgaccgttcctcaggacctcccaagtgctaggcactatgctgggctcttaacatgctttccttaatttacgggccattccttccccccaatccaataatttagagaggcctca

SEQ ID NO: 98508 - DNA, 725 bp, Homo sapiens
tgtctttgctcactagattccctcagccttcaacaccttgagagcttgtttggaggccctagcaggggtgcaaagctactcatatacccttggctgaagaccagtcctcctctatcggggattgtcgtgagtgcagctttgggaaggacgcatatggagtggtgagggaggaaggggacacctgcctagccagccagatcagccgaatcaactttggcgatcaatggggtgacagatgtcacagccagatcaccctcacatccccctagccttgaacacctttccccatcttcttcacctggcactttttcttgtggcaggagatggcaggatgagattgtggtcttccatccacacagctaccccttcaccatgtgatctctgcataccagctaccttttgccttctgacatgaacggaagaagcctgcagccctcaccagaagcagatgctgatgccatgcttcttgtacagccggcagaactagctcagttgatcgtggataactgacacaaggaaggcaaaagtgggtgaaggaggcctgctgaattgggaaattgttagacaacattctacaacggctgaacagtgcttgtcatttcagtgctgtacaagaatattaatgatgtggaaagctgtccattataataaagttcagaaagaactttgcaaaataaacaaacacacaacaacgggaacagaccaaaaaaacttctcacagggta

SEQ ID NO: 98509 - DNA, 948 bp, Homo sapiens
acaaagggccacgcctgcccctgggaggggtattgggctgccgcccgcagatgttgcagtaggaactgaagaagatggcgtgcctgggcttcctcctccccgtgggcttcctcctcctcatcagcaccgtggccgggggaaagtacggcgtggcccacgtggtgtcggagaattggagcaaggactactgtatcctgttcagctccgactacatcaccctcccccgggacctgcaccacgccccactcctgcccctgtatgatggcaccaaggcaccctggtgcccgggtgaggattccccccaccaggcccagctccgctcccccagccagcggcccctccgccagaccactgccatggtcatgaggggtaactgcagcttccacacgaaaggctggctggctcagggccaaggtgcccacgggctgctcatcgtgagccgggtcagtgaccaacagtgctcagacaccaccctggcaccccaggatccccgccagcccctggcagacctcaccatccctgtggctatgctccactatgctgacatgctggacatcctcagccacactcgtggggaggccgtcgtccgcgtggccatgtacgcacccccagagcccatcatcgactacaacatgctggtcatcttcatcctggctgtgggcacagtggctgcaggcggctactgggccggcctgaccgaagccaaccggctacagcggcgccgtgcccgaagaggaggggggtctggtggtcaccatcagctgcaggaagctgcagcagctgagggagcccagaaggaagataatgaggacatcccagtggacttcacgccggccatgacaggcgtggtggtcaccctgtcctgctcgctcatgctgctgctctacttcttctatgaccactttgtctatgtcaccattgggatctttggcctgggtgctggcattg

SEQ ID NO: 98510 - DNA, 236 bp, Homo sapiens
ttctctccagtgtgtatcctcttatgtctagttagggttgagaattgaattaatgctttgccacattcttcacatttgtagggtttctgtctagtatgaactctcctatgttcagtaaggcctgaggaccagataaatgctttgccactttcttcacacttgtaatgtttccctctagtatgaattctcttatgtttagtaagggttgagaactgggtaaacgctttgccacattc

SEQ ID NO: 98511 - DNA, 322 bp, Homo sapiens
ttcatgaccccttatcagctccaggcctacatttcaacaatttcctctgttttcatagaatcttgtctcattttttcttttcatcattgatatccactcagttctcaactccagattctatgtgactttctattttctgtacctctactctcagtaatactggacacacaaacacacacatatatacacacataaatgtctcatgtggataataaattaaaattttctaacagcaaagaaacccctattttcctgtcacattctctgcaatgacatcccttactcccacccataagtagaacatctcacctcgtatttgttt

SEQ ID NO: 98512 - DNA, 349 bp, Homo sapiens
tggttatggttatgtgtattttatgcactatgaatttaagatcaatttctattgataaatgataaagtgctttagtttagtttgccatttggtttatgtgatgtcatataaaagtttaaaaagacccattctttgctatggtttccggatttagtttattccatgtttacaacttacatacaacattatttcagttgaaaagaacaaatgacctatttattaactgagcagccaatacttctcatactaataatgggtatgtattacaataaagtggcagcagtaaggttggtagacttatgtatgattttcctgtggggtcctgggagcccaaattatttattacttg

SEQ ID NO: 98513 - DNA, 732 bp, Homo sapiens
ccatcttctgatattttttagaattttctttagagaaaaactgttaatgttttactcccttttgagggtcacaatctattacaaaacaaaaacttttcattcagtttcattgtatgtggccctttacacttcctgctaaagactttagccatgtatctttgcccagctagatacacacacagtcagcttttgatatttgccctgtggaccagatgaaataaagcccagaatcaagtctactgtttcccaattggtgtgaccatgggctgaattctgcgcttctttttgttgttgttgttgttgttacattgctacagcccagatttccaatgaccttgagaggtctatgcgtgggtatgtacatcctgatgtgggttactcatttcccatgtaatcttacaggtcctttatttctgcccaaatgtgagaggctccagtaaagtttctagctagaagaattataatctatagaggtggttgatagaattattttcatgctcagtgttttcctttaggtctctattctccaaatcttgcaggtaaagtagtcctttattcagggaagatgatgacgttcataattgcaggcctagagagaaagctggtcaattgtcatacattccacagggaacatcaaacagagctcctttagttgagggcatctcaattcactgagctgagccagtctcactgatgtgtgatctgaatgacagaggactggcaaaggccctg

SEQ ID NO: 98514 - DNA, 458 bp, Homo sapiens
acgagaatggcgtgtggtgggatgatgcctgggtgcccagtggcaccgtaggcagaatctggagatatagtcagttgggctgtctgacccacactcatctaagcaaccctttcttcccagcctcggatcacctcctgctaaaaattaaggggcttgtttctgtcccgggaggaatcaaatttctttccatcttcaagcatcccggtgtagtgcaccacgcaggtctggccgtgcctcgggaaggtgcactcctctcctggggagatggtttccacctgcactcccatggcggcggccgatgctgggtgggcgggtagcgcgacgggcggtgtggaccaacagcgacctggcggcggttccacagctctggctagacccttggcttttatttatttatttatttatttattttttgatacagagcctgggcgacagagcaagactcaaatcaaaaaaaa

SEQ ID NO: 98515 - DNA, 543 bp, Homo sapiens
ctgacccactcctggctcaagctatctgcgcaccttggcctcccaaagtgctggtattacagagctgagccatcatgccatggccatgtttatcacgttgtctacgattcattatagcaagcggtaactaggggaggtcccctagttgggtgcaagcagattcatttatgtattgtgcaaatcatgtaacacagtgaaattcataatcgtaaccccatactgggatcattgaaatattttactttccctattttgtttactatcaagcctgatctcattaagatatatccagtggcctggatcaggatcatgtgaaaaacaggaccttggcttgcttacaacgtttgcatttgttttggtgggtcagaacataaggaaatggaaggtgtcggaagcaaagctgagtgacagaacacattcagtcagggcagatgtctatacagagtgtagtggaacctcaggaaaagcttcatatggattcatgcgcacgcgtctggaggcaccagatccctccatggcagatccaagaacagggagctgagg

SEQ ID NO: 98516 - DNA, 398 bp, Homo sapiens
aatctggagatatagtcagttgggctgtctgacccacactcatctaagcaaccctttcttcccagcctcggatcacctcctgctaaaaattaaggggcttgtttctgtcccgggaggaatcaaatttctttccatcttcaagcatcccggtgtagtgcaccacgcaggtctggccgtgcctcgggaaggtgcactcctctcctggggagatggtttccacctgcactcccatggcggcggccgatgctgggtgggcgggtagcgcgacgggcggtgtggaccaacagcgacctggcggcggttccacagctctggctagacccttggcttttatttatttatttatttatttattttttgatacagagcctctctttgtcacccaggctggagtgcag

SEQ ID NO: 98517 - DNA, 528 bp, Homo sapiens
cctctaggctgccgtgtaggtcttatgagctaacaaagctggaaatgacgaaagccaagctgaacaaaagttaagagctttgtaggaataaaaatacttttatttatgaacatctaaaggctttgcctaaaagtgtggtcagtggaccggcagcagtggcagtacctggagcttatcaaaaatgcgcagcccgggtcctcaggctccaccccagtcctgctgggtcagagtctgcattttcacaagcttcccccatcacccatgggaaacactggtctaggaatttcttgcttctcagttccccattcccggaggctgcctcttgggccttctttccatagcctacaaggggttcttggcaggaaattcccatctcgttggagaaaatgctgtggcccagccagacccctgccctgctcaactgcctaggagatatgagtgcatcagaattaagctgaagttgggcagaggctctaacagcctctgtcactccaacaacctctgatgagaccatttgttgggagtgca

SEQ ID NO: 98518 - DNA, 271 bp, Homo sapiens
cactatcacgagaacagcacaggcaaaacctgaccccatgattcaattacctcccactggttccctcccacgacacgtggggattatgggagctacaattcaagatgagatttgggtggggacacagccaaaccctatcactggatcatatggttattttggattttaaaatcttggttaccaattctgagaaacctagaaagcatagtttatctgctccctgcgaagataattcctcacatttttgtttctctggaaagtctgcaaaaca

SEQ ID NO: 98519 - DNA, 161 bp, Homo sapiens
gaactgaacactagatgcaatatactgtatgtacattgtacattaatacaaaaatgaaaaaggatcctaatgcccaggcctttggggtgggggcaacagccttctttgcagtgtgaaggccacactggggtgtagacgagcaaagcttcttgtgtgacctg

SEQ ID NO: 98520 - DNA, 326 bp, Homo sapiens
actgctggctgtggagataatataagtctggagtcttgttggtggccatccgcttccaccaaaggagaccagctttctgagaatgaagccaactcagagcaaagaaaggaacaagggggatccctgataacatcactgggattcctggacccagctttgtctgaggatagacacccaaagttacataaacctgtaaattatctttttagctaaagctagcttgaggtgggcttctgtcacatgcaaccaaaggagttcctactgatacacaaatgttttccaatgtgccctgtggagtcctgaaggtccccccagaggtgctttgg

SEQ ID NO: 98521 - DNA, 379 bp, Homo sapiens
cctgcaattacccagttcaaatgtttgaagaaataaacattttacattagtcacactcaccccctgggcatggaagcagagccaagccctgttaagagtaaaaacagcccaggaaggtgttcctgaggtaacggcattacagataccagtaaggacagaaggcttaagagcgatcctcagactgaagtggcatcatttagaggcacacgtgacaccaagagccaacagaggtttctgcctccaggtaccccagtttggcacctaataagcactgtgcttactctttctccccagtggtatgattgtgacattcctctgaaatacagcttagcagctacccacagggtttgagagatgattggcagctgcagcttccacc

SEQ ID NO: 98522 - DNA, 327 bp, Homo sapiens
gtctaataattccacttgcagatattaatctactatttaacagaactcatttcttcataattatctaccaatcaacattactctcccttattactccatcttatcattctaagcagaacccagaatatcaatccgagcttatcccaaaagtatgtattttgatactaacatttaatcattgtacatttattgagtattcactctgatccaagcagtgaattgaatgaggcacagtccctggtctcaagccgatcactaacagcataataattatctccagggtgacattatgatttctgttagattctagagcagtaaaacagttgt

SEQ ID NO: 98523 - DNA, 317 bp, Homo sapiens
ggtggtggttatatgggtgttcactgaacagttctctcaattttactgtctgacacacctgcctgctggaaatggaggtggccttgaagaagtgagaatggcagtcatagccctgaggtcagaggacatggtctcaccttaaacaagcctgctgacctggaggaggactttcacatccccaagcttctttatttaaaagggtagtggtcaaaatcagggacctttttacaaacatcttatgtttggacccaactatgagtctactgactcacaatgtgaggcaggtggggtaacataacattatctttttcttttct

SEQ ID NO: 98524 - DNA, 459 bp, Homo sapiens
aaccaagtatgatcctcccaaggaccagggcctacagtccagtcaagcttgggagtgtagctaagggaggaatgaataacccactgtcatttcaagcgtaggattctctcatcactctcactgttttaaatcttctttatcatcacagattttacattattcccttatgtatgaatgttatttttattgaccattgaagattggaacctttttctggaaaaacatcacatggttgagtcaaggatgaaaagtcaaaactaccttttcatgtgaggggagagagagagaagcgcgcgcgcgcgaaagcgtgtgtgtgtgtgtgtgtgtgtgtgtgtgtgtgtgtgtgtgtgtgtgtgtattgggaccacctttcagctgtgttgcctccctctggtggccattatatgcacaaggcctgggtgacatggactgagtcagaatgtaacttacttttcaaaa

SEQ ID NO: 98525 - DNA, 573 bp, Homo sapiens
ctagggccggggagtttgggggagtgactgttaatgagtacactttcttttgggggtaatgaaaatgttctaaaattgataagtgatggttgcatagctctgaacacactggaaaccattgaagtgtgtattttaaatagggaaatagaatgtgaattatatctctaaggtgttacagttaatggaagcctttcaccttatcgtgatactgtatttcctcagtgctgagatgtgctttttaaggctaggcttggctgctcactcctgggatcccagcactttggaaggccaaggcaggaggattgcttgagcccaggaattctagaccagcctgggcaacatagtgaaaacctgtctctacaaaatgtatatttttaattagcggggcatagtagcatgggcctgtagtcccagctactcaggagactgaagtgggaggatcacttgagcccggggggtcgtcaaggctgcagtgagccaagattgtgccactgcactctagcctaggtaacagaatgagaccctatctcaaaaaaaaaaaaaaaaaaaaaaaaaaaaatatatatatatata

SEQ ID NO: 98526 - DNA, 641 bp, Homo sapiens
ttatgtcttcataagtcttaactccagaatctggattctagtatcctatctctctttgttaatttccatatttttaaaaatagagatggggtttcaccatgttgcccaggctggtgatgaactcctgagctcaagtgatccacctgtcctggcatcccaaagtgctgggattacaagcgtgagccaccatatccagcacctagtagtctgtttgtcattagttagttgtatgatcttaggcaaatcacttggtattcttcaatgctacaattttacgattccatgaaaaattctgaagaacaaaaaccaaaaactcgcacataaaaactgccttcaaagctttcctttctcaaatagcaggtcttataaatcacttttggtattctccataatctagaccacactcaaatgagaaattactgaacccatgattcctaagcaaagagaatgaccaaacatattcctttactaagcaacctgagtccaagacactttataattctgaaacctgtgactgttctgtataaatgttttttatgcaaaataagcaccaaattcataattctaacacaatgatgaattatattattttttccagctcttttatcgagtttatagactacattaatctttaagtacca

SEQ ID NO: 98527 - DNA, 479 bp, Homo sapiens
ttcagagaacttgactgactctcccagtgtcatacaacagttaaatggcagaattagaacttgaaccaaagtctgactcatatagatcagggctatttcaatatttacttattcatccagacgtgtgtttgttcaagtcagtgtcagtgagctagatactatctgtaggtacagtgtcttaagatatgttacttgatcctggctgggcgccgtggctcacacctgtaatcccagcactttgggaggctgaggcgggtggatcatgaggtccggagattgagaccatcctggctaacacggtgaaatcccgtctctacaaaaaatacaaaaaattagccgggtgtggtggcagcctgtagtcccagctactctggaggctgaggcaggagaatggtgtgaacccgggaggcggagcttgaagtgagccgagatggcgccattgcactccagcatgggtgatagagtgagactctgcctca

SEQ ID NO: 98528 - DNA, 661 bp, Homo sapiens
gtccagtgcctcacagacagcatcccagcacatcatggagagctaagtgacagaacaggcagctcctcttctccctggaggggagaacagagatggatttctatcaaaaggagccactatgtgctgttacatgccatatacatgggaggttgtgacagttgtattaaaacctccaggactggctatctatgactggctccacagtgctcagggcaagaagagtcaactgcaggtcttttgtggctcattatcttcttgcttccatttcttaaagggagaatatgtagattggtcccctaacttaggaagtacggggaaagtaaaaccagaaatacttcccctaactttgactcgtataaacacattaaggaaaggaaaggttgaaaggatgttcccacactcaaggaacttgtacaaccaagtcaagcgaggcaagtcaagaagaaaacagaaccccaatcatttctccagatgctctgaatcacctccagggcacaggcatagatgttccccaaccctgaatgctacagcaagtgcatatctacttacagcagatttgtaaacagatctattctccacttaaaaacattttttcaagaccagtgattaaaaatgtaaaaactaaagcctgaaaaaatatcagttccccttgcagagccca

SEQ ID NO: 98529 - DNA, 373 bp, Homo sapiens
tatgctctactcccagctacacatcatctgcccctctacagctcaatggaaaggttccccctacccgctggggccgttacctgactgttgccaaactcactggttaaatcatttggacagagcatggttggctctggaatagcaaattttctatgaatatactggcattacaaaaagctgatttggtcaccagctttcagatttatttccgtgaacagggcgagagttgtcaaaagaataagctcatggagctgatgaagaacttgatgatgaggggaggttttctcacccggcaggtccagtgtcaaccaggcaaacagcttctactgctctaaatttttagcatccacctgtctggactagcaactcccta

SEQ ID NO: 98530 - DNA, 268 bp, Homo sapiens
actgccactgatctgtacactaagaaatggctaaaatggctaattttatgttatgcatatcttactataaatagatgaatgcacacacacatagaaactacacaatttcaaaaataaagaaaaggcaaaaaaaaaaaaaaaagagtggttaagaaaagtgactgagagctacagaagccactctgtctgctgcctggccccctttcctgtggtctggcaccagtgggcccaggtcagcacagccacggccgtccctgccctcaccctc

SEQ ID NO: 98531 - DNA, 500 bp, Homo sapiens
ttccccttcacatttgactatgattgtaagttttctgaggcttccccagccatgtagaactgagtcaattaaactttttttgtttataaattacccagtttcaggtagtatctttatagcagtgtgaaaatagactaatacactaggcaacatagcgaaaccctatatctacaacaaaattagctgggcgtggtggcccgtacccatagtcacagtacctgtagtcacagctgctcaggaggctgaggtggatcacctgaggccaggaggttgaagctgcagtgagctgagccatgagcatgccattgcattccagcttggatgactgagactctgtcccctgaacccccaagaaagaatatcttactagggaaaatgtaaattggaatggaaatatcagtgactgaaggcctaatgagaaatacatgagccgctgttgctgaagtccccacgctgtaggaaaaaccaggctcttgtcacatgaccaggaaagattaggc

SEQ ID NO: 98532 - DNA, 567 bp, Homo sapiens
ctttgatcctcacagcagtcctgtaaggtattatgtggcggagcctggatttaaattagactctttctcaaattccatctccagtggttatattattagagatgtgaatttgttccccaaaaaacacttaatgatgctactgttatttgatccctttgccagtgccagacagtgtgctaagtatgcgttttacgtatgttaattcatttattatatgcaaaaccactttttttttttgagacggggcttccgtctgtcacccaggctagagatagtggcttgatggcagctcactgcagcctcaacctcctaggctcaatagatcctcccatctgagcctcctgagtagctgggactacaggggcacaccaccatgcccagctaaatttttgtatttttagtagagatggggttttgccatgtttcccaggctggtctcaaactcctgggctcaagtgatccacctacctcagcctcccaaaatgctgggattacaggtgtgagccattgtgcccagctgcaaaaccacattttatagctaaagaagttgaggctcagagagattac

SEQ ID NO: 98533 - DNA, 314 bp, Homo sapiens
ttaaaaaaaaaaaaaaaaaaaaaggcaaacatcacattaaaaagtctgctacttcacaaatgcagaattacattttcttaaggtttttttatctctctttccctattatgacactataattttatcaggcttaatagtgcagttacataatcaaaatatatttcttcaggtatttatccttaggagacctgatccttagtaatgtctaactaaaagtttccaaatagatgagtgaacgattgagcatgtcgagattttcttttgtgtttttaaggattgcatttattttaaacaagaacatactatccttcatt

SEQ ID NO: 98534 - DNA, 809 bp, Homo sapiens
ttgggaaaatggtacctctagacttgtttggtgccgggttgccacaaactcagcttataagaaaacacagtatcttgaaagtgtattaaaatgaagcatgataaaacgaggtatggctgtatttgatttaaatttagaatttggtaagatgcagctctgtggatgtttcaaagaagcatgtgactagtttcttaatttatatttttgaggtctaaatattgtcctaaaatattttatgtttaactgagttttttcaggaatcgtgtaatcttttagttgttgataatacaagtaattatttccatcaaagggaaaaagttacttaagcaaaagacttagccctgtttatgggctctgcattttctgtcctttctttttcatgtaatacattatatgcatcttacatgtcattgttttccttttaatatatggatgtatgataatttatttaactgctctgttctctgttacttttttttttttaaatagacaggatctcactttgtcatccacactggagtacagtggcaagatcatagctcactgtaacctcacacacctcctgcctcagcctcccaagtagctaggactacaagtgtacctcacaatgcctggccaattttttatttttttgcagagatgaggttttgctgtgttgctcagactatttatttttattgcttttctattcttaacagaatttcagagaacatctcttcagttaacttttcactcacatattgatccgttaataattctgataaatttctaaagatgaaattgctgattcatgttaaagacttgatcct

SEQ ID NO: 98535 - DNA, 1174 bp, Homo sapiens
tttcagtgaaagcagtgtatttgctaggtcataccagaaatcatcaattgaggtacggagaaactgaactgagaaggtaagaaaagcaatttaaagtcagcgagcaggttctcattgataacaagctccatactgctgagatacagggaaatggaggggggaaagctggagtattgatcccgcccccctccttggttgtcagctccctgtcctgtgtgtgggcggaacatagtccagctgctctatagcaagtctcaggtgtttgcagtaagaagctgctggcatgcacgggaacagtgaatgccaaacacttaaagcaattcgatgtttaagtatgtaagttcttttttttttagacagcgtttcgctcttgttgcccaggctagcatgcaatggtgtgacctcggcttactgcaacctccgccttcccagattcaagcgattctcctgcctcaggctcccaagtagctgggaccgggtgcgcgccaccacgcccggctaattttgtatttgtatttttagtagagatggggtttcgccatgttggtcaggctggtctcgaactcgtgaccgcaagcgattcacccacctcagcctcccaaagtgctgggattaccggcttgagccaccacacccggcacatcttcattctttttatgtagtaaaaagtataaggccacacatggtttatttgaagtattttactaatttaaaaaaatacagaagcaggaaaaccaattataagttcaagtgagggatgatggttgcttgaaccaaagggttgcatgtagtaagaaattgtgatttaagatatattttaaagttataagtagcaggatattctgatggagtttgactttggttttgggcccacggagtttcagatgcctttgagaaatgaatgaagtagagagaaaataaaagaaaaactagccaggcacagtggctcacgcctgtaatcccagcgctttgggaggctaaggcaggcagatcacttgagaccagcttgggcaacatggcgaagccccatctctacaaaaaacacagaaattagctgggcattgtggcgcacacctgtattcccatctactcaggaagctgagatggaagaattaattgagcccacgagttcaaggctgcagtgagtcgtgattgtgccactgcactccagccg

SEQ ID NO: 98536 - DNA, 515 bp, Homo sapiens
gccctgctgatgcctttggggtcattcttttattttgaaggataagacatgtttgcagccatatagtgatattagctcattctgttgaatcccagaagtctgatagccttccttcattttatcccacctcaatccagttcactcgaatctgctggtataagattatcagaaactgagttggcctcccatgcaattcatggaggtccacaccatcagacaagaggcttttccagataactgcatctctattcctggcttctgttgagatgactaattggatccataaattgcacacctggtgctttagcaaatggttgtctagccacacccttgatgttctcttcagaacagtttctcattttttaccatgtggttaggctgaagaatttccaaagcttcaagtattggttccttttttatttacaattccttcttcaatttatttccctcctcttgcactttacaataagcagcaaagagaaaacaggtttcatcttcaacactttacttagaaa

SEQ ID NO: 98537 - DNA, 2313 bp, Homo sapiens
cctgaaatgtgcaatctactgtatagtattgccacataattgtacatagatgtattctgaatttgtggaatttcttgcttagatactattgtgtttgtttcatatgaatatttttgtaattctaaaagagatcttatttaaatttcctttttaaaagccgcatggttctgtgatccatgtaactgacactttttggctttcagtgctgtttagaaacagtggcaaaggcagggtggtgctgcctgcaagctgctgcctatggaaggcaaagtcatagtaatgagatagcacctctgaactgtgcagtcagcataccctgagtgatggctcaggggcgcactacctattttgtcaccagagctgactcaggcttcctggaccctcaaccccagatcattccaggcagcatagctttcttcacagtcctttcagaattcccaggctgaaatcagccatagcagttgacaaaacagctatccccacaagtgatgagatagtccctttactgtcctcaaatggacttggccttagagacgtggtaaagcactttggcagggtttaaaatatttgtgagaagcccacatttcagtatacatcctcactggcttccatgcacccacctgacggtagcctcacagaagtcctggctgtcactcaggtggggagctcatggtgccgctggggactttttagagaaatgtaaagagaatagctattcagtgtctactagcagagcaacatgtgtcaatttaaccaaattcacaaataaccctccatttttcaatatctgctactgtaaacatgaatattgaatactgacaagagaatacccatacaaatcgtcccaccgccctagaggccacagaattagcccaaaattatcaaagaacattaactggaaggtcaggtttttcaaggaacatagcttacaaatgcatcagtgtgtatctggagagcatcctaactgcatttcaactcatcttttaagtgatttcagtcaaaactggaaaacaactaagatgtagtaatttttttttcctggttcaaaccttcaataacttgctcattcagcagtctctctgagctacatttttatttgtaaagtgactctgtctgcatggcaatgagcaggtgcgtgttttttccacattcgccctttcttgcagtatccagggaaacacatcattacaaagggtttctacctgaaatctttcatggaaggcctacaattcgaaaagctgcacatgtttacagaagagctcttaccctccatgcaaacactttgctctgtggtgtcacagctttgtgacaataagatggcaatctcggatctacaaggtgctgtcgggaatcaaataaaatatgttatcagagatatcatcacatctatagtgtttaacagagctttatgccaactactaagacaaagctttaacaaagtttatagaatactgaaactcgtaacaattacctctctacgtgatgctgtaaggaatcttgctaatttggtaggaagaggaagcatttaggaaagggtttagtatctaccaaaagtacttgacctcaagtaaccaatagtaatgcaaacttgctttaaaggaaccaaaggcattgccaagtatttgccaaaaggaggcactttttatttaaaatttgagactaatgagatctcaaaaatcagccccaaaaaggtattatccatttaaggttataattttcactaagatgtagatatttctcttattgttttcatgtaaaatagtatagagttgttttgttggtttaagagtaacattcagtagtaatacaaagttttttttctatgtagaaattagttttcttttcttgcttgcaatagaaatgcaatgtgataggtgtttctcttcttattttcattgtcacattatgtcttagcatctcactttatgaaaaaaaggagaaagataccaatctacagagccctgcttgttgaagcactagtttaatcaacaaaaaattatggcaatcgggggtccattcatctattgcctttatgttgttttttaaaagaaaaaccatgatgcctttgtatttgctgtttgcacccctgaaatcaattccatatcatgtttgaatgccatacattttgcacatgtactgtacataagtaatgcatactgtatttttatatgtgtgcacatttatcatcagatcttttgtacatagtggcagtattgtagctgatcgggaaatgtttgatatctcagcaattttgcatttttgtgtctcaaataaaagacattttgatgtatgattcttgctgtgcagaggaaa

SEQ ID NO: 98538 - DNA, 411 bp, Homo sapiens
cccacttttccatcctgagtagctaggactgcaggcacatggcagcatgcttggctgatttatttttattttttgtagagacaaggtcttggggtgttgcccaggctgaacctggcaatcttatgaagaaacactttaaactctgaaggaaactttttaagtaatatagacacaatatttttgaaaagctcttaaattgctaaaaattaatgcaaagaatagaattgcttatagtagcccaagaggaaagcataaaattgaaactggaagaactttttgggtggtattaattggagttgtttttactttgtgcatttcactttctattccttctcggaaatgccagaagtacatttggtaccaggatgagaaattcctgttcctccttgttttcacacttgagatgtttgt

SEQ ID NO: 98539 - DNA, 1017 bp, Homo sapiens
aaacagcatacacagacagacagttagggactctgaaacgatctcactaccaagaatgattaaacatttgaggaaaacctatggtagacaaatgaggcaccaaacttaataaacaaaaagtaatagcgagtgagacaatgaataagtaacagagactttgaaataagtaaaagtaagattcatagagagaaaagagattattgcatttataaagaaatatgtattaaaatgaattcaaaccaatcaaatatcttagaatttaagaatgtaattatcaggattaaaatgcataattggactaaatagagtggacacggttaaaagcaaattaatgaattggaaggttgaattccttcagaatgcagttttgaactgaaaaaggtggaaagcatgaacaaaaagtcacatgatacagaggacgttctaaaccttcagcgttcatctgatgtaaaattgaaatagtatggagttataatcacagaagtaataggaaattttcctgaactgaagacagacaagtcttctgaaaacaccttatgaatgcagaagtaaagaataacaaaaggccaacactaaattcctgcttatgaaatttcagaatacgtgataaagaggaactgactaaaagtattcagagagcaaacagtttatctgcaaaggaaagaatgagattgacaacagtcctattattgataaaaaataaatgatagaagatagaatgcagtagttgtggagttgtgggaaaaaacattttgaactcataattctaaatcaggcaaaccatcaatttagtgtgagtggaaaattaaaacaattttgaaccttctctgattgtttcacaccttctttgaaagaattgatggaagtactcccttccaaaaagcaggggagtgtccaaagaagggaaagacataacatgggaaacatgtacacacagtaaaatgtatagttgagcctgatagtttttaaaatctataatgttaatctttaaatatttaagtctagatcagatcagtt

SEQ ID NO: 98540 - DNA, 774 bp, Homo sapiens
  misc_feature (4)..(4): n is a, c, g, or t
  misc_feature (63)..(63): n is a, c, g, or t
agcngcggagttgagattcagaccttgacagtgtaaccgatagactgggctggggcaacgctnatgaaaggcaaattcctgagagaaaaatcacccagactttctagaagttgttatgagtggacctgactacctagagagagtaatacagaagctccgtgccgatcacagctacctcattaccatgttcctccaagatggccgcccctgaggagaatcatcaactgggctttacggaagagagaaatccaaacgaccatcagcaacaaatgaaagactgaagttgaaaggaaatccataatttttgaatgctggccgaggtctgtgacctctgactgaatggtttccaagctccgaattcctaggtgatgttttcatttgttcacacttgctgaagaagggaaaggctctctgatttacgtgtaagcaaaacaatctaaacagtaggataaaatcatgttggaatggagttctgcgtggatgctcctttgaaccaaatcagttccacaactgaccctgtcagggacatataaatttagcattttggtgtggatacagaagacgagattaacacagatcaagtaacatggaaataaaaaaggagacaatgctggatgatacaggggcagccaacaagaggagaaaacccaagcattggcaaatgcctcattatccaaagaacactgaggtgtggagcaaaactgtgttgaatgaactgtagatgggaaattctctccttcccaccgaaggagcccgctgcaggttgcgacttcc

SEQ ID NO: 98541 - DNA, 794 bp, Homo sapiens
  misc_feature (4)..(4): n is a, c, g, or t
  misc_feature (63)..(63): n is a, c, g, or t
agcngcggagttgagattcagaccttgacagtgtaaccgatagactgggctggggcaacgctnatgaaaggcaaattcctgagagaaaaatcacccagatttttcagtgccttctctagctttctagaagttgttatgagtggacctgactacctagagagagtaatacagaagctccgtgccgatcacagctacctcattaccatgttcctccaagatggccgcccctgaggagaatcatcaactgggctttacggaagagagaaatccaaacgaccatcagcaacaaatgaaagactgaagttgaaaggaaatccataatttttgaatgctggccgaggtctgtgacctctgactgaatggtttccaagctccgaattcctaggtgatgttttcatttgttcacacttgctgaagaagggaaaggctctctgatttacgtgtaagcaaaacaatctaaacagtaggataaaatcatgttggaatggagttctgcgtggatgctcctttgaaccaaatcagttccacaactgaccctgtcagggacatataaatttagcattttggtgtggatacagaagacgagattaacacagatcaagtaacatggaaataaaaaaggagacaatgctggatgatacaggggcagccaacaagaggagaaaacccaagcattggcaaatgcctcattatccaaagaacactgaggtgtggagcaaaactgtgttgaatgaactgtagatgggaaattctctccttcccaccgaaggagcccgctgcaggttgcgacttcc

SEQ ID NO: 98542 - DNA, 604 bp, Homo sapiens
gtgacttgcggaaaactcgtaaaagtgaataattttttgacaaatattacagcagataggtttttttgttgcttttgcttaattacatttcactgttttttgattcttgataccagcaagggattaaaatagcggtgtgtttttctgctgctagaatgtatgatgaatcactcttgattctgaagccaaattcttgctgatagcattgctgccaatttctgtgctatgttgccttagtatgggcattgcagcgtccgagaatgtgcacaaagcacatcagaataaaggtgatcccagagctgcagagtgcacgtcaggataccagagggcagcttctgagagagctggaaaaggaaccagcctgcgaatatagttgtttgtagctggactttcagtgtgcatgaaaagggggaccccaccccttttctttttccacagagggtcatatatgtcacttcagttgaagaataatagaaaaagttgtgatttggaacagacttgagttttctgaccatacctcagcatggtatggtaagttgtgtttaatggtttaggtgtttttttaaatgtttgtgaggtgatgaatgagatcataaaataccca

SEQ ID NO: 98543 - DNA, 198 bp, Homo sapiens
aagtcttcccagtggtaccagaaatactggaaatgtctgcatggggtggggggaacaaataaacattgatccttacttaataccatacacaataattaacctgaaatgggcaatatgcctagatgtaaagctaaaactacaaaatttctaggagaaaacctagtagattttctttgcaatattaaggcaggcaagatt

SEQ ID NO: 98544 - DNA, 752 bp, Homo sapiens
acggagtcttggtcttactccccaagcaatggtgcgatttcgtctcagtgcaacctctgcttcctgggttcaagctattctcctgcctcaacttcccaagtagctgggattacaggcgcccaaccacacccagctaatttttgtatttttagtagagacagagtttcaccatgttggccaggctggtctcgaactcctgacctcaggtgatccacccgcctcagcctcgcaaagtgttgggattacaggtgtgagccactgcgcctggccacatgtgtatatcttaaaggaaataatgctaggtaatttagtcaggtgcttgatgagcatttgtcatcatcatacggagtcaatttgtctttttctataaaagttctttttgtaaatgattagttgcttaactgctttaatttcttctaggtaccttacctgtcatcaggatctttttaccacaaataagaaaccttaaagcataaaacttggttcagtcttcacatttcttaaatggaaggagaaagggaataatagggagatatctttatctcaaagccaactgttgttgacttttccagtggcaggggtatgatgctaggacttcagatttcctgattccccatcctagtgccccttttgccaaactaggcaggctttcacagcttttggagcctaatttaagtttttcttgttaagaacagaaaactccattcatagattttaatttgtcattatttgcttatttactgaaaaaaaaa

SEQ ID NO: 98545 - DNA, 404 bp, Homo sapiens
caaaatgcccagcgtcttaatatgagtaggtagcagagctcaaatttaaatctggggatcctgcttcctgaattcatgctcttaacctccatgtgatggagagatctacacaaatcagaggtagaaatatttcccaaggaggtgacatctcagctagttttgagagaggagatgatgagaagccatgtgccacacagacatgggagagaagatcaattaaaagcagatgcaggccaggcacggtggctcatgcctgtaatcccagcactttgggaggccgaggcaggtggattacctgaggtcaaaagtttgagaccagcctggccaacatggggaaatcctgcctctactaaaaatacaaaaattggctgggcatggtggctgcatgcctgtaatcccagcta

SEQ ID NO: 98546 - DNA, 2865 bp, Homo sapiens
  misc_feature (1369)..(1369): n is a, c, g, or t
  misc_feature (1374)..(1374): n is a, c, g, or t
  misc_feature (1438)..(1438): n is a, c, g, or t
  misc_feature (1442)..(1442): n is a, c, g, or t
  misc_feature (1450)..(1450): n is a, c, g, or t
gagaaagaataggtcagaagcaatagtaaaagacataataacttgagaatcttccaaaactaatacagacttgcatatttgagaatcactgtagctctaagcagaatcaataccaaaaaacaaaaataaagggaaaagagaggaaaaattgccaaaacaaagaaaatcttaaaatcagccaaaggaggaaaaagatacattaccttcaaaggagcggcagtaaagacggacagtctactttgcaaagaaatggaaatcaaaatacagtggaacgatatcttcaaagtgttgtaagaaaataactgccaacctagaaatctgtatgaagcaaaaatatctttcaaaaatgaagtgagaatatagacatcttcagacagacaaaattagaattcatcaccagcagatctacactagaggtactataaagaaagttcttcaggtaaaaggaaaattatcccagctggaagcatggagatgcaggaaggagtaaagagcactggaaaggatagatagacgaatacatctaaaataatgtgaactgtgtaaaacagtaaaaatattgataggtgcagcaaaccaccatggcacacgtttacctgtgtaacctgcacatcctgcgcatgtacctggaacttaaaaatttttaaagtaaaaataataaatggcaacagcaacacagaaagctggaagagagttctgatgggggaaaaacacaggttatttttcctcggctctcactctacaacagtgatcatcacagaggacttctttgaccaaatgtgtggatttctccccacgtgccaagcaagcagtcagttctgcagtggacaccagctgggtcggtctcaacacagaagacttctgtgagcaaatgtgtgagggtttcttctcacacatcaaacaagcaaggagttctgctgtggatatcaggtgggtaccctccaattccatttcaacattatctacctggagataactcagatctcacaggttgaagactcagtctccaggactgtccctccttgagacaccagttgcaagtctgggcctccagaacttctgacccactagcttcaagttgggattcccaccacccctctttgggttcagttaatttgctagagtggctcacagaactcagggaaataattacgtttaccaggttattacaaaggatattatgaaggaaacagatgaagaaatgcctagaacaaggtatggggggtgggtgcttccatgccctctctgttgcaccgccctcctggcatctccatttgctcgggcatttggaagctctccaaacccaatccttttgggtttgttttgttttgttatgttttttggttttttggttttggaggcagtctcnctctnttgtccaggctggagtgcagtggtgcagttacggctcactgcagcctcaacctcctggactcangccntcctcccncctcagcctcctgagtagctgggactccaggcacgtaccatcatgctaggctaattttttaaaaaaaattttgtagaggtgggggtcccactgtgttggccaaactagtcccaccttggcctcccaaagtgctgggagccactgctcctagccccttttgggtttttatgagaacttcattatgaaggcatcattgattaagccattggccattggtgatcaacttaaccttcagcccctctaccctccctggagattggagggtagggctgaaagtcctaaccttctaatcctgccttggtgtttatggagaccagcccccatcctgaagctaacaagaggctgccagctatcagtcaactcattagcatacaaaaagacattactttggagtttggaaggattttaggaattatatgccaggaagcaggatcgaagaccaaatatatatttcacaatattacaaagataaatatagtttaaatgtcctcaggtctttgtaatttatattagattttaatgagtcagagatagtaatatctagggtagtccttctcaatcacatttggtgagagaatcacatcataatgttcaaagacagcaaacttcaacctgtgggtcaaatctggcctgccacctattttagtaaataatgttttattggtggaacaccgctatgcccgttagtttacatattgtctatggctggattcatgctgcaccgccagaattgagtagctgctacagagacattgtggtccacaaagcttacatttattgtctagcccttgatagaagagatttgacaacccctaggtattgtggactgagtgtgtgtgttccccaaagatttgtatgttgaaattctaacctccagcgtgatggtgttaggaggtggggcctttgggaggtatttagttcgtgaaggtggaaccctcacaaatgggattagagacacagagttcttgcttctttctgtctactctctgccatatggggacacagcaagaagaatgccatctgcaagccaggaagagggtcttcaccagaacttgaccatgatggaaccctggtcttggagggtctatagaacccagcctctagaactatgagaaatgtttgttgtgtgagccacccggtctatggtatttttgttagtagcagccagaactaagacatctgtgctaaggcatctattatatattatgaattaacttctttacatttagaatgccttgtaagaactgaaaaaaaaaatagtcactcagaatgttttctgcaggacataattctttcatagaacttgagttgattaactctagagtaatcactaaaaggatagaaagagaatttatagctaccaagctaatagagaaggagaaaggaaataaaataataaaaaccatttactgtcc

SEQ ID NO: 98547 - DNA, 602 bp, Homo sapiens
ccttctaatactctggcatcacagaaatgtgtgaggcacagaattcggaacatgcttagaactcacatttactgagctggtaaaattctaccttgaactgtagatcaaacctcaaagcagctttcacttggaatttaaaaataaacagttcaaagatactctagattatcaccctataaacttctactccagttatggtttctgacatatgattagactgtttcaaatgctggcaaaatggttaatgaagtaagagaaacagatcaacaacatatgttcaccttaaaccatctgttcatgatttcacccgtgactaactggttatgagataggacttaattaggttatttctgtgggttcaacaagggccataaactcagatcctacagggggccaggcagatgacttacctaaatgaagtggaacacgtggggaccctagtgcactgagcacagcttgcccttccaaaggagccagctgctcctcagtggctgctgctggtgctagggaggacccaatcttgctaaatgtgctgatatttcaagagaagtcagaaagctgggactttgtaacataagctcatattttaatatgttggcaac

SEQ ID NO: 98548 - DNA, 749 bp, Homo sapiens
atctgatgctgtccctcagtcactgcagtccctttcaagtatcaccttttttcctctgtagcagttatcaccatttggaataatttttgtttatttgctcattgtctccatcctcccactaaaatataagctctgtgatgacaaggtcctgtctctcttgctcacagctatgtgctcagtgtccccaagaggtgtttgccacgttgtaggtgctgggttagtttgtgttgtatgaagcagtgagcttaaacaaagggtttgaattaccttccctaagtagggctgtccttggtgcttggtctacaatgtcattggagataacccatcagcgagaataaaggaatacttcccagtgttagagcagcctcagagcagaaccagcccagatatgtgaggctggacatgggatctttgaacccgtggcaatgctggtgctgagtttccaccccataagaaaatctaccaacccaaggcgggaaggctgggagcaacagtatgatattctttactattttcctagggttgattctatggccatgacacatctttgagtccatatgacttttaggaggggtgtgctgaaaggttagtgacagcactcagccttctttgatgaccctgaatggaagatcccatcctattggcctgactatcttgctcccgggcaaagagagggtccatgtttgtgttcacgtctgtcaccaaacgggacccaggctggagcttcagcacctcactccaggtgaggg

SEQ ID NO: 98549 - DNA, 522 bp, Homo sapiens
agcggctgaaaagaaccactacacagtatttcccaaagtctggaccacctaaatcagaatcagctggcacgcttgtgcaaatgaaaattcctgcctccaccctggtcttactgaacaccgtggcaggcaccatgcccagaaatctgccttttaaacaagctccctgagtgacttttacacactctcaagtttgagaaccagtgctctcctttatgcggaaactaagaaaaacttttccagttacatttggggattgcagcggcagcttttgaattcctatataagaaagatttagggcccacaaacgggtgggattatgggatttgtatggaagccgaatctgcatagcacgcatcctgtttttcctaagattaggtgaagtctggacttcaactgggtgcctcaggaacgcggctagcagatggagattatcagggggatctaaatcccggataacccgctcgcgccgccaccaccagctggatggcttgagggaccccctccaagtatggcccactgcag

SEQ ID NO: 98550 - DNA, 565 bp, Homo sapiens
ggtctcactatattccccaggctggtgctggtctggtactcctgggcacaagcaattcctgcctcagcctcccaaagtgttgggattacaggcatgagccaccgtgccccgccccgataggtgttcttttaatacttcttctgaacttttcaacttccttcattaatttatgttaattaccagcactgattccctgcatcatcgaggagttattagtggtgtatttggcactagttttagaagtagatgccgctatgttttattcatttacagagtgatggcagctcatagttagtcctacaagtgcattattactgatttgtgaattcgtttatttttcctgaaacaattcaagtctttagaaagagaatccgaattattttgtagaataccatctcctgccatatcccttgggtctgatgaaacagatttgacaagaaaacatcagttggtgtttaggcatttttctctcttttattaattaccatcttgaaggatagtagccgaagcgaaagatcccataaacaagatcgcgctccgatatccatcaaagatgatattattg

SEQ ID NO: 98551 - DNA, 359 bp, Homo sapiens
tctccatgtgtttccaatatcatctatggcttgtggtcaagatgaagtaactaacgagatttaatctcctgcttgaaacaactaaaaaaaaaaaaagacactatagatgagaatgattttcaaggcattggacattaggtaatttttttttttttttgtatttttagtagagacggggtttcactgtgttagccaggatggtctcgatctcctgacctcgtgatctgcctgcctcagcctcccaaagtgctgggattacaggcgtgagccaccgcgtctggctaggagtctccttttagagaactggtccctgagagatgagactctaagtgagccctatgtttgccctagagtactgc

SEQ ID NO: 98552 - DNA, 357 bp, Homo sapiens
ggcatgggagacagtggagagtatttggattccagcctccttccttcctcagtgacaccctgagctctgcatttgtagagggtcctcctggtcaccagctacctgtccctgtgtcccttagcctgctattcttggcaacctcaacagttgctgccaggtggggagattatgtagcttaccaatagcagaaactgagcagtggctcactctacttcctcattctttcctgcggtcagcatcaaatcacatcttctgagcacctactgtgtaccatgttcttctaggcagtgggataggaaagtgattaagacatagtttcagggccgggagcggtggttcacgcctgtaatcccagca

SEQ ID NO: 98553 - DNA, 726 bp, Homo sapiens
ggcaatgtggtaaaacctcgcctctacaaaaaatacaaataaaagtatccagatgtggtggtgtgtgcctgtagtcccagctacttgggaggctgaggtaggaggattgcttgtgcctggggaggttcaggctgcagtgagtcgtgatcacgtcactgcactccagccctgagcaacagagtgagaccttgtctctaaataaataaataaataacataacataactacgtattctttgcatagctattcaaatgcaaaaaaaaaaagtagaaaggataattgtggactattcattgaaatactatatagcagtaacattgaatgaacagtgaacaactacatggaacaacttggttggaatttcacaaacacaatgttgcaaggaaagaagccagacacaaaaacattatgtatctctattattttatttatatcatgtaaaaacaggtgagttcttgtatttagtagactgggtaatagctaccctgagtggttggaatgggacacagtagaggctcctggaatgctgatactgattcgtttcttgatttggttgctggttacatagatgtgtttacctcagtattttgagctgtgcgcttagatctgtgccctcttttgtatgtatgtttattatacttcaatagaaagagaaaactgtatgaaagattaaatatcatgcagccattaagggtcctattttcaaagattatataatgatttagg

SEQ ID NO: 98554 - DNA, 879 bp, Homo sapiens
aaaatatttttttcccctattgaattttaaaagtacatgctatattttattttctttttttggttctttaaagggcaatacgttgagcagttacagtagaaaaattcattgttcatgcacatataagaaaccactagtagaactttgtaaatgaatcagttgcctcctttggtattcattctttgtttttttggacatggagtcttgctccatcgcccaggctgtagtcccagctacttgggaggctgaggtaggaggattgcttgtgcctggggaggttcaggctgcagtgagtcgtgatcacgtcactgcactccagccctgagcaacagagtgagaccttgtctctaaataaataaataaataacataacataactacgtattctttgcatagctattcaaatgcaaaaaaaaaaagtagaaaggataattgtggactattcattgaaatactatatagcagtaacattgaatgaacagtgaacaactacatggaacaacttggttggaatttcacaaacacaatgttgcaaggaaagaagccagacacaaaaacattatgtatctctattattttatttatatcatgtaaaaacaggtgagttcttgtatttagtagactgggtaatagctaccctgagtggttggaatgggacacagtagaggctcctggaatgctgatactgattcgtttcttgatttggttgctggttacatagatgtgtttacctcagtattttgagctgtgcgcttagatctgtgccctcttttgtatgtatgtttattatacttcaatagaaagagaaaactgtatgaaagattaaatatcatgcagccattaagggtcctattttcaaagattatataatgatttagg

SEQ ID NO: 98555 - DNA, 870 bp, Homo sapiens
gaaacacagccgttcactgaagaggatttgagtgttgtctcctctgtggggtcaaaacatcatgcttctttctgttctgccccatggcagtggtgacgatggcctagcttccatcccgtagcttcttgtgtttttctattccaccagtctatcaaccctgtatttgttgtcaaatttacactgtccacaggcaaagatctattctcctttagaatttaataggagggtttggaaatgatgccatggaaaccctgagcagcttggcaatgctgaccccaaatgagaaataactatcattggtgttttccttctactactattatcttgcccattgatcttcaaaaatttcattggtcaaattgattgaggaacgcaagacttaaatgtaatatggctctggcaaattctgagatgctaacaaaaacaagttttcttaagaacaatgtcaactgactcacagtatccgactatataaagtcgagtgctctcatgccaggaagctgatacagttcatgaaacctcagtcattctttcgtattactcctgtcttctctttggaaaacaatctcatgaatttggtcttgacgctgacttaacatcccaggaaacagatactcaattccactgtcttttttgagaaatgaacagttctcaaactttgtttaaatttccttttcacagatgagtaataaccaaagatatttctgaaagggctctgaaaacatgcaggcaattgatctttaaaaataagatagaaatagtaggttttataaaagaaggaaatagaaatacttcagaagaaataaagtgtgctgaatcatgttttaaacataattatatccggaatgcacttacccatttgaaaaaaaa

SEQ ID NO: 98556 - DNA, 312 bp, Homo sapiens
acagagtttcacaatgttacccaagctggagaaccgtggcaccatctcagctcactacaacctctgcctcccgggttaaagcaagttttgtgcgtcagcctactctggtagctgggactacagacatgtgccaccatgcctggctaatttttgtatatttagtggacacagggtttcactattgtagctttacaggacaaatataatctgacaatttccaaattcctatgtccagacacaaactacaaagcctatattttcaactgcctacttgacattttcatttggatgtctaatagaaatctcaaactc

SEQ ID NO: 98557 - DNA, 691 bp, Homo sapiens
aagggtttcatgaccaagaacctaaaagcgaaaaaacgataaaaacaaagataaatagctcggacttaaattaaagagctttttgcatggcaaaagcaacagtgagcagagtaaacagacaacccacagagtgggagaaaatcttcccaatctactcatctgacaaagaatagtatccagaatctacaatgaatgcaaacaaattagcaagaaaaaaaaaatctcatcaaaaagtgggctaaggacgtgaatagacaaatctcaaaagaagatatacaaatggccaacaaacatatgaaaaaatgttcatcatcactaatgatcagggaaatgcaaatcgaaacgacaatgcaatagcaccttactcctgcaagaatggccataatcaaaaaatcaaaaaataatagatgttggcatggatgtggtgaacagggaacccttctacacagctggtgggaatgttaactagtacaaccactgtggaaaacagtgtggagagtccttaaagaactaaaagtagaactaccatttcatctagcaatcccgctactgggtgtctacccagaggaaaaaaagtcattatatgaaaaagatacttcacatgcatgtttgtagcagcacagttctcaattgcaaaaatgtggaaccaacccaaatgtccatcaatcaatgagtggataaagaaactgtg

SEQ ID NO: 98558 - DNA, 779 bp, Homo sapiens
agcccagaaatagaaatagggtgaaataatccaagagtggaagctgagataccagcttggaaattattgcagttattcagggaacctaaatttgaggtcaaggatcaaaacgagccttctctctgtcaagagatttctacttagacttatgtcttctgcaatgtcttctgcaaatgatttactgaaggcttatggtatgctcagtgacctgtatcgttctcagacgaaaaacacgtatatgatctaaaatgcaaagtcatcttcaattatggttaaatatcatcatcacctctactaaccatttataaaccttataaactctttttgcactaacaatttcttttgtagccccaaagagccctcttagaaagaacttgagcccacagaaaggatataatttacttaagatcatagtaagaattagggtctttcaaaaccagggaagccacctggtcctttgaggaaatctaggcaaggtgggcttttaaaaaataatatccaacataaagcagagtctggcaataggaggtactaagtaaatatctgttgaataaatagatttcagagtaactcaaaattcattctgagtccacatgtgattatagaagaaaacaaaggaacgaccaagaaatcaactgacaggactgctggctcagagccactgctagggtccaataagacagtagaagagaccccttctcccactccatatcatcacatttgttatttgttctcaccttgacactggctttctgacagaataatttttcccagtgtgt

SEQ ID NO: 98559 - DNA, 378 bp, Homo sapiens
aagggtgatgcggttggagaggagacgtttgctgctcagtgtttagacctcaagcactgtgtagcccatgacccagcaatacggctctgggctctcaaccccagagaaattctgttgtactaccaaaaagacaaagggaagaaggacagaagaacaattagatctttccaatcatttggataaactgtctcccacagttggatatttcaattatttttcatttttcactaatataagcactgtgaacacccttatacacctagcaccccctttgtgccagccacactattctaagcacttcatgtgtgtgttaacttgatcctcacagcaactctgggaggtgagcacaattattatctctattttatgctaagaaaa

SEQ ID NO: 98560 - DNA, 661 bp, Homo sapiens
aatttggctgggacaaaagttagtggtggaagccatagacaaaacaacactgctgaggaaagaggtcttggagaaacagggaaagaaaggcctgtaactgaagtgtaagtaagagtagaatcatagtccagaattctgtgccagttttggaaaagatgcttattagatttctcttatgaactgttaagaaaagagataagacaatcagcatcatgtgctttggggaaaaggagtatttcaggacagatcctgggactagggacaggccagaagaagggcagaaactgagagacccaaggagataatgaaaatgctctctggatgctccagagatggtgaaagatggtctctggagcaagtggcttgcaacacaaaacattcttgcagctccaagagcagcctgagcaggctaggcttagacagtagtctgtctttgggaggagctcaaaaaattcaaaatggaatgcaagagctgccctaagaaccagttttcctttctcctaggccactgacctaattcagccgataaggactcaatcagcacttccctaccaggccacatgagctgacccaaatacatcctttaggagaaactatcaaggatcccatcaaaaggcaacacggacacttccgataaccagagaccctgttggaactgtca

SEQ ID NO: 98561 - DNA, 150 bp, Homo sapiens
aatttggctgggacaaaagttagtggtggaagccatagacaaaacaacactgctgaggaaagaggtcttggagaaacagggaaagaaaggcctgtaactgaagtgtaagtaagagtagaatcatagcactcgaccaggcccgaggtgcgt

SEQ ID NO: 98562 - DNA, 235 bp, Homo sapiens
tcttcagacagcagatgaaactgccagaaaccatggaaagtggaatcgcggataagagaggactactgtccaagccaaggaacacagggcttgcaggcaacccccggagctggaggaggcaccagatgcatccttcctcacagcctccagaagggaccaacccagccaacacctcgattttggatttctggactcccaagctataacagaataaatttctcttgctttaagccac

SEQ ID NO: 98563 - DNA, 234 bp, Homo sapiens
cctcccagatcacttccgctgtggtgtaaatcctggtcaagcttcctgatgataaaagaccacagggagacagagacccaggccccagctgacctgtcaggtgagtgacccaggctaacacagaatcatgagaaatcataaatcacagttatctaaaaccattaggttttggggtggtgtattacatataaccactcaaagacagcatttccattttaagtctttcctagggac

SEQ ID NO: 98564 - DNA, 153 bp, Homo sapiens
tctcatgtgcaaagaagtcatgtgagcacatggcacagtgggacggcagacactaggagtatgagaagaggcctccgaatgaaaccttcctgtctggcaccttgatctcagacttcccagtctgccgtcccactgtgccatgtgctcacatga

SEQ ID NO: 98565 - DNA, 254 bp, Homo sapiens
tgggcagtggcaccaagtctccagtcagctgtgcattttcaacttaatgacattttcaatttatgatgggtatatcaggacataaccccatcgtaagtcaagaagcacctggaattattagtctcaaaactagattccacctatatgaggtactcagagtagtcaaaatcgtagcatcagaaagtaaaatggtgactgccaggggctgagggagaagggattaggaagttactttttaatgcgtagtgtttcca

SEQ ID NO: 98566 - DNA, 253 bp, Homo sapiens
ctttatgaggctcagctacaccatctgaccagcacaggacaacttctgcagcacaaacacctcaggtggggcgaggcggctgccgaacccagggagccatatgtttgttgtttgctccactctggtgccctgtgctcctcagcccagccgggcactgcatcctggctgcatctcactcttctggtttctgcagttcctgccccccacacaccacgggctcagtgccttcagagaacgtaaaccacatcacagt

SEQ ID NO: 98567 - DNA, 907 bp, Homo sapiens
atcccggagggcgggcccagtgcggggcgggcggcgccgggggctcttcaggctcagggcataggcaggcggcggccgcgttttctggagacggtcgctctcggagggaccctgcaattgcccgagaccgagagtgggcgctgcctgaaagtttgtccctgggcgcttcgctggcctcatccggtctcggccttgttctgggcctggcgcctttcccattgttggggaaagtggtctaggagaccaaggcagcgtgctgggtgggagagaatgatttgtggcttctgattctgacatatgtcgttaaggaggggagggatgagtgaccctgttttacttatggagaacctggggccagagctgttttcccagggtgacacaggcggtgagtagtggagctggcattcctgaccccaaagctcagcgtttcccagccactctccgcagccaggccttcacctgcactgctgggcgcaggtggggaagtggggaaacggtgctccatcccctgcagagggcaggcgtgcggggagcggtggctgaactccacagacagctactgctcagctcttcagctgccggctttgaagagtgtgaggggctctgggcaagaggcccccacattactcaaggaccagatcatcaagagctttacttgtcccacaaaggagtctggacctcgtttaagtgcacaggagaccgctggaaggtcctcagtggcgtgccatggcccgacttctatttgagaagtttttctctggccacccgtctaaggaaaggtatctgggtgggtggtgcgggtgagaacaatggtggtgcggtgcttggcggagaaggtgagtgtccagagatgttcaggaagaagaactgacagctctggatgacaggaggtggaagtgagaaggaa

SEQ ID NO: 98568 - DNA, 405 bp, Homo sapiens
aacgggtgatgcggttgagggtggggggtgggggtgggggtttgcggtggatctagttggaggcagccaaggagggactctcaggtatccacaggggaggggcaaccaggagctgcccttgaggtcaggacaagagggtggtgggcagcggtgggcggcagctgtgggccacgacctagagcagcagccacgtcccaggagactgaggccctcaaggcacaaagcctcgtggggggtcctggctggggcccaagccactctgcttgggtaggacgctctgggccaaggggcagagtggctgctgtgggcctgggacacgcagacagtagaggcctggccgttctctgggctctgcaggcggccaaccccctaactcagctctatccgcaacccccataccctgtt

SEQ ID NO: 98569 - DNA, 380 bp, Homo sapiens
ggataatgtgggtcacttttatgaagtaggtaaaactggcaaaattggcaatgtatcaaatgtcaaggacatcaggagagaaaaagtcaagctcacctcccaggtttttggttagggtgacagtgagaataaggatgacaatgctgccaactgagatacagaaataaatctactgaaaatgcaaaccagttagtcaaacaatcattttctggaggaaaaatacattctctggtaagaaaaaaaatttgtttctatattttacctaagacacaaaacaggattcagtacaggtattaaaaattactggaaaattgtcataacatgcagtatctttaaagggaacaaatggaatccaaggtgtattacacaaaattgaacta

SEQ ID NO: 98570 - DNA, 264 bp, Homo sapiens
ctcctaaatggtctcagttaacagactgtagtgatgaaactggctgtgggctttgcatgaaaggcactgacgtggtccaggaaaagactcacaggccatgtccaaagcttgcctgctgaaacacacacacacacaaacacacacacacagtaagaggaagtaggcaaagaggaaaaactgtgttatctgcacatggaggaaactgcatgcttaaaatacaagtagccaaaactaaataatacttaacgaccattaaaatatgta

SEQ ID NO: 98571 - DNA, 347 bp, Homo sapiens
ggaaattaggtataaacttaatttttgcaaagaaagtcacataataaaacattaggagactcatttacttaaagggagtcttggctgggagcggtggctcacgccagtaatcccagcactttggggggcccaggtgggcggatcacgaggtcaggagatcaagaccatcctggctaacacgatgaaaccccgtctctactaaaagtacaaaaaaattagccgggcgtagtggcgggcgcctgtagtcccagctactcgggaggctgaggcaggagaatggcgtgaacccaggagacggagctagcagtgagccgagatcgtgccactgcactccaggctgggtgaca

SEQ ID NO: 98572 - DNA, 503 bp, Homo sapiens
agaaagcgaatgtacagtttttcacgtggagaaaagcactgcagaggaagatactagcagggcaagggatctgagtgcagtcagacctcatttgggtccagacttcattcctctatgtctctttcctttctacagaaagactgttagagaaaatggtagcattggtttcctgttgggagggaaagtgggtggtcatggtaagtgggtagagaaagacttcacagtatactgtttttgtacattttgagtttttttaaaagcgagacttgagctattctagctctgataatatggtgcagtatttgttatgttagttgtagtctttctgggcagtttttacatccccatgagccgttaaaaaaatacctgaacctttaattaggggaaataaattggaaaaatacatttcccttcacttaacattatcttagtttctctttttttttttttttttttttgagatggagtcttgctctgttacccaggctggagtgcagtggtgg

SEQ ID NO: 98573 - DNA, 207 bp, Homo sapiens
gcaaaaagctcacccaaaataatgtagatggtaaaaaaaaattacatgaaaagatgttcaacatcatttactcattaaggaaatacaaattaaaaccacagtagattcaaataccaattagaatggaccaaactttaaaaaatactgatagtggggcatggtgtcacatgcctataatcctgctacttgggcacctgaagtaggagg

SEQ ID NO: 98574 - DNA, 416 bp, Homo sapiens
cttcactgagggtcaaatggaaagaacacatgggggtcaagtttcagaaaataagagaaatgaagaaatatgtgcccggaagcaagaacgaccgacctcattaaactggctcccttcacctcctctcacatctttttctgccttttggccaagttttctctcccccgcatttcctccttgatctcgtttgaatcctcttccctggtgaagtcatttaggttcaggctcttattttactttggtccataatttagatcgaaccacatgtgctgatgtgattgaaacgatgtggaattctctggacagagatagaattatggaggggttagtgtgtgtgtttaagattaaaagaccaggtgtatgggaggaaatataatgaacaaaaaatagtattttaaatgaatactaaacttgca

SEQ ID NO: 98575 - DNA, 282 bp, Homo sapiens
aaaggtgttgctagggagatacagctctacagaataccgcagaaaacctgcagggaacgagtgggtgttggcagctttaaagaggaaagaaaagcaggctgggtgcacaggaaaggagagctctcacaccagtctggcctaatataacccaagaagtgcctggtgtttcccctgggccttccagtcaaccaccaggtcctttttattctccctttaatgtaccacaaaggtctcaccactgctctgtatctcacgctactttgactccaccaggcaccctga

SEQ ID NO: 98576 - DNA, 503 bp, Homo sapiens
actacctgccccttcccctactgtggataaatgtcaacacatgttttgtgcaagttatactttcaccatcaactttttaaacaggttttgaaataggtcaaatttctgataaccagttcagcaatttaagaatgtacattttcagttactgcaccagcagtgtttattgaaaaacagaaagaaaacccaaaaatataaaatacgtaaacattgtagaatggcatcatataacaaatgacaaaacctttgtggctaactactctttatatgttctgcaacaggagtgcccagcctcccttccctgtacatattttacactcaagactggaaggagttagctgttcctggttgctagtgtctaagcacggtgtgctgtaatcactgagcaccctgggcaatgtctttccaagtgagctattggttaaattgtgtgtgaaaggggcaggaaagaaaatatgggtatggaaaatcatctcttagatttcagcatgtattcaagtcag

SEQ ID NO: 98577 - DNA, 276 bp, Homo sapiens
ccctaaaggaatcgttgttgagaaagtgcgtaggagggaggaaccagaaaagtggcctcttcccccaatagtggattattcacagactgatttgccctgaatttgttccccgtcagcactaccaaaaggagacagagtcggcacctggctctcctcgtgctttcaccccagtgccagggacaaggaagatgactagttacggagggtgagggttgttttttgccaaaaagcctgggtagagtgatctgaattatctggcaccctcctgaatggaac

SEQ ID NO: 98578 - DNA, 762 bp, Homo sapiens
agcggctagtctagccctagacagggacttcagttttcctaggtgtctcctagcttttagagagtgccagctactcaccttgtggttatacaagatttgtatagtttttaatgacaacatttcaggaagaagcaataaaacatcttgaagacagaactgtctttttaaaatttgctcagaattaccataccagtaattccagcagttgagcaaaggacagtaccagcaaaggagagtataaaggggaaaggaacagagaagaagcaagacctataaaattatgcttataaaaattagactaataggccgggtgcggtgggtcacgcctgtaatcccagcaccttgggaggccgaggcaggcagatcacgaggtcaggagttccaggccagcctggccaacatagtgaaactctgtctctactaaaaataaaaaaaattggccaggcatggtggcaggcgcctgtaatccctgatacttgggatgctgaggcaggagaattgcttgaacccaggaggcagaagttgcagttagccgagattgtgccattggctccagcctaagtgacagagtgagactccgtctaaaaaaaaaaaaaaaaaaaaaatagactaattttattatgggacatgtgccacaacatacattctaactatagatcttctttctcaattttatattacatcatgggttatcccattagaataatgctggctacagtaataaataaccccaacatttcagtggcttaacatggaaggaat

SEQ ID NO: 98579 - DNA, 534 bp, Homo sapiens
agtgccatcaagtaatttccatataccccaatccaacattgcttgtgttaagtcctcatttcagtctctcaccagtatttcccccttgtctgtttctttgattttttttcttttttcaatgtgtaactcacagtcactgcaacacacaaaccctacgtgtagagtgtgatgaattttacgtatatttgcccctgtggaactacttgtgcagcgattggtgtggttggatgggtgctccctcctcctcctcctcatccccactctcattttcctcctgtgtcactggctggtccttcagcttctgctcagctttcagatagtggagtgtctcagggatgagttctaggaccccttctgtgttttctccgtcactcctaggggcgcttatatgatctcatggctttaaatgctatctacatgtgacagctctcaggtttgttctctacctctgacctcttctttccacttcagactcatattttcagctccctagttggcatttctacgtggaagtcaaataggcatctcaaaccc

SEQ ID NO: 98580 - DNA, 375 bp, Homo sapiens
tgagatcatgccactgcactccagactaggtgacagagtgagactgtttcaaaaaacaaacaaaaaaactgagttcaaggatattaaatcataaacataaaaaaactcaaaagtaccagcaaattttaggtgaatatctttagaatcttggagagcaaagactttcaaagcatgaccccaaaggctaaaaacagaaaagactaatgacctggcaacaatgacattaaaagcttcattatggcaaaactgaactataaacaaagttaaatatggaattatgggcactattgtcaactataccctttgtacaagctttcttgagggcagttttacaacagtaatcaaaatttatactttggccaagaaattccaaaa

SEQ ID NO: 98581 - DNA, 115 bp, Homo sapiens
gctatggtctttcagttaaccagtgggtcacctgggagcaaagcccttttgtgataaagttggctgatttgtgttttttttttttttttttaattttcgtaaacgttgcaaaacc

SEQ ID NO: 98582 - DNA, 515 bp, Homo sapiens
ttataagtaaaaatggaaaaagcagtttaaaataaatataataaatgtaagtgtaatgtgttttatatgtgcttcattatcatgtattgcatggcacgtatatagtattcaccagagtattatatattaatgtcaccataagttacacatatttatgttaaagtttattttttagagtacttctgatgttacattattttgtagacattttgaaaaataaaaaagccaaagaaaatgttaaaaaattactaacacttccatcccgcagaagcatttttacatatcagtgttaaatatttttctaagtatacagaacaatagaaagcagtcttaattagtataaagttaattatctgacataagtatctaatcctctgctcatcaaaagactattaagaaaatgaaaagacaatccacaaaatgggtaaaaaacattcacagcacaaacatcagacaagattttaataaccaatatatgactatcatctacaaatcaacaataaaataacccatgt

SEQ ID NO: 98583 - DNA, 232 bp, Homo sapiens
tgagcaaaagtttttttcttttcagttgacagaattctgttttcttcatttacttctactatctctcctttctcttgcaccctctgctgcatggaggacctaaaatagtttataatagcctggggttccttaaagaaaatggagaaggcaccagactccctttccagggaaaacaaattttttcaagaatgtaaacagacaagtttgtctcagttctcgaacagcttacttt

SEQ ID NO: 98584 - DNA, 283 bp, Homo sapiens
gcggccgcctactactactaaattcgcggccgcgtcgacggctgtctcttattttttaatttgtagtgatacttcataaatttggacagtaattcttggtcagttattaaatttccaagtatctttatccaatttgggcttatttttctttccttatgactttggggtagacaaggatttcataagaagcacaaagcatagatctgaaacaaaaaggttgataaattggactaccttgaacctaagaacttccgttcaacaaatgacaccataaggaaagaaa

SEQ ID NO: 98585 - DNA, 859 bp, Homo sapiens
tagaaaggttcatacacaatgtatcatgtaacatccccagtgggggctggggcagcaatctgtattaaacacaataattttgcagcaagtcacatgacacatgattatttctactaagagattactagattataaacagcctcacatcagtctgttgggttagactgtgctgccaaattatcaaataattttgtattttcagagtgttaggacttcagaattacagataggggatcgtagatctatagtattcctatttgaatggctaaatggatttttcctaaggtcctagcatgtattatgaccaggaaaattgtaacatttaacacgagagcatttctaaataccattttcaacatcagtacgtgcctgactcggagaacaatgaaagagccgtccttcatgcccagggccagctgagatccgtcggggctgaaagctacactgcgaaccgcctcttccatgttacagcgggcgatcaaggcatgatcagccaggctccacagcctaggcacaagaacgaagtcaaaacaaaacaaaaccaacttcccatggtcatcggccagcccaaggcaagaagggctgctcaccacaccaacagtaacaagaaaagacataggaacttcacaccagagccctttatcatggcctgtcagcgagtgtggaaaggtgttttagtgcatctttgggtcattttcatgatttgaaggaaaccagcaagaattatcaaatgaggtaacatttccaaagattttgagattcacagaacaaaaaaaaaatttaaggctgggcatgatggctcaacgcctgtcatcccagcactttgggaggccatggcaggaggaacacttgagcccag

SEQ ID NO: 98586 - DNA, 340 bp, Homo sapiens
agttttggagtgtgaggtcaaaggcgttttgagcaacttgtaagaaaccatttttaaggcggaagtcgggaattttgttttttatatgttgaatttgaaatccttattaaacatccaagtggagaggctggatagacaattaaatttagaccctgaggttcgggaaggaagtccaatgggctagagatataaatttgagagttgtcaacctaaaataataaaaaaggtaagaatctagtttaaaggaagtttattcaagcataaaggttgaagatggctacctgggagcatagattcaagttaccctaaatatacactctgattagcagcggttatgagt

SEQ ID NO: 98587 - DNA, 337 bp, Homo sapiens
tgtgtgctctcctctgccgatggcctttccctagcctgtgtcctcaaattcacgctcccttctgaggtaacgtgacgcctccccaccaccccacggtctggcagtgtaaacagttttcacccttgctcatttgaagagcgtaggagccttctctctcttctgaaaccccaaacatttgtttctatctttcttgaagcgtgaggagatgctgcttcacattcccgtgtcttccatgagactgagctcccggagggcaagcgctcgcccctgctcacatcttaccccccccagcactggccgacacagggcctccctcaacgtggatgcctggagaatg

SEQ ID NO: 98588 - DNA, 330 bp, Homo sapiens
gcatcactaaaattggtgtggagaattatactagagttttcccaaagggccccaccagtgttagggaatggttgttaaacctggtggatccgtgatgtgcatttatctccttttctctcttgaagccccactggaataaccactatgacaaagagaacaggagaagaaacagtcaataaagagatttcataataactttttacaagacagaagggctgggcacagtggctcacaactttaatcccaacatttggaaagccaaggtgagaggatcacttgaggccaggagttcaagaccagactgggcaacatagaccctgtctctacaaa

SEQ ID NO: 98589 - DNA, 429 bp, Homo sapiens
aggctccacaaagatgttgattgacgtgcacaattcggcacagccagtttcttggtcctttgtccttttctatttgaacaagcctttcaaacggatagggctaattttggataagactagagggagccctgggtcttaactgattatgggtgctttagatctggacttggaaatctccaagggcgaacactggggagcgtccgcaggggcagtgggcacagccggtcttcaggtgcggagagggggtcaaagggttccagcgattgctgggcttccacactctggtttcattttaacaagtgaagcaagagccgcttctcactgatagagggaatggaaacaaaagccgctctagtgcccagcaggatggagagggaacccgattctggtattgcttatgtatttatcacatacccagttccacggagc

SEQ ID NO: 98590 - DNA, 780 bp, Homo sapiens
cagaaacccagattcccaccaaatcatctgctggcacatagacctcagataaggagaactgaggacagactgctgttctttgttctaaatttcttcctgaggggcctggaggaagtcgcagccacgagccagagcaaacattttttccccaaatttttagacaaagctttgcctccttaaccaatcgctaagcagaaaatttttgagtccacctatatcccccttctgcttcaagatgtcctgcatctttcggtcaaaccaatgtatagcctccaggtattatcctgtgactttgcctgtaacctctgcctccccacctttaaaactgcttacctgtaagccatcagggagtgcaggcctgaagcatgagctgcctgaatgtccttgcttggtgcccttcaaaaatttcctcattttctctcgctgctagccccatgtcagtgtttggctttgctgtgctgggtgggggactccagttcgcttcaataacgcagggatatttcacttgtaaagcgggttcccgctaactgtggcgtcctaattagggaaaggaagttaggctggcgaaacaaggggaagcaaaaagagaacgcagataagctctaagtctgtctttcttcatggtccaggacacatagccctactgcagaaataactcaccgtcttcctgtgcctatcaccagacatgcgctgaggtgggaaattaaagaaagaaagaaaaagaaaatttaaaaaaaagaaataagttttcctgtattaggctgacttgtcccagaagca

SEQ ID NO: 98591 - DNA, 351 bp, Homo sapiens
aaacactgagcctccagcatttcaggtccagtcaacttcagcagatgtggtgttgggacacgagggtgttcagatgtgtgggggtgtccaagggggaatgattcagagccactgcctcagtttttaaagtaaggattcgtggatagtctttgtccccagtacaaaggcatagcggaaaaccaaagtggaagatggtgtggaggaagaggttcaaaggtgattttgttttttgcatcaggatgatccttgactgtgtctgaggccaaaagtaagtcttgactcccatgaaactccaggaaatggccggcacttgaagagccgtaaagaagcagcccagacctcactctcctg

SEQ ID NO: 98592 - DNA, 522 bp, Homo sapiens
tctatttagggagccttgccaatgggactggtgtgctctcaactgggaagcacttctattcaagaaggcctagagtgcttcccctttcagctctaccctgttgtgagcttggtctcagagtggcctccattcccttcccattcccagtgtctgactggagcacacatgccctgtgatctcttttcctatgactctggggaggtaaggaagggataaagttttttttttttatttaattaaattgataaattaattttttgagatgaggtcttgctctgtcgcccaggctggagtgcagtggtgagatctcggctcattgcaacctccgcctcctgggttcaagcaattctcttgcctcagtctcctgaatagctggaactataggtgtgcgctgccatgcccggctaattttggtattttcagtagagacggggtctcgtcatgttggtcaggctggtctcgaactcctgacttcaggtgatccttccacctcagcctcccaaagtgctaggattacaggtg

SEQ ID NO: 98593 - DNA, 247 bp, Homo sapiens
tgatttgggaactactttcactgaggcaaaaggcagaaaagggtgattgtaaatccaggctggccaagagtaaactgcagttcctcctgctgttggccagagaaaaagctattatgcccctcacaagaggaacaaatggcccacgagtctcttctttggccactctgagggatgctccctctctcactccgtttcctactcctgtactccagacattgctgctcacacacatcctgaagcagctatg

SEQ ID NO: 98594 - DNA, 392 bp, Homo sapiens
gagattgcacatcatgggtgtgcctttgggaactgcagcacatctcagtaaaagggtggtaggatttggggtttggttaggtgatttggggaggatccaaggaagtacgggttcactctggattgggtactgtcaggaagtagggacaagtctttgggtatcagtactattcagggttctccagagggacagaactaatagaacatatgtatatatggaagggagtttaagtccaggcctggtggctcacacctgtaatcccagcactttgtgaggccgaggcgggtggatcacgaggtcaagagatcgagaccagcctggccaacatggtgaaaccccgtctcttctaaaaatacaaaaattagctgggcgtggtggcgtgcatctgtagt

SEQ ID NO: 98595 - DNA, 422 bp, Homo sapiens
gtgtccaggccgtggggagccgagacgcagccccctcccgtcgcccccaggcgcccgccccccactcaccagccagcagcgcgcagggcagcagcagccagtacaggaccgcgccgagcacgtgcggctccatggctggagggcccagggcccggcccagaccgagcggacgccgcggcgctatggggcggtgcgggggccccggggccggcgcgccatggctgacccgcggggacccgcgcgccgccttctcctcttcctccttctccttcggccgccccgccggtgccgacgtcccgggcccgcgctcgctcaggcgaccgccctgcccctcggcggagcgcagcgctcggctcactggggccgagctgggccggacggcggctcccgccctcctccgcccgcgggcctttataagctcg

SEQ ID NO: 98596 - DNA, 424 bp, Homo sapiens
agatcgagaccatcctggctaacatggtgaaaccccgtctctactaaaaatacaaaaaattagccgggcgtggtggcacgcacctgtagccccagctacttgggaggctgagggaggacacttgcttgaacccgggaggcggaggttgcagcaagcggagattgcaccactgcactccaacctgggtgacagagcaagactctgtctcaaaacaaaacaaaacaaaatcggtaggaaaagaatacataattccttgtcttgaacagtggaagacaagaagaagccaataatattggctccttctatacaaaggagctgggtagctagaggatgagtgggagacttccacttgtacctattgaattttgagtagtgtcaattttatacattttttaaaatagacatgtaaagggagtgtgccaga

SEQ ID NO: 98597 - DNA, 264 bp, Homo sapiens
aagctagggatcaaacactgttaggtatcaagtataggcctttcatggaggcctgtaatcaaaatacttggaatggggcaaattgttacattaaccagaaatggaaatactattcctatcaatcatatacaatgtgcctgaaaatactgctttcttttctttattttttagacagagtttcgttcttgttgcccaggctggaatgcaatggcgcaatctcggctcactgcaacctccacctcccaggtttaagcaattctccgg

SEQ ID NO: 98598 - DNA, 193 bp, Homo sapiens
cctcccatacattctacacgtcaggtctgtccattcatctctcttacctgctcaaagttctccaatgacttacaattacacttagaataatatctaagctcctcaccatgcttagaaggtcctacaaggtgtggcttccacatgcctctcaggcttctccttgtaccagtctccactttggtccagccacact

SEQ ID NO: 98599 - DNA, 648 bp, Homo sapiens
caggtatctttaggtcaatgaagagtaaatataaaaacattttcttgaacaatatgctagcagcagtgaacagaggtgtgggtgtggaagattttcaagaggagtttagcatgaaagatgacatatatgctgttgccaacacttacaacacaatgactaaaggcacagtgtacatgcctgacacaacctctggcctgccactatgttcagagttgatgatgaacaaagtggtgactttgaagaattccctaagtcaagtgagaaaaaaatgtctctgaccttcttacatatgcaaaaaatatattttcagaggctgttgtaagtaagctggaaaaagtggatattgaagaaatttttaacatgaataataagtctccagttgttcatttatcaaccaatggtgaaatagctgaaatgactctgaatcagtatgatggtgatagtccaggcatggtggcttacacctataaccccagtgctttgggaggccaacgtggaaggtcacttgagcccatgagttcaagactggcctgggcaacataggagactcccatctctacaaaaaattaaaagtttgctgggcatggaggcacacacctgtagtcctagttacttgggaggctgagatgggagaatcacataagccca

SEQ ID NO: 98600 - DNA, 332 bp, Homo sapiens
cagtaactgagactcctcattcttcttgagtctacagattattcatcattaaaaaccatatgctaggccttaaaacaagtctcaataaatttcaagggattaaaactgttcagacttttttttttaaccacaatggaattaaattagaataataataatatttgtagaaaatcctgaaatatttggaaattaaacacacaactaaaaatgccagcatcaaaaaaagacaagatacattaaaaattattttgaactgtatgataacaaaaacaatgtcaaaaacatgtgagatatagttaaagcatggctgaaagggaaatttataaatttat

SEQ ID NO: 98601 - DNA, 123 bp, Homo sapiens
taaaatgaaataaaataaaaatccagctataagagagacatctgaaatatatgaagatgttgaaagtaaaacaatatgaagccacttatgcaaatatgcaaattcttggatgtttggaggaga

SEQ ID NO: 98602 - DNA, 303 bp, Homo sapiens
ctgtctcaaataataatgataatattttcttatgcttactttactgtaagattacagtatacattacaacatatgcgtttattgactgtttatgttattgataaggcttctagtcaacagtaggttactagtaattaagtttttgaggagtcaaaagttatgtgtggattttcaactgtggactttggtgcctctaaccctgtgttgttcaggggtcaactgtgtattctttctgtggtaacatttttagatgttatagcctttagacattagaaatggaaatttagttgaactcgagtgttc

SEQ ID NO: 98603 - DNA, 208 bp, Homo sapiens
tgtaaactggatggattgtgcttggagaggtccacaggcccagtgagctctgagaatttgaactggtttatttacacaccctgtccctgcccttctattaggagcacttcctgatgacagggtgaaattgtcccatcccgttccccagggcttaacctttcctcttagaattctccctattctacatgcttttcttcaactcaagtta

SEQ ID NO: 98604 - DNA, 476 bp, Homo sapiens
tgctgatgggcttgtgttcgttcccactcactgactatgcaagcgcctcttctcttagcctttctcaggatgcagttctccaggaggaatcagccttctgttgggctgctttcagagctctttgttgtggcttcctgccattgactttgcaagccctaagcatgctttatgctagttattttaagtgcagctccttcctcaaccaaaacaggaagctggctctgcaagagaatcaagtgcttttgatcctttcagctttttttttttttgactattcttctccaaatctgaaacatatccattctcgtctacggccatgagtgcatttatgttaacagaaaatgctaaatttaatgtttagaaagtaacctctgtggccagacatggtgactaatgcctgtaatcctggcactttgggaggccgaggcaggcagatcacttgaggccaggagttcgagaccagcctggccaacaca

SEQ ID NO: 98605 - DNA, 328 bp, Homo sapiens
tggtttcatttgtaaggactgcaagattttaattgcaagaattaaaaggaaggatagggaacctatatattaaaagacacattaaaaatgtagcagacacatacaacgtggggactgtgtttataaccaagttcaagcaatccaactgccaagaaaaaaatggagagatataaaatctgggaaacatgaatactggctggacatttgatagtactataaaatttttatcttttaggtgtgataaaaataattctttttttagcaatacatatgtcagaatttgcaggtgaaatgacgtgatgtctgggggtgggggagtctgataatt

SEQ ID NO: 98606 - DNA, 381 bp, Homo sapiens
caatctgcttacttccccaatttgattatttatacctctccctccacccctccaagatctggcatggaaattctttcaattgtctcaccgtacataccatctttccttcatgtctttgtgcatgctactcagtggcagctgcaaaggatagcttccccccataatacacaagctcccaaaattacctcaaataaacaatttcagttgcaacttgcttactacacattactgcactgcctcttcatctagacagcaccgtcttccttataaagtaattctggagccacgagtgatattacctctctcacctgcactataactcctcaagcccccactaactcttatttattgcccattcacaatttctaattatctttcaag

SEQ ID NO: 98607 - DNA, 994 bp, Homo sapiens
gtgcacgagggccatgtttggagccatgccagcttgccaatccttggcatactctgtacatagccagataactacacaagctcacctcatctgcacaaactcactctctgaacacttctaaggtcaccgagaagtcagggaaaaatgagaaccaggacagtcaaagcctttgcctctcctgaagctatggggcttgttgccagagccaaagcccctcttagcactcttattacttcatttaacaaacataaggagagcccggccctctgcttttaagggtggattccattactattaagacttctgcggcccctgaaagattaactcaacagtcacccctgtgaaagctgatccaagtggaaaatcgagttagaaaattccaccttcccttccctcacacctcagcagattaaggggaaggcctgatgctgagttatggggatttatgggaatgtgcagttgctggcttttaaacgctcactctttggaatgttggcaaccttgcttcctataaatcgttgctggtatttcttagcctttccttgccagcaacgcggaggcctgcaacaccttttccgtgcagtagcctgtgaaaatattgaagtcaggcccagaaaaacaccagcattgaaaggggaaactttgatgtttgctagttcttttcagacaactcttgccaaatcttaatttttccagtttacaagtaagggattctgaccatctgtctgctgtcaaccgatgtttgtttggatgaagattttatttttttctcccaatctagcactcctgttcttacaagtagtttattggacttcataaatgtcagctttttgcaggcattttgtaagcagcttatgatttagtatttaatcaaaattgagcagtcagcgtctgtaatcaatctgaagcaggagtaacaatgagattgaagcttaaaatgcaccaggaccacaatttatgtctcccaactatcgttgtaagaactaagtttgca

SEQ ID NO: 98608 - DNA, 520 bp, Homo sapiens
ggctgaggactgtgaagcaatcggggcgaggccgggtgtctgttcaactctcccgcgtatcgtctgtttcttcggcggcggacagtgttctgtaatgtgtctcccgttgcccgagctaaaggttttcctcgacggagtctttagaataccgtggtagaggcagtctccacaccactgtgctcgaacagctctatgaagaggcctatgtggagaggagaaaaagcctccaccaacagccagcaccaacttgccagccatatggcgtcttgctctgtcacccaggctggggtgcagtggtgtgatctcagctcactgcaacctctgcctcctgggttcaagcaattcttctgcctcagcctcctgaagagctgtgattacagacggtgtgccaacaatagcacggctaaagtttagtagtaataacgttataacttggaggtttatgtgatcgcattcactatagttgagtctggtatacttcgtgaagattggaagtccatgctctgataggcaagggttg

SEQ ID NO: 98609 - DNA, 2110 bp, Homo sapiens
ggaacatgggaccttgaggagttccgtaaccaaaaggagaaagtaacaacagccagtggagacaaaaagaactgcttctctttctttccccctccaagttcctagtggagggctgagtccagcatcccagactcgtgtgactatataggtaatgaaagtcttgcggcacaagtacctcatcaacttctatcgggccattgagagcacatctcgagtatacatcattctggaactggctcagggtggtgatgtccttgaatggatccagcgctacggggcctgctctgagccccttgctggcaagtggttctcccagctgaccctgggcattgcctacctgcacagcaagagcatcgtgcaccggtgagggcgctgccacccagactggggcctttgccctcaagggggttttatgcacatctcccatttcctgtccttttttcctctttcgaactccctcctcaatatctagcctattcatgcactctattttaatcatatggtcaaggatactgataaagtactcactgtatgcaaagcattttatgaaatacaatggtgagctcccggtggtcctcagataccatcctctgtctctctccctactttgggctctgctcacaactccatggctttccttcctctctaccttgtgccctcataatggtttctacctcccacttcctctgtcctcatctttaccctctgacccctggcccttcagctcccagtctaaaactaagccctctccccagcctgatgcccagcctttctgctgctggtagggacttaaagttggagaacctgttgctggacaagtgggagaatgtgaagatatcagactttggctttgccaagatggtgccttctaaccagcctgtgggttgtagcccttcttaccgccaagtgaactgcttttcccacctcagccagacttactgtggcagctttgcttacgcttgcccagagatcttacgaggcttgccctacaaccctttcctgtctgacacctggagcatgggcgtcatcctttacactctagtggtcgcccatctgccctttgatgacaccaatctcaaaaagctgctaagagagactcagaaggaggtcactttcccagctaaccataccatctcccaggagtgcaaggtccaactgctcattgcctgtgtggcacaatggagaaaaactcaggcaagacctctctctcccctgctctagaacctgatcctccagatgctacgccaagccactaagcgtgccaccattctggacatcatcaaggattcctgggtgctcaagttccagcctgagcaacccacccatgagatcaggctgcttgaggccatgtgccagctccacaacaccactaaacagcaccaatccttgcaaattacgacctgaaaatggctgagggagggggctaagagaggagcaaagcaggaggtcttgggctaaaaatcttttttaccaaaaataaatctaagtctgatttagtttcatcaactagggtcaaagacattcttttctcaaggcaatcttatagcagggaacactgctggagtaagagatagatttctgcccagagcctgtaaccaataatcttgacactgtgttaaatcaatagtgtaattcatgatgtggctcttaggggatggggtgctcagattaacgctctattttgggaagctttattattcaactcaacatatgctcattattttacatctttgtgctgtttaaatgctcaagtagtggggtaaaagccctggttcttccactttgattatggctctgcctgtctatagtccaaagtaatggcactgttagttcttttagaaatgggtattcgagctgggtgcggtggctcacgcctgtaatcccaacactttggggggccgaggcgggcagatcacttgaggtcaagagttcgagaccagactggccaacatggcaaaaccctgtctctatgaaaaatacaaaaattagccgggcatagtggcacctggctgaggcaggagaatcacttgaacccgggatgcaggggttgcagtgagccgagatcgcgccactgcactccagcctgggcgacaaagtgagactctgtctc

SEQ ID NO: 98610 - DNA, 2038 bp, Homo sapiens
ggaacatgggaccttgaggagttccgtaaccaaaaggagaaagtaacaacagccagtggagacaaaaagaactgcttctctttctttccccctccaagttcctagtggagggctgagtccagcatcccagactcgtgtgactatataggtaatgaaagtcttgcggcacaagtacctcatcaacttctatcgggccattgagagcacatctcgagtatacatcattctggaactggctcagggtggtgatgtccttgaatggatccagcgctacggggcctgctctgagccccttgctggcaagtggttctcccagctgaccctgggcattgcctacctgcacagcaagagcatcgtgcaccggtgagggcgctgccacccagactggggcctttgccctcaagggggttttatgcacatctcccatttcctgtccttttttcctctttcgaactccctcctcaatatctagcctattcatgcactctattttaatcatatggtcaaggatactgataaagtactcactgtatgcaaagcattttatgaaatacaatggtgagctcccggtggtcctcagataccatcctctgtctctctccctactttgggctctgctcacaactccatggctttccttcctctctaccttgtgccctcataatggtttctacctcccacttcctctgtcctcatctttaccctctgacccctggcccttcagctcccagtctaaaactaagccctctccccagcctgatgcccagcctttctgctgctggtagggacttaaagttggagaacctgttgctggacaagtgggagaatgtgaagatatcagactttggctttgccaagatggtgccttctaaccagcctgtgggttgtagcccttcttaccgccaagtgaactgcttttcccacctcagccagacttactgtggcagctttgcttacgcttgcccagagatcttacgaggcttgccctacaaccctttcctgtctgacacctggagcatgggcgtcatcctttacactctagtggtcgcccatctgccctttgatgacaccaatctcaaaaagctgctaagagagactcagaaggaggtcactttcccagctaaccataccatctcccaggagtgcaagaacctgatcctccagatgctacgccaagccactaagcgtgccaccattctggacatcatcaaggattcctgggtgctcaagttccagcctgagcaacccacccatgagatcaggctgcttgaggccatgtgccagctccacaacaccactaaacagcaccaatccttgcaaattacgacctgaaaatggctgagggagggggctaagagaggagcaaagcaggaggtcttgggctaaaaatcttttttaccaaaaataaatctaagtctgatttagtttcatcaactagggtcaaagacattcttttctcaaggcaatcttatagcagggaacactgctggagtaagagatagatttctgcccagagcctgtaaccaataatcttgacactgtgttaaatcaatagtgtaattcatgatgtggctcttaggggatggggtgctcagattaacgctctattttgggaagctttattattcaactcaacatatgctcattattttacatctttgtgctgtttaaatgctcaagtagtggggtaaaagccctggttcttccactttgattatggctctgcctgtctatagtccaaagtaatggcactgttagttcttttagaaatgggtattcgagctgggtgcggtggctcacgcctgtaatcccaacactttggggggccgaggcgggcagatcacttgaggtcaagagttcgagaccagactggccaacatggcaaaaccctgtctctatgaaaaatacaaaaattagccgggcatagtggcacctggctgaggcaggagaatcacttgaacccgggatgcaggggttgcagtgagccgagatcgcgccactgcactccagcctgggcgacaaagtgagactctgtctc

SEQ ID NO: 98611 - DNA, 776 bp, Homo sapiens
ggaacatgggaccttgaggagttccgtaaccaaaaggagaaagtaacaacagccagtggagacaaaaagaactgcttctctttctttccccctccaagttcctagtggagggctgagtccagcatcccagactcgtgtgactatataggcaagcatttggggacctacttcactttgataccctagccttcagcagctcaaggtgttggcctttggataggaggcttccaagtagtaaagctccctgctctcagcaagcccaacaccatggggaagggagatgtcttagaggcagcaccaaccaccacagcctaccattccctcatggatgaatatggttatgaggtgggcaaggccattggccatggctcctatgggtcggtatatgaggctttctacacaaagcagaaggttatggtggcagtcaagatcatctcaaagaagaaggcctctgatgactatcttaacaagttcctgccccgtgaaatacagaacctgatcctccagatgctacgccaagccactaagcgtgccaccattctggacatcatcaaggattcctgggtgctcaagttccagcctgagcaacccacccatgagatcaggctgcttgaggccatgtgccagctccacaacaccactaaacagcaccaatccttgcaaattacgacctgaaaatggctgagggagggggctaagagaggagcaaagcaggaggtcttgggctaaaaatcttttttaccaaaaataaatctaagtctgatttagtttcatca

SEQ ID NO: 98612 - DNA, 1433 bp, Homo sapiens
ggaacatgggaccttgaggagttccgtaaccaaaaggagaaagtaacaacagccagtggagacaaaaagaactgcttctctttctttccccctccaagttcctagtggagggctgagtccagcatcccagactcgtgtgactatataggtaatgaaagtcttgcggcacaagtacctcatcaacttctatcgggccattgagagcacatctcgagtatacatcattctggaactggctcagggtggtgatgtccttgaatggatccagcgctacggggcctgctctgagccccttgctggcaagtggttctcccagctgaccctgggcattgcctacctgcacagcaagagcatcgtgcaccggtgagggcgctgccacccagactggggcctttgccctcaagggggttttatgcacatctcccatttcctgtccttttttcctctttcgaactccctcctcaatatctagcctattcatgcactctattttaatcatatggtcaaggatactgataaagtactcactgtatgcaaagcattttatgaaatacaatggtgagctcccggtggtcctcagataccatcctctgtctctctccctactttgggctctgctcacaactccatggctttccttcctctctaccttgtgccctcataatggtttctacctcccacttcctctgtcctcatctttaccctctgacccctggcccttcagctcccagtctaaaactaagccctctccccagcctgatgcccagcctttctgctgctggtagggacttaaagttggagaacctgttgctggacaagtgggagaatgtgaagatatcagactttggctttgccaagatggtgccttctaaccagcctgtgggttgtagcccttcttaccgccaagtgaactgcttttcccacctcagccagacttactgtggcagctttgcttacgcttgcccagagatcttacgaggcttgccctacaaccctttcctgtctgacacctggagcatgggcgtcatcctttacactctagtggtcgcccatctgccctttgatgacaccaatctcaaaaagctgctaagagagactcagaaggaggtcactttcccagctaaccataccatctcccaggagtgcaagaacctgatcctccagatgctacgccaagccactaagcgtgccaccattctggacatcatcaaggattcctgggtgctcaagttccagcctgagcaacccacccatgagatcaggctgcttgaggccatgtgccagctccacaacaccactaaacagcaccaatccttgcaaattacgacctgaaaatggctgagggagggggctaagagaggagcaaagcaggaggtcttgggctaaaaatcttttttaccaaaaataaatctaagtctgatttagtttcatca

SEQ ID NO: 98613 - DNA, 449 bp, Homo sapiens
caaaaagctgctaagagagactcagaaggaggtcactttcccagctaaccataccatctcccaggagtgcaaggtactggctacctaaggagggctgagccttcagggatgacccacagggaggggtgaatatccaacctaggtcacccaacctaggcctcccaaccctggggaaaggctcttcccacaccagagccatctcacacactagctcctgtcctataataaacagtatggaaggcataaagggccaaccactaggctccaaaccttgcctgatacacaggttccagcttctttctctttaggccagaagggaaatatggaaagcattcctcccaaggaactcttcccttcccctccagggagttaactgcctgggtctccaagataaaatcagagccacacccactttgaccagagtggtatgatgggctatcctgcttctt

SEQ ID NO: 98614 - DNA, 1381 bp, Homo sapiens
ggaacatgggaccttgaggagttccgtaaccaaaaggagaaagtaacaacagccagtggagacaaaaagaactgcttctctttctttccccctccaagttcctagtggagggctgagtccagcatcccagactcgtgtgactatataggcaagcatttggggacctacttcactttgataccctagccttcagcagctcaaggtgttggcctttggataggaggcttccaagtagtaaagctccctgctctcagcaagcccaacaccatggggaagggagatgtcttagaggcagcaccaaccaccacagcctaccattccctcatggatgaatatggttatgaggtgggcaaggccattggccatggctcctatgggtcggtatatgaggctttctacacaaagcagaaggttatggtggcagtcaagatcatctcaaagaagaaggcctctgatgactatcttaacaagttcctgccccgtgaaatacagaacctgatcctccagatgctacgccaagccactaagcgtgccaccattctggacatcatcaaggattcctgggtgctcaagttccagcctgagcaacccacccatgagatcaggctgcttgaggccatgtgccagctccacaacaccactaaacagcaccaatccttgcaaattacgacctgaaaatggctgagggagggggctaagagaggagcaaagcaggaggtcttgggctaaaaatcttttttaccaaaaataaatctaagtctgatttagtttcatcaactagggtcaaagacattcttttctcaaggcaatcttatagcagggaacactgctggagtaagagatagatttctgcccagagcctgtaaccaataatcttgacactgtgttaaatcaatagtgtaattcatgatgtggctcttaggggatggggtgctcagattaacgctctattttgggaagctttattattcaactcaacatatgctcattattttacatctttgtgctgtttaaatgctcaagtagtggggtaaaagccctggttcttccactttgattatggctctgcctgtctatagtccaaagtaatggcactgttagttcttttagaaatgggtattcgagctgggtgcggtggctcacgcctgtaatcccaacactttggggggccgaggcgggcagatcacttgaggtcaagagttcgagaccagactggccaacatggcaaaaccctgtctctatgaaaaatacaaaaattagccgggcatagtggcacctggctgaggcaggagaatcacttgaacccgggatgcaggggttgcagtgagccgagatcgcgccactgcactccagcctgggcgacaaagtgagactctgtctc

SEQ ID NO: 98615 - DNA, 1505 bp, Homo sapiens
ggaacatgggaccttgaggagttccgtaaccaaaaggagaaagtaacaacagccagtggagacaaaaagaactgcttctctttctttccccctccaagttcctagtggagggctgagtccagcatcccagactcgtgtgactatataggtaatgaaagtcttgcggcacaagtacctcatcaacttctatcgggccattgagagcacatctcgagtatacatcattctggaactggctcagggtggtgatgtccttgaatggatccagcgctacggggcctgctctgagccccttgctggcaagtggttctcccagctgaccctgggcattgcctacctgcacagcaagagcatcgtgcaccggtgagggcgctgccacccagactggggcctttgccctcaagggggttttatgcacatctcccatttcctgtccttttttcctctttcgaactccctcctcaatatctagcctattcatgcactctattttaatcatatggtcaaggatactgataaagtactcactgtatgcaaagcattttatgaaatacaatggtgagctcccggtggtcctcagataccatcctctgtctctctccctactttgggctctgctcacaactccatggctttccttcctctctaccttgtgccctcataatggtttctacctcccacttcctctgtcctcatctttaccctctgacccctggcccttcagctcccagtctaaaactaagccctctccccagcctgatgcccagcctttctgctgctggtagggacttaaagttggagaacctgttgctggacaagtgggagaatgtgaagatatcagactttggctttgccaagatggtgccttctaaccagcctgtgggttgtagcccttcttaccgccaagtgaactgcttttcccacctcagccagacttactgtggcagctttgcttacgcttgcccagagatcttacgaggcttgccctacaaccctttcctgtctgacacctggagcatgggcgtcatcctttacactctagtggtcgcccatctgccctttgatgacaccaatctcaaaaagctgctaagagagactcagaaggaggtcactttcccagctaaccataccatctcccaggagtgcaaggtccaactgctcattgcctgtgtggcacaatggagaaaaactcaggcaagacctctctctcccctgctctagaacctgatcctccagatgctacgccaagccactaagcgtgccaccattctggacatcatcaaggattcctgggtgctcaagttccagcctgagcaacccacccatgagatcaggctgcttgaggccatgtgccagctccacaacaccactaaacagcaccaatccttgcaaattacgacctgaaaatggctgagggagggggctaagagaggagcaaagcaggaggtcttgggctaaaaatcttttttaccaaaaataaatctaagtctgatttagtttcatca

SEQ ID NO: 98616 - DNA, 631 bp, Homo sapiens
cactcaccttcagtccccaaaaagtaaaggcacaaaacatagcatttgcccacaggccaccagttctctggggttgaggggctgatcctattgcaaagtcctaagtcagtagctgagggtaggagacggctgggagtgcagtcagggttctcccttcccaggtttgatgggtccttcttctggggtcaggtaatgaaagtcttgcggcacaagtacctcatcaacttctatcgggccattgagagcacatctcgagtatacatcattctggaactggctcagggtggtgatgtccttgaatggatccagcgctacggggcctgctctgagccccttgctggcaagtggttctcccagctgaccctgggcattgcctacctgcacagcaagagcatcgtgcaccggtgagggcgctgccacccagactggggcctttgccctcaagggggttttatgcacatctcccatttcctgtccttttttcctctttcgaactccctcctcaatatctagcctattcatgcactctattttaatcatatggtcaaggatactgataaagtactcactgtatgcaaagcattttatgaaatacaatggtgagctcccggtggtcctcagataccatcct

SEQ ID NO: 98617 - DNA, 566 bp, Homo sapiens
atcttaagacacatatggaaaacaatagggtagaacttagtaaactacaagaatataaattggagctagatgaaaaggcagtgcaggcagtagaaaaattagaagaaatccatttacaggttagttttttaaatcaggtaagtttatctgtaatgtgctttcatttatttcaccgcaaattatattttggatatgtatatattatgtttcctctgcctctcttgtagcaatttgctttgtagagttctagaaaaaaaatggcatctgttttttcttttaaatatttacatttccattattattataacaaaatcaatctttcagagtaatgattctcactgtggagtcatttgatgattaagatcagttggcataagaaacaattgtgatttcaaaattatgtgatacttttgaattggtcttaagctacattgttcattaatcactttttaaaattatgaatggattctattactttttatatgaccagattacattaatactaacataattatgatttcaaatttttataaatcagacaattctgaattcagttattagttttg

SEQ ID NO: 98618 - DNA, 828 bp, Homo sapiens
cgacgcctcaaggcctgctcagcgtgcgcgggcatccggtgggtgcgggaggcccgaggccaggcaggcagggatcccgcagcgaggggctggttactgccaggacggagcgcattgcctcgagccgaccccggggtccgcgagggctcctggggacgaggagtgtggggcacctgccgcggggggcccaggcgctaaaggtggagggaaggaacgcactcgcggcgggggcctggccggggcggacgcagccagcctcacccgcgacggtaggggacttccagggcgagggggcccatctgccctcgggcgccaggaggatgctccagctcctggtgctgaagattgaagatccaggttgcttctgggttattataaaagggtgtagtccctttttagatcatgatgtcgattatcaaaaattaaatagtgccatgaatgacttctacaacagcacgtgtcaagatatagaaataaaacccttaacattggaagaaggacaggtgtgtgtggtctattgtgaggagctaaagtgctggtgcagggccattgtcaaatcaattacgtcttccgcagaccagtacctggcagaatgtttccttgtggactttgccaagaacattccagtcaaatctaaaaacatccgagttgtagtagaatcgtttatgcagcttccctatagagcaaaaaaattcagcctgtactgcacaaagcctgtcacattacacattgacttctggcgagacagtactgacattgtacctgccaagaagtgggacaatgcagctattcagtactttcagaaccttctgaaaggtaagccagtgc

SEQ ID NO: 98619 - DNA, 3098 bp, Homo sapiens
  misc_feature (84)..(84): n is a, c, g, or t
gacccgcgcgggatgtgaccccctgaccccctgcctggcctcccctgccccccagggggcccgcctttgcctgcttttgggggngggtggggaggggcgcgcggatcatggcattggagttcccgggcttgcagccgccgccgccgcctcgttcacgcaccccgagcgccccttcttcccagagcagcagcggagaaggcgaagcggccggcgggggcgaggcagatggggctcaaggcgcgcagggcggcgggggcggctggcggcggcggcgacgggggcggcggaggcggcggggcggctaacccagccggaggggacgcggcggcggccggcgacgaggagcggaaagtggggctggcgcccggcgacgtggagcaagtcaccttggcgctcggggccggagccgacaaagacgggaccctgctgctggagggcggcggccgcgacgaggggcagcggaggaccccgcagggcatcgggctcctggccaagaccccgctgagccgcccagtcaagagaaacaacgccaagtaccggcgcatccaaactttgatctacgacgccctggagagaccgcggggctgggcgctgctttaccacgcgttggtgttcctgattgtcctggggtgcttgattctggctgtcctgaccacattcaaggagtatgagactgtctcgggagactggcttctgttactggagacatttgctattttcatctttggagccgagtttgctttgaggatctgggctgctggatgttgctgccgatacaaaggctggcggggccgactgaagtttgccaggaagcccctgtgcatgttggacatctttgtgctgattgcctctgtgccagtggttgctgtgggaaaccaaggcaatgttctggccacctccctgcgaagcctgcgcttcctgcagatcctgcgcatgctgcggatggaccggagaggtggcacctggaagcttctgggctcagccatctgtgcccacagcaaagaactcatcacggcctggtacatcggtttcctgacactcatcctttcttcatttcttgtctacctggttgagaaagacgtcccagaggtggatgcacaaggagaggagatgaaagaggagtttgagacctatgcagatgccctgtggtggggcctgatcacactggccaccattggctatggagacaagacacccaaaacgtgggaaggccgtctgattgccgccaccttttccttaattggcgtctccttttttgcccttccagcgggcatcctggggtccgggctggccctcaaggtgcaggagcaacaccgtcagaagcactttgagaaaaggaggaagccagctgctgagctcattcaggctgcctggaggtattatgctaccaaccccaacaggattgacctggtggcgacatggagattttatgaatcagtcgtctcttttcctttcttcaggaaagaacagctggaggcagcatccagccaaaagctgggtctcttggatcgggttcgcctttctaatcctcgtggtagcaatactaaaggaaagctatttacccctctgaatgtagatgccatagaagaaagtccttctaaagaaccaaagcctgttggcttaaacaataaagagcgtttccgcacggccttccgcatgaaagcctacgctttctggcagagttctgaagatgccgggacaggtgaccccatggcggaagacaggggctatgggaatgacttccccatcgaagacatgatccccaccctgaaggccgccatccgagccgtcagaattctacaattccgtctctataaaaaaaaattcaaggagactttgaggccttacgatgtgaaggatgtgattgagcagtattctgccgggcatctcgacatgctttccaggataaagtaccttcagacgagaatagatatgattttcacccctggacctccctccacgccaaaacacaagaagtctcagaaagggtcagcattcaccttcccatcccagcaatctcccaggaatgaaccatatgtagccagaccatccacatcagaaatcgaagaccaaagcatgatggggaagttttgtaaaagttgaaagacaggttcaggacatggggaagaagctggacttcctcgtggatatgcacatgcaacacatggaacggttgcaggtgcaggtcacggagtattacccaaccaagggcacctcctcgccagctgaagcagagaagaaggaggacaacaggtattccgatttgaaaaccatcatctgcaactattctgagacaggccccccggaaccaccctacagcttccaccaggtgaccattgacaaagtcagcccctatgggttttttgcacatgaccctgtgaacctgccccgagggggacccagttctggaaaggttcaggcaactcctccttcctcagcaacaacgtatgtggagaggcccacggtcctgcctatcttgactcttctcgactcccgagtgagctgccactcccaggctgacctgcagggcccctactcggaccgaatctccccccggcagagacgtagcatcacgcgagacagtgacacacctctgtccctgatgtcggtcaaccacgaggagctggagaggtctccaagtggcttcagcatctcccaggacagagatgattatgtgttcggccccaatggggggtcgagctggatgagggagaagcggtacctcgccgagggtgagacggacacagacacggaccccttcacgcccagcggctccatgcctctgtcgtccacaggggatgggatttctgattcagtatggaccccttccaataagcccatttaaaagaggtcactggctgacccctccttgtaatgtagacagactttgtatagttcacttactcttacacccgacgcttaccagcggggacaccaatggctgcatcaaatgcatgcgtgtgcgtggtggccccacccaggcaggggcttcccacagcctcttcctccccatgtcaccacaacaaagtgcttccttttcagcatggtttgcatgactttacactatataaatggttccgctaatctcttctaggata

SEQ ID NO: 98620 - DNA, 877 bp, Homo sapiens
  misc_feature (13)..(13): n is a, c, g, or t
  misc_feature (39)..(39): n is a, c, g, or t
  misc_feature (42)..(42): n is a, c, g, or t
  misc_feature (97)..(97): n is a, c, g, or t
  misc_feature (100)..(100): n is a, c, g, or t
  misc_feature (117)..(117): n is a, c, g, or t
gaaaggtgatatnttagaggatagcccctcaatgtctantcntcaatttaatgcatattacaagtactgcttatttgttgcaaagaagggtcatttnttntctttcttccttctttntactttctcttttttctcgtgccgaattcggcacgaggtgatagttgccatggtgaccaatcaagataatccagatgacctaaacaaatgtctgtatgcagctgacactgctattctccctcacagtcttgtcaagagccacagtagctatggcagacatttggttgatggtttcatcatttcctaatacgagagtctggcactatgttggagagaggaatcacttcctcagagataggttcctttcaactcacatgtcaacagttactgtacaaaaagctcagaatacagtaatgattagagcttgacccctgactttaggaacttagaaccaaagcccaaagtcccaggccaagggcagacattgtgagcagcagaagggtgttttttatggagagccccataaatggatgggtgtagaccttgaagtctgagatgggaaatataccagaatgctcaatgcatcagacatgaagccccacgggcttccatttgacatgctggcaatctgaaggacaaagggcatgggttatttgggccttttccccactccttcaatatggctgaaagtgccagtggggattacaacctaagaaaccctatgccccttcctgagggcttgattattgaatcctgatcttcctggaatctttcacttgagatgatcacctgcctaacatccaacatgttactatgctcttctttatgtacatgagttactggaaaccaacaataaaggagagtgagtcataaaaaaaaa

SEQ ID NO: 98621 - DNA, 5169 bp, Homo sapiens
  misc_feature (84)..(84): n is a, c, g, or t
  misc_feature (3678)..(3678): n is a, c, g, or t
gacccgcgcgggatgtgaccccctgaccccctgcctggcctcccctgccccccagggggcccgcctttgcctgcttttgggggngggtggggaggggcgcgcggatcatggcattggagttcccgggcttgcagccgccgccgccgcctcgttcacgcaccccgagcgccccttcttcccagagcagcagcggagaaggcgaagcggccggcgggggcgaggcagatggggctcaaggcgcgcagggcggcgggggcggctggcggcggcggcgacgggggcggcggaggcggcggggcggctaacccagccggaggggacgcggcggcggccggcgacgaggagcggaaagtggggctggcgcccggcgacgtggagcaagtcaccttggcgctcggggccggagccgacaaagacgggaccctgctgctggagggcggcggccgcgacgaggggcagcggaggaccccgcagggcatcgggctcctggccaagaccccgctgagccgcccagtcaagagaaacaacgccaagtaccggcgcatccaaactttgatctacgacgccctggagagaccgcggggctgggcgctgctttaccacgcgttggtgttcctgattgtcctggggtgcttgattctggctgtcctgaccacattcaaggagtatgagactgtctcgggagactggcttctgttactggagacatttgctattttcatctttggagccgagtttgctttgaggatctgggctgctggatgttgctgccgatacaaaggctggcggggccgactgaagtttgccaggaagcccctgtgcatgttggacatctttgtgctgattgcctctgtgccagtggttgctgtgggaaaccaaggcaatgttctggccacctccctgcgaagcctgcgcttcctgcagatcctgcgcatgctgcggatggaccggagaggtggcacctggaagcttctgggctcagccatctgtgcccacagcaaagaactcatcacggcctggtacatcggtttcctgacactcatcctttcttcatttcttgtctacctggttgagaaagacgtcccagaggtggatgcacaaggagaggagatgaaagaggagtttgagacctatgcagatgccctgtggtggggcctgatcacactggccaccattggctatggagacaagacacccaaaacgtgggaaggccgtctgattgccgccaccttttccttaattggcgtctccttttttgcccttccagcgggcatcctggggtccgggctggccctcaaggtgcaggagcaacaccgtcagaagcactttgagaaaaggaggaagccagctgctgagctcattcaggctgcctggaggtattatgctaccaaccccaacaggattgacctggtggcgacatggagattttatgaatcagtcgtctcttttcctttcttcaggaaagaacagctggaggcagcatccagccaaaagctgggtctcttggatcgggttcgcctttctaatcctcgtggtagcaatactaaaggaaagctatttacccctctgaatgtagatgccatagaagaaagtccttctaaagaaccaaagcctgttggcttaaacaataaagagcgtttccgcacggccttccgcatgaaagcctacgctttctggcagagttctgaagatgccgggacaggtgaccccatggcggaagacaggggctatgggaatgacttccccatcgaagacatgatccccaccctgaaggccgccatccgagccgtcagaattctacaattccgtctctataaaaaaaaattcaaggagactttgaggccttacgatgtgaaggatgtgattgagcagtattctgccgggcatctcgacatgctttccaggataaagtaccttcagacgagaatagatatgattttcacccctggacctccctccacgccaaaacacaagaagtctcagaaagggtcagcattcaccttcccatcccagcaatctcccaggaatgaaccatatgtagccagaccatccacatcagaaatcgaagaccaaagcatgatggggaagttttgtaaaagttgaaagacaggttcaggacatggggaagaagctggacttcctcgtggatatgcacatgcaacacatggaacggttgcaggtgcaggtcacggagtattacccaaccaagggcacctcctcgccagctgaagcagagaagaaggaggacaacaggtattccgatttgaaaaccatcatctgcaactattctgagacaggccccccggaaccaccctacagcttccaccaggtgaccattgacaaagtcagcccctatgggttttttgcacatgaccctgtgaacctgccccgagggggacccagttctggaaaggttcaggcaactcctccttcctcagcaacaacgtatgtggagaggcccacggtcctgcctatcttgactcttctcgactcccgagtgagctgccactcccaggctgacctgcagggcccctactcggaccgaatctccccccggcagagacgtagcatcacgcgagacagtgacacacctctgtccctgatgtcggtcaaccacgaggagctggagaggtctccaagtggcttcagcatctcccaggacagagatgattatgtgttcggccccaatggggggtcgagctggatgagggagaagcggtacctcgccgagggtgagacggacacagacacggaccccttcacgcccagcggctccatgcctctgtcgtccacaggggatgggatttctgattcagtatggaccccttccaataagcccatttaaaagaggtcactggctgacccctccttgtaatgtagacagactttgtatagttcacttactcttacacccgacgcttaccagcggggacaccaatggctgcatcaaatgcatgcgtgtgcgtggtggccccacccaggcaggggcttcccacagcctcttcctccccatgtcaccacaacaaagtgcttccttttcagcatggtttgcatgactttacactatataaatggttccgctaatctcttctaggatacacatttatctgctgttcttacttttaatcacgattggaccagtacagggagaaattactgatgagccatgctatttgtctgtttggttggctggtttgggttttggtttggtaagcagagaaagtagtttaagttatttctaggatcactgccctcttgtgtaaaacgctccagcaattaactgtttttgaaagcaaggaaataattttctcaacaaaaccacattgtgtatcagtggggctgcctactgagctaacattaggaaaggaatgagatagtcattgtgtctctaaaacaaagaatttaaacaaatatttaaggcaaaaccttttaaaagctctccaaaagacctcacttggcctgatgttacttagtatcatgcctcagtttccttatctgtaaaaagtggtggtaatcccaagtgtagcatttctgatgagttatgaattggcagggagaaaacacacacacacacacacacacacacacacacacacatacacaaagttaaaatagtttccaatttatgtagccaaggacaatggaatttatcagaagtgaagtgcccctctgggcagngagctgagttcagtgcctttaaaatgaatttccaactctcatttcttcccatgatactgaagtacaaaatatccatctaaaatagaaattaaagtcaagaaggcacacagaaattttctagtccaaggacttccttttataaatgaagaatcttaggctcaggtaaagtgacatacccagagtcactcagttgtcccatagagaaccaggactcaaaagtcaggtctgcccactctccctgaccttgtttcccctcaccacaccattcttccatttatataatgcatcctagagattgtgtcaagatatatgactttgtgtcgcgtggaaagcacccagtttatccagcaggagggggatttccacttttattgcaaaacatgcttgcttgatgcaatgcatttcagatctagaaaaaaataatgcaagcaagctacatttacagatgtgtaaacaggcaaaatttccagaaccgtccaattttacttttccaaatttatggaaccaacccagattttttaaatgaaaatactaaaaccatatgtaaccgtaagacaagctaaaatgtaagcagacagcctgggaagcactgccctactgtacaggtgtgatattaagcacaagccatcctctggcctcttatgagatgttgttattctctgaaaaactttgatggaaaaggtttctgttaggcttagactgaattagctaaatgaccatgccacagtattattgtatcactcttctcacacacctaggcactggttgtggatagttgccatggtgaccaatcaagataatccagatgacctaaacaaatgtctgtatgcagctgacactgctattctccctcacagtcttgtcaagagccacagtagctatggcagacatttggttgatggtttcatcatttcctaatacgagagtctggcactatgttggagagaggaatcacttcctcagagataggttcctttcaactcacatgtcaacagttactgtacaaaaagctcagaatacagtaatgattagagcttgacccctgactttaggaacttagaaccaaagcccaaagtcccaggccaagggcagacattgtgagcagcagaagggtgttttttatggagagccccataaatggatgggtgtagaccttgaagtctgagatgggaaatataccagaatgctcaatgcatcagacatgaagccccacgggcttccatttgacatgctggcaatctgaaggacaaagggcatgggttatttgggccttttccccactccttcaatatggctgaaagtgccagtggggattacaacctaagaaaccctatgccccttcctgagggcttgattattgaatcctgatcttcctggaatctttcacttgagatgatcacctgcctaacatccaacatgttactatgctcttctttatgtacatgagttactggaaaccaacaataaaggagagtgagtcataaaaaaaaa

SEQ ID NO: 98622 - DNA, 354 bp, Homo sapiens
ctgatggctgcctctcgttggtcaaatccaaccaaaagctaagagctggagagcttgggtggtgcatccaaggaggcttgcttcctggggcacagaagggagagtggagaaggatggaaagtggctctaggggaggaaatggagaacatccagaactttatgtcacctctggtgcttgaaggcctttctccagggagacaaaaagtttgtgttggctaaagctccctggttgctcaggagccaagggtcacataatgtgccaatgggggtttttgcctctgaaagcctctgaggtataattactgcaatgaaacatcccttttctctctctcctctgcccacctccatgccagg

SEQ ID NO: 98623 - DNA, 1086 bp, Homo sapiens
  misc_feature (392)..(392): n is a, c, g, or t
atttgataatgacttcttcaatcttgttcaggtgatctgtctttctgggaaaataaaaccctgacatctttttttctgaaaaactatacttcctaaaatactaagacttactgtttttatctatgcatatagatctaataagagtagtagggcattgggtactactggcaatagatttgtgaataaataatgctgtgctcttgtatgaaactcttttgttttcctattaagtagtgtatcttctttgaagtttttgtcttcatttatttgttgggggtggatggagggggatgaatttgcactggcctggttcatttttgacatgtcatcaatgtccagtgggcatcggttggaagtccagtcacctttagacctgcagcctttccctgtgncaacatagtgacagtccttgtcctctaggaggagacatggcatgctaaggcagagggctttatggttcctgggggaataaagcagacctctaagtaacttttccaattaagatagaatccagtgcttgttttatgagaacagctgagtaatccggtatatatataacagatctcttttatgggggctctgagagctaagttgtcaggcattccctatatacttgtctggcttccagtattccttcctagtcatctcatgcacattctcgtccccttaatctctcacctccaaacattgtagagggagggaaggcctttattcccattcctaaaataaataaataaaaatcaagtgtcatttatcagttatatggtttaaattattggattattttcccaaaagaattaaaatataaacaaatatgctttcatttgaaaccatagatagtagttcatgtatttttttgtttgtagaggtagagaaggaaaagaagtataaaaagaggtccaggaggccgggcgcggcggctcacacctgtaatcccagcactttgggaggccgaggagggcgaatcatgaggtcaggagtttgagaccatcctggccaatatgatgaaaccccgtctctactaaaaatacaaaaaaattagctgggcatggtggcgcatgcctgtaatcccagctacttgggagg

SEQ ID NO: 98624 - DNA, 450 bp, Homo sapiens
aaaatgattttttctgcaaagacaagattgaattgggcattctgaatacatgttgttgagataagccaaatatttggtcctagaagctgagaggatatgatactgaatgattatttagcactaaaggtttatcttcaaagaggtcttgaaataagaatatgtaattaggctgggcacagtggctcacaactgtagtcctagcacttttggaggccaaggcaggtggatcacttgagctcaggagttgaagaccagactgggcaatatggcaaaaccttgtatttttgtagaaaaagtataaaaattagccaggtatggtggtgtgtgcctgtagtcccagctactcagaaagctgaggtggaaaaattacctgagcctagtggggtcaaggctgcagtgagctgtgatcaggccaccgcactccagcctgggtaacagaaagagtaagac

SEQ ID NO: 98625 - DNA, 440 bp, Homo sapiens
ggcaagcaaaccaatctgattcgatgttaacattggaagtaactatttttaaaattcattcatgtatacactttctccatagctttctattttaaaaagtcaattgaaaacttccaacaaactttatcataatgcaactagtgggaaaatagatttttctataccttcatctgggttaggttttgtgaaaggtggttgggtgaggcgtggatgtggaagagggagatcagttcagtgtaaggtccagaaaaagcaataagatctgggaaagacccagaatgaaagccaagagagtgctaaccagctgtggttcctttctatctaggtaatttctccacaacttctctcatactctctcgtagacaggcagcctttattctgcatcctctccacaggcatgttatttgcatcacattaatttacacatttgcttgttccct

SEQ ID NO: 98626 - DNA, 672 bp, Homo sapiens
atcaggaaagtaacatcttttaaacaaatatttctacattccacatttttaaattaatttgaagttaaaattattgttttaagtactgtcaagtatatcttcaggcaagaatactcaaggtagtatttatattttataagttttgttttttttttttcctcagacctcatgatttctagtgacaaggtactttgtgaatttgtattaacttgaaatttcactgcaactgaattagctaaatacctttcaaaagaaatgactaagcagccagaacagggatagaattacaaagttttcaagaaagtgcattttaaacaactaagttcaaaactatttttcttacactaaaagtagggaacattattattatttttaacatttgaaaatgaggttaataaatagataactacatttttgaaattttatgtaattgttataattaatcatttttcgtggtgagtagttggtttgatttttttttctttttagttagcaagagggattatttttaaggaaacctagctgttaaatatttctaatgtaaatagttgttacagattttagtcatttagagttgttcaccttcaatgaccagatctaaatttgaattaattggtgcctcagaaacttgaaagccgtcaaaattattcctgtaaccagtagcatcttata

SEQ ID NO: 98627 - DNA, 299 bp, Homo sapiens
ttgtgtgatcttagacatgtcccttaacctcttgggcctcagatttctcatatataaaatggagctaataataccagctgggtgcagtggctcacgcctataatcccagcactttggggctgaggtgggtggattacaggcatgagccacctcaccgggccttttttcttttctttgcttttatccttttcaaaacctccagtgacctcatactgcagtgggctacgtgttcttccaagggtgcagtctgatagggccacctttgcagagagactttcccacagactttgatttttatt

SEQ ID NO: 98628 - DNA, 301 bp, Homo sapiens
ccccctgccatatttctggcagcagtcacagcccccatggagcagggcagcccctctctcaacactaccgcctcccctatggctccaggtacatttttggtcccctagtcccctcaggcctaggggtggtgacagctctcagggcttgttagcaccggggaactttgtcctgtgctggctctcgggcctgcccacaccctgtgatggtcccttactaaactcctctccgttgcacccccggaacgcagcagctcttgtctgctggtgtctttaactcctctttcttactgtttgccaggaa

SEQ ID NO: 98629 - DNA, 401 bp, Homo sapiens
atttagcttcaaatacattgaattcttggtaatatagacatgaatattttccattgtataacagagttttcacctgtactatggaaacctattgtgtccttcattcttgcttcttgagtaagatattgacataagaataaataatgtttaggttatttcttctttataaggaagtataacaatatattgtagtatgatccataattcccagagatccatgttaatttaccttgccattacagtgtaacaaataatagtgtagaagttacaaaaagaagggaaaaagcatcagagtgaaagtttagataagagttatttaattattcacaattaagaaaagggctttaccctatagttgtttattatttcatggttttgcccaagtcgtttgggcactcttg

SEQ ID NO: 98630 - DNA, 636 bp, Homo sapiens
tatttccctcttcaatgaactcgcaacctcagaatgcatttgtgagttctcttgcagtgtaaattatgagattattcctaaccttgtcaggttctggtgacatactgcctaccataatataatagaagcaattcataatttttttttttttttacctgaactagtttcaagttctgtggctttgcagctgccattgttcctgcttcacacagaacattcggtacaggggatactttatgggacagaacagatagttgaaagctgattttacttgctaattctcccttgttattctggcattaaggttgcattagaaggatgcaaagatgtttgatgaaagtgatctgtgctggggttggtgctctgcaaatgctttaaaggtgtggcacatgacattgagccagtgcatccaggtggagcctgggacagacataaaaccctaggttggtaaacacctgtcacaggaagcctcatcaaggaattcttggggagtggaacagtggagcaccctgcaatcctcacaggcagcagccatagtaagcaatgttcagcatttgctgtgcctcagagacacacacagcataaccctacttcagcagctcactgcagaaaatgaaccatatcccaccaaacgag

SEQ ID NO: 98631 - DNA, 421 bp, Homo sapiens
ggtcgacagtaaccactccccaggtgtgaacacttctttatgttttcctccagaagtgctttatgtagagtgtggagctcttctttcattcctttgttttagttatcagataattttctttctgaagtaattttctagtggttgtattatttatcaatagtgtcaactatggcttttcttaactttaagatttttttcttaaatcacactttttttctagagcatttacgaaagatttattttttcattttaaaaaataaggaattaggctgggcgcagtggctcacgcctgtaatcccagcactttgggaggccaaggcatgtgaatcacctgaggttaggagtttgacaccagcctggccaacatggaaaaaccccgtctctactaataatacaaaaattagctgggtgtagtggtgca

SEQ ID NO: 98632 - DNA, 705 bp, Homo sapiens
tgatgacattacgctaagggaaagaagccagacacaaaaggacaaatattgtatgactccacttatatgatgtctctagaggaggcaaattaacagagacagaaagaaagtagattttcagctaccaggtgacaaggaaaggagggaatggggagttacagcttaatggttagagttgtttttttgttttgttttgtcttttctttttttttaggtggagttttgctcttgttgctcaggctggagtgcaatggcaccatctcagctcaccgcaacctccgcctcccaggttcaagcgattctcctgcctcagtctcccgagtagctgggattacaggcatgcagttagagtttttaaggtgatgaaaaagttttggaaatagatagtggtgatggatgcaaaacactgtgaatataattgatgtcactgaattgtacactaaaaaaaatggcaggtttatgtcatatatattttaccacaattttttttttttccttgagacagaatctcgctgttgcccaggctggatgcagtggcgcaatcttggctcattgtgacctctgcctcctgggttccagcgattttcccgctcagcctcccgagtagttgggaccacaggggcatgccaccacacttggctaatttttaatttttttttggtagagacgtgggctttaccatgttagccaggctggtctcgaact

SEQ ID NO: 98633 - DNA, 390 bp, Homo sapiens
tgatgacattacgctaagggaaagaagccagacacaaaaggacaaatattgtatgactccacttatatgatgtctctagaggaggcaaattaacagagacagaaagaaagtagattttcagctaccaggtgacaaggaaaggagggaatggggagttacagcttaatggttagagttgtttttttgttttgttttgtcttttctttttttttaggtggagttttgctcttgttgctcaggctggagtgcaggcgtgagccaccgcacccggccagaacttcatccctttttatggctgaatgatgacccattgtatggatatagtacatctggttaatccattcatttgttgatggacacttgagttgtttccaccatttgcctaaagaa

SEQ ID NO: 98634 - DNA, 345 bp, Homo sapiens
ggctagttgaacatttccacactcattgtctttatctatatatattgttatagttggtcttctttcatcatttggtttaatactttctggtttttgtttcctcttttttctatttttcctttatagatggtttgttgactattatctttggtaatttcaaagatacatatgttttatttcgttatataaatagttatcctaaagtttttttaaaaatattccctacttccatagctattaacatttacaatatttataatgtcacttggcattatattgacaactattgacataattttaataacagaattcattttttacttccatttataggaaaaggaaatt

SEQ ID NO: 98635 - DNA, 815 bp, Homo sapiens
caggcgtgttggtgtgcacctgtaatcccagctactcaggaggctgagatggaagaatcacttgagcccaggaggcagaggttgcagtgagccaagatcacgccactgcactccagcctgggcaacagagcaagaccctgtctccaaaagaaataaaattttaaaaaagactaaaaaacaatacaaatgatcagtgaaataaaaagatttgaaaaaataaaattgacaaccactagtaaattttcccagacacatataccaacatagattcaagaggaaatagaaaacctgatcaaacagaccagttatgagtaattaaagtgaatctgtaattaaaagtctcccattaaagaaaagtccagcacttgattccttcactgcagaattctgccaaacatttaaagaagagctaataccaattcttctcatactcctccagaaaactgaagagaagggaactcttctgaactcaatccacaaggccagcattaccctaatagcaataccacatgaggatacaacaaaataaagaaaaatatagacaagtatccttgatgaacataaatttttaaatccccaacgaaatactagcaaactgaatccagcaacacattgaaaagagcattcatgatgaaaaagtgggatttatcccagggatgcaagaatggttcaacatatgcaaatccataaatgcgatgcatcacatcaacagaatgaagaacaaaaaccatgtggtaatgccagtagatgcagaaaaagcatttgataagtggcttcatgatatgaactcttaacaagttaggtatagaaagaac

SEQ ID NO: 98636 - DNA, 242 bp, Homo sapiens
agtagaggtggggttttgccaccttggccaggctggtcttgaacacctgacctcaggcaatctacccactttggcctcccaaggtgctgggattacagacatgggccactgtgcccagccccattttctatttcattgctttctgtttttattttttattatttcctttaatcctgttactctcatcagtaaccattgtttttagattctggtttatcttactattgtttctttttgcaaaa

SEQ ID NO: 98637 - DNA, 252 bp, Homo sapiens
cagagaacatgcatgcccctgctcaccctggctgggagcctctttcctacctaactgtgcacccgcagcacctgttacacttccttcagcaacagcagcccaagaaagctatggcaatgacaccaaggatgttctacataaaaaggcactggcctaaccctacctgctcatggtagaaaaagagaaaattatgtatgcttccctttagaaaatctatgtaataataaactaacgtgtgttgagatttcctga

SEQ ID NO: 98638 - DNA, 376 bp, Homo sapiens
actttcaaaggtccctctggttgctgcatgatggtctaggggtaccagggtgcaagggaaagacaaggtgacggcagtgacctgctgcaggggtggccaggaattggcagtggcaatgaggcagtgggacgtgctcagatctggatgtgttctgaaggtagggctgtcaggatttgcaaaccaaatgggcatggagtgagaggaagagagaagcccaagtgagtcagataattggtccaagcgaacagaaggatgcaggcaggcccaggcacggtggcccaggcacggctcacgcctgtaatcccagcactttgggaggccgaggcgggcggatcacctgaagtcaggagttcgagaccagcctgaccaacatggt

SEQ ID NO: 98639 - DNA, 340 bp, Homo sapiens
tctcacccagcacacaggttttaaaatcgccttctgtactggccactcggtggtttctgtactcagcctggcccttcctccttaaggccagatgtctcagactgactccacatgagtttccacttagatgtctaacaggcatgtcaaactcaaatgaccaaaaatgagctcctggtttccacctgcacctgcttttcttagggttttccccatccttgtaaatggtgctttcattattctagttgctcaggccaagaaccttggaggcatttgtgattctgcctttctgcgattcataccccagtttgtcaagaattctgttggctgtatcttcagagta

SEQ ID NO: 98640 - DNA, 211 bp, Homo sapiens
cctccagggacaccctcccagcagtgtgcttggctcccacatcagcccttccctcttcctggggcgcctgcccatggctcctcccaccctgagcatagcctcctggacccacctctgcccccatttatagcacgacttcccgaccccctctcttttctccccatttcccttgatccgtctattgcatgaggcttctgcggctggcactgac

SEQ ID NO: 98641 - DNA, 1735 bp, Homo sapiens
ccccgcttccagtcagagttcaagttaaaacagaaaaaaggaagatggcaagaatattgttacttttcctcccgggtcttgtggctgtatgtgctgtgcatggaatatttatggaccgtctagcttccaagaagctctgtgcagatgatgagtgtgtctatactatttctctggctagtgctcaagaagattataatgccccggactgtagattcattaacgttaaaaaagggcagcagatctatgtgtactcaaagctggtaaaagaaaatggagctggagaattttgggctggcagtgtttatggtgatggccaggacgagatgggagtcgtgggttatttccccaggaacttggtcaaggaacagcgtgtgtaccaggaagctaccaaggaagttcccaccacggatattgacttcttctgcgagtaataaattagttaaaactgcaaatagaaagaaaacaccaaaaataaagaaaagagcaaaagtggccaaaaaatgcatgtctgtaattttggactgacgttttaagaatttgttaccttacagaagagcaagggcttaggggttggaggtggcagataaaagaggattttcaactcaaatcttgtttcctgctggcctggtctgcccacgagctagagcggggaaatgttgagctcaaatgggtaaattgagaccagaaaattattttttcaacctagagaatctcctcttacagggggatgcatataacagatcatgtatgtgtagttatttctaagtagtaattcttcccagctctttgatttgccatatataaaataggtgggtcgtatgtcttccctttagacatgatgttttctactcatttgtctctctggccaattgaattattaataaaaggtctgtattatcaaagagtattctagtatttttgttacttttaatatttgatgccttttggaggtaaagctgttgggggaagaagagtttttggacccatagatgtttggatgatgtctctaatttgtcatttagaaaaatctcaaaaatgatttcagttgaataacttgccttctaaatgatcaatttacttctcccccaattttaaagaagtatgtgtatatttaataggggaaggtagtttatggaaatatttttaatggaatagttttcccttaatatgtatccttgctggatattattcaagctgcaagtcatcaaaagacccagaaaaaaaaaagtctgtaggttattttctctacttctatttcaactttgaatttcctcttcctgtgcaaattcctctagtcaagtgtgatatatcaagaaatctgaggaggatgcaggttttgtggtcctgatgggcccacaagtttttctatatttaactggaaatatgctttgattttgtgttattaatataattcttttgatgtagtcatgagtttttctttgtttgcatataattaaaatgcctctacttaatgtcacaattctgagttttttctaaaacatttttcaccttagagaatgaaagtgtgggggagttgggaatgaagcttgtttttcagttctctgtgatctggacatcccctaagcatgaagaagagagcagaagagggcatttagggtgagccacagacttggcccagggtcattttttagctctgtcagctgtgattttgggtgaatatctttttaccaaattcttatgtaggtcggtcaagtaaagtaccaaaatgcaaaac

SEQ ID NO: 98642 - DNA, 847 bp, Homo sapiens
ccccgcttccagtcagagttcaagttaaaacagaaaaaaggaagatggcaagaatattgttacttttcctcccgggtcttgtggctgtatgtgctgtgcatggaatatttatggaccgtctagcttccaagaagctctgtgcagatgatgagtgtgtctatactatttctctggctagtgctcaagaagattataatgccccggactgtagattcattaacgttaaaaaagggcagcagatctatgtgtactcaaagctggtaaaagaaaatggagctggagaattttgggctggcagtgtttatggtgatggccaggacgagatgggagtcgtgggttatttccccaggaacttggtcaaggaacagcgtgtgtaccaggaagctaccaaggaagttcccaccacggatattgacttcttctgcgagtaataaattagttaaaactgtgcatgtctgtaattttggactgacgttttaagaatttgttaccttacagaagagcaagggcttaggggttggaggtggcagataaaagaggattttcaactcaaatcttgtttcctgctggcctggtctgcccacgagctagagcggggaaatgttgagctcaaatgggtaaattgagaccagaaaattattttttcaacctagagaatctcctcttacagggggatgcatataacagatcatgtatgtgtagttatttctaagtagtaattcttcccagctctttgatttgccatatataaaataggtgggtcgtatgtcttccctttagacatgatgttttctactcatttgtctctctggccaattgaattattaataaaaggtctgtattatca

SEQ ID NO: 98643 - DNA, 900 bp, Homo sapiens
ccccgcttccagtcagagttcaagttaaaacagaaaaaaggaagatggcaagaatattgttacttttcctcccgggtcttgtggctgtatgtgctgtgcatggaatatttatggaccgtctagcttccaagaagctctgtgcagatgatgagtgtgtctatactatttctctggctagtgctcaagaagattataatgccccggactgtagattcattaacgttaaaaaagggcagcagatctatgtgtactcaaagctggtaaaagaaaatggagctggagaattttgggctggcagtgtttatggtgatggccaggacgagatgggagtcgtgggttatttccccaggaacttggtcaaggaacagcgtgtgtaccaggaagctaccaaggaagttcccaccacggatattgacttcttctgcgagtaataaattagttaaaactgcaaatagaaagaaaacaccaaaaataaagaaaagagcaaaagtggccaaaaaatgcatgtctgtaattttggactgacgttttaagaatttgttaccttacagaagagcaagggcttaggggttggaggtggcagataaaagaggattttcaactcaaatcttgtttcctgctggcctggtctgcccacgagctagagcggggaaatgttgagctcaaatgggtaaattgagaccagaaaattattttttcaacctagagaatctcctcttacagggggatgcatataacagatcatgtatgtgtagttatttctaagtagtaattcttcccagctctttgatttgccatatataaaataggtgggtcgtatgtcttccctttagacatgatgttttctactcatttgtctctctggccaattgaattattaataaaaggtctgtattatca

SEQ ID NO: 98644 - DNA, 703 bp, Homo sapiens
tgtgtgccacatgatattttttattaaattaaaaacatttaaatatgcatatttaggaatgcttataaatacaataacactatataaaaaggaaagcaagggagtggggattcaggttgatggctgcctggcatgggaggagttagggcatggtacgggtaggggcctaatgtggtaggtttatgggtgcttttaatactttaaacaaatggttagctagctagccaggcagcaaagtagacagctctgactgctatgtgaagaatggatcaaaggagtagaagctggagcaggatgaccagttaggaagatgtttagtatccagatgaaggagggtgaggcattgttctcgaatggtggccattgagatggagagtattgaacagaatcagaatctattctggaggtaatggagaacttgctctgatgacttagatgtgggaggcaaggaatattctattgtacaaatattccataattaaactctgctcttatggtatatctaagttgtttacaatattttttgctccaataaaggtctaaaatgaacatccttgtaccttaatcttcatacaaattcaattaatgtctttcttttttatggtgtgtgatgtgatccaattttattatatttaagattgtattttttttttagagcagtgttaggcacacagccaaattgaaaggaaggtacagagatttc

SEQ ID NO: 98645 - DNA, 626 bp, Homo sapiens
acattgtcatagggaagtagagagtagggggaggggccaggcatggggaagaggaggggacaaggggaggagtggggagtcttatgaggaggccaggctggttgaaacaaaaaaggggcatttctttagcactcctaaaaactttcccaaactgacctagcaccctcctcatcttctcatgtcagttctggtgagtcacatggcaaggatagggtgtgtcttccaaagcctttctctactgccaacccattcagtggtacattctgttttcttccacctttaaccattatctagttgttgcatgtcttacctacaatctattcatggtaaaaatttatgctaatatgtcatggccatatttaagtgtctgtggagatgtcaatcatccagttcccacctacaaatcctctaagcattttgaaaaccattaacttcttggcttactaccaagaaacttttttattccacgtaccttttctagtgtccatttagctctcctcagttttctattctccagtctgaaaccaccgccttcagactatgaagacttcagtgaagggctgtacatggtggctcatgcctgtaattccagcactttgggaggctgaggcaggaggattgcttga

SEQ ID NO: 98646 - DNA, 745 bp, Homo sapiens
ttcaagatttgttgctctccatcaaatacaactctcaggaactaagaaatcatttatgaaaaataaaagaagaaagataaaatgaactttgagaatttgaggtgaaggctatccaccttagaatttacagactggaacataccttaagaagaaacacttttatggcctctaagatttatgatctactggtatactgaaaataatcggccgtgggaattcaaaggaagctacttgtagagcacccattgggtgagctaattttattcaagccataaatttcactgaaaaaaatgaatgaaggctgatgaaaaacttcatgctctcaaagaaaagcaaaatcaaataaaacaaaatttgcccagagaacccaatcatcccagagaaaggtaatgtttcaggatcacacagacaaatgccctcatgcagatatcaagaaagagacactgaaggcacatactggtttttcaaagtcaaatcttcaagcccaggaaattgaaacagaagaaatacaaaggagtcccaagagatataggtttatacagagtttcttcgagtggattttgaagttctttgaaaaaaatggcataactgccaggaaaaatacttgtctatctgtgcagattatacttgcaataactcactttaaagtattctattaccaaatgattgattattacttgactttatttcatgataggtataggtcaaagtgcagatgtacatatagatgagcgtgtaatgctat

SEQ ID NO: 98647 - DNA, 342 bp, Homo sapiens
agtgaatttgaactcaggacactctgagtttaaaagtccattctacacttagccgtctcctgttactaaatagaaaaagttcctttagggatcaacaagaatttgttaagtgcctgccttttccatggattactttttaacagaacaaatttacttaattttgttcatttttcttcatgtcttgtcaaaaaatgatttaccatccttatatttcaatcattgacagctgacaagaacaattaaattcttgccaactatagctattttttccttaagatgtggccttaaaaatataaatactgtaaaataataattatttttgtgaaaaagggttttctttgg

SEQ ID NO: 98648 - DNA, 134 bp, Homo sapiens
ggcggcgaggctggcgctgggaagaggaagaagaacattcgccctcctcctaccagcgcgcgggcggcggcggcggcggcaccggggtcacgaactctgacctttcactgacaaaaacaataacaaaccccccc

SEQ ID NO: 98649 - DNA, 490 bp, Homo sapiens
gctatccttacaggcgaaaatctgaaaccatctccagaagacagttcatagcggtgggcctaatattgactggaaattacaccttgacgagttagttttgagtctctgttaacagcacagggtatggctggatggccctcaagactgactgcgacaaattataaagcaacgtcgatgctaacgccagaaacaccaaggacgaaatgcttgagcccctacagaactggcaggaagcagcagcttaggaggctccgaaagatgaaaacacaaagacagaagcacacctagaaactggagggaatccacatggtgtgtttgttaaatgaatgaattaaagagagaataagtagactcagattgccacctggactcaggacatttatagcaacttaatgggctgaagttttgcaaaagttgatcctcagtgctaaacatcaggtccagcagaagggttccccagaggggtgtgggcatgggaggatgagagagg

SEQ ID NO: 98650 - DNA, 280 bp, Homo sapiens
tggctcaggaacacaggttgcatttagttgtcatgtttatttgcttttaaaaagttaacattctcctcgttcaaaattcacatggtgtgggaggatattcagagaagactctgcggctcttgttccccctcctacgctgttcacttcctgagggccaccagggttaccaatttcccatgtgttccccagagatattctgtgttgacacagctagtcatgtatgtactttctccctcttttatgcatacctagtttattctatgctgttctgtactcgctt

SEQ ID NO: 98651 - DNA, 328 bp, Homo sapiens
acaaaggtcttagatgaaatgactacttacaaagataattttccccaaattaatagagaagttcagtgtaacatcgatcaaaattcttgttgtttttgagggactttgataacttttgatatataataaagccccataaatgattaaaccagctttgaaaaataagtgcaaaggagctactaagacattctataaagccataataataaaaacagtaaggtgctggcacaagaatgtgcaaatagaccaatggaacaaatcacatcactcaagacggatccatgtacatgagggaacctgaaatcagatgaggtaccacagatcaata

SEQ ID NO: 98652 - DNA, 318 bp, Homo sapiens
aaggcttctgctccagagcagctgccctgggacaccaagaagacgctgggtctccttcagggatccagggttgcttggatgctgggagccgacctgcattcgctgaaggaagtggagcccagacctcatgacagataattccagcaaaaccagtacctcgcctactgaaaaattaccttcactcatcatctaccttgcttaaactcatcggacatttctcagttttctactccccggtgtgctttaagctttgctataaagcatcaacatctatcatcaccctaacttcttaaatcaattttagtgcctattaaaagt

SEQ ID NO: 98653 - DNA, 1285 bp, Homo sapiens
gaactcttggaatggcataccatttgacctttcaaaggttctccagcagtatttaactgatgcaaaaggaacacacttgcaattttctacttttgacatgacagaccctcctcttagttcacacaatgttcaaaaggcacaagtccctcgcttcggaacgcaagagagcattactttcccaaagagctacacggttcatactgaaggatgatatgagaaattttcactttttgtcaaaacttgtactctcagcgggccctctaagaccaactccagcagtcaaacattcaaaaacgactcactttgagattgaaatatttgatgctcaaacaaggaaacagatatgtattctggataaggtgacacaatcatctactattcatgatgttaagcaaaagtttcacaaagcatgtccaaagtggtacccttctcgagttggtctgcagctagaatgtggcgggccttttttgaaggactacattaccattcaaagtattgcagcttcctccattgtcacactgtatgctacagacctaggtcaacaagtcagttggaccacagtgtttttggctgaatacacaggacctctgctaatatacctcctcttttatttgaggatcccatgtatatatgatggaaaagagagtgctagaagattacgccacccagtggtacacttggcttgcttctgtcattgtatacactacatccgataccttttggaaaccttatttgttcacaaagtttctgcaggacacacacctttgaaaaatttgataatgagttgtgccttttactggggatttacttcttggattgcctactacattaatcatccactatatacaccaccatcatttggaaacaggcaaatcacagtatctgctatcaattttctggtcataaatcacctgccacactttgtaaggagctctcacatgaccctctcttgcttcctctctctctacatatctttagttaagagtttaggtaagaacgtcctccactgtgttggctttgaaaaggagagatctttttttttgtcttttcagcatatagtttggcctagcaagaactcattacttgtttgaatagatagcacagattatttatgtatttggaatttcttcaacaatatgttgaaaatatatcacagccttgtaattttccaattgtgcatactgttcaaggagaggaattctgtgattcacgtgttgtaacagcgttatttaatgttgtatacagcgtactacaacccctgttgtattaagactaatgttctgat

SEQ ID NO: 98654 - DNA, 574 bp, Homo sapiens
ggtttctgtataatgctataatttgattcaaaaaattaaattacataacaaagtcataagaccatgttaaaccataccagagtaatgcaatcgacgaaatccaggatgtagaaagcgtcacagaacaaacagcctggcttcttcaaccaataaattgcaagtaaaggaaacaacaaagagatgggccaatgctatagattaaaagatacttaaaagatacatcaaccaattgcaacgtgtgaagcttttttgggagcctgattcaaataaacaaacagtttatgaaacaatggaaaacaagtaatttatgaaacaatcggaaatttgaatgcagactggatattagatgatattaataaagtactgttaatttttaaatgtatggtaatgctatcgtcgttatgtaaaaataaagaatccttttcttttagagatgggcactataaaattacagatgaaataatatggtgtctgggatttgctgtgaaatagtatgggagagagtatagaaagaagtttgttcatgaattgttgaagttgactaatgagtataccgctctctctttatttttgg

SEQ ID NO: 98655 - DNA, 587 bp, Homo sapiens
aacactatcagaagaaaaagaagaaagcaagtcttaaagcctcagggaggccatttttgcctgaatttgaaatgagggtgggccagatgagtatgtttaagtggagagtgcttccagctgagatgatttgagtctgccctaactgctctattgagttctcgtgccctcatcagctgagagcagggaatggaactttaatgcaagaaccacttttatctactcttttttgtacatgtcattgtttcagttctgatttcaacaaacatgagcaaaccactttgactcaaagcggaaagagtgaaaattctattttgttatgctactggtgttcaattattagtttgtaccatttttaatttatgtcagttgatgcatctgaaaataagtgcttgaagtgttcacacccttactttttttttttaagattcctagaaggaatctttggttaattcagattgagcagttaaagtttttgctatttacctttgtgcaggctggcatatgctaatttgggggtggtaaccaaccaattttatctcatttaagcgttacattttgaagactgtgaatatacttcacagtagatc

SEQ ID NO: 98656 - DNA, 543 bp, Homo sapiens
gaattcttgagcatcatgcctagaacagtttcacagatgcaataaaacacgtctatctggctctcaaaagggaggcctcactgggaggtcagacattggttaagtctcatggttgagggtctggtccttgggaatgcaggtttagaaacatctcaatttattcgttggtgggggtaggaggcagaggaatatcagaagaggggaaggggggcaagccttgaaggtgcattcacttcggtaaaatttacatatctcacaccaaataaaatactgcctgagaaccaaactacttacatgtgtctattcagaatattaaaatgcaaattaggtttttggtaagcatagaacaagggaaagttaatattcttaagggatgtttttgcaaattatagcagcataactctagtaatgctgttaattttgtataaatcagtgttttccaagtttatttgatcacagaacacttgttatcaaaaatatcttttaagaccttgtaaaagatcttggcaaattcctataaaattaacaggaaatttacaaaag

SEQ ID NO: 98657 - DNA, 516 bp, Homo sapiens
acggacccgactcatggtgcccagcatccctcatggaccctacagtgctggcctgtcccctgcaatggcgatgagccctgggagccatgcacccaggtttacacgttagtggcaggaggacagtccgctgtctggggaacaatatgtttgcctgccccttgtagggggagcgagctctgttttctccctcctgtaattgttaccatctgtttccctccatcatgtttgttgatgttttcttgttttaaaactgaaatgagtcagattggaggctgatttaggaaaatgtatctgggaggaaagctcaaagtggccatgggggactctgtgttctggagtcatcggaaaagaaaagattctgtggggccagccgaggggtgtctgccagctactcctgccctgtgggggccggagtccccccgcagtccaagaaggctggggctgtgtgggtttctgtggaatgcatgtgtgtgggctcagttatgtaagtaggtgagtggacatgtgcacacttgt

SEQ ID NO: 98658 - DNA, 360 bp, Homo sapiens
aaggagataattgacatacatgtatatacagacttatgtatctgtatataaaagaaatatcaaaaataaaaatggtacaaataagtctaccctcactacctctcccctccgccacaatcccacttccacctgtgttagtactgacatcagtttgctagtggtttgctttgatttataagtagtatgtacagcatgttgttcagcaccttgctttccccgatcccatttaaaatccattttagacatctttctatgtgagtgattactatacatttcttggtatctgattcaaatgtctctatcctccataaaaaaatctaaaattgttgcttacaaattattttttttccagtttccatc

SEQ ID NO: 98659 - DNA, 340 bp, Homo sapiens
gtgaggtgtgtggctgccctgtctctgtataggtagacacaggcccacaggtgcagtggccatattatcggtgcgtgtttactcccatcgcatgtaccattcctctcacaaacacctgcttcctgatcatttgtctttttaaataaaaatatgatatttgagattcttttattctctttaaatatttgaatacagagtctatttgaaggaccagtatattgaatagcagtaatatttgaaggactagtcagctgtagaagccttgacttcagatcttcacccaagaaactctgtgtatttgcttttcctgggccactcagatagacaattgtgtttttga

SEQ ID NO: 98660 - DNA, 1188 bp, Homo sapiens
aaaaaaaaaaaaaaaaagaatcaccaaaataaaaaatagtaacaatactattgtcaaggatgcaaaggaactgtaccactcaatcactgctgtgagaatttaaagtggtgcagccactctgggaaacagcttggctgtttttttttatgactgaatgtgcaactactatatgatgcagtaatttcatttttgcacatttatcccggagaaatgaaaacatatattcacacaaaacctgtatatgaatgctaataaaagtcaattggccaggtgtggtggctcatgcctgtaatcccagcactttgggaggctgaggcagtggatcacctgaggtcaggagtttgagaccagcctggccaacgtggtgaaaactcgtctctactaaaaatacagcaattagctgggtgtaatagtagccacctgtaatcccagctactggggaggctgaagcagaagaacctcttgaacccgggaggcagaggttgcagtgagctgagatcgtaccactgcactccagcctgggcgatagagtgagactctgtctcaaaaaataaaataaaataaataaaaagattagataatctgcaaagttcctgtgagcgctgtcattttgtcactctggtttttcagattcttcccctggaggctggagtttccaggatgtcaaaattacctctgcttgggtgagctatttcaagcagctgggatacctgtgtcactcctgctgtctgccagtgactgcccaggtgtctgctggttcctccccaggagtagggaggaaccaggtgggctggctgggatgggtggatatttaaagaccaggccttggacgctgcagcacttctatctctgcttgatgcctgctgccacgtggctggtcctcctcctcctgctgtggctgagccttggggtgaagacaggtgaggagctaggctggcatctgtgctacaggtcaaagagaccccagtctctgctctctcattcattcaatcaattaatctgttttgtctctggcatgacccacctcctgtgacccagcattcattaattcattaatcaaataattcatgtattcagacacttattaagtaccgactatatggttgatgtggcttctttgtgtatccagttttatatctggataagatgtctttggatgatcagcttgggagggtctagtatccagag

SEQ ID NO: 98661 - DNA, 271 bp, Homo sapiens
tagatggcactataaggtatcaatattgaagtggatgagatcattcaggaagagtgtaactagagaagtccaaggactgaatcctggcatgctccaacattttagaggccaaggaggtgagaatgtagcaagaaatctgaaaaggagtgggctcagaggtaggaggaaaatcaggatagtgtggtttctaggaagccaagagaaagttgcaagaatgactgtgttgaatgctgctcagagatgaaggaaaaggagtgagcattcgacacaa

SEQ ID NO: 98662 - DNA, 422 bp, Homo sapiens
aagggtttctcttggaggtcatgaaaatgttctaaaattgattgtagtgatggctggagaactgtgaaagtactcaaaacctttgaattacacactttaaatcagcaaattatacagagtattatatgttgataaagttgtccttttaaaaagaaccattaaaaacataagaacgttctgagagataacaaaagtcctgcctcaaaataaagagtaagtgaacactctttctggagattgctcatgcccctcgcgcctggccctggctgtgcggtccacgcaatgatacccaccgcagaggggctggtgttctcttgggctctgctgtggcttagtcacttctttcagtgtggccaattaagtaatgttttacatgtccatgcaaggagctttacaatgaagaaaaccatttcatagttact

SEQ ID NO: 98663 - DNA, 412 bp, Homo sapiens
ggctgtgggtctaagccacagctttcctggtctgaaacccttagcccaggcaaaggagaggcaggcaactcaattaatcctccctggagacctccctctcctcagttcattttgtgtataaagttgtggtcgggagtgtgacctacagtcaccaagaatccacatggaggccctagggtggtatactgataccaccaaacatccacaaacatcaagaccatacagaaaatcacgacctcaacaaagggaccaaaaatcatgacctcaacaaagggaccaaataaggcaccagtggccaatcctggagagagatatgtgacctttcagacagagaattcaaaatagctgtcttgaggaaactcaaacaaattcaagataacacaggaagggcattcagggtggtatagggtgg

SEQ ID NO: 98664 - DNA, 263 bp, Homo sapiens
ttttccctcggtgcccatgcgaatctgttttctgaggctctttggatcattttaacaaaacctaggtagatgccatgtctcttctgatcactcagaaaatataaagtcctctaatcacttttagttacaaaaagcttgatttcggtattcaaaatattctgaagtaatagttaaagcgccaaacttcatttaaagtttatcctctcctggctcaggctaaggaataggttgctagactgcagagtggaaagggcaacgttttt

SEQ ID NO: 98665 - DNA, 706 bp, Homo sapiens
aaatggaaatttaggtcagctaacatttctgaatgttatttaagggatcactgaaattattgaaaatgtgtttcatatttcatcatgcaaatgtcaaactcaatttctcatttatttatttacagtaatcttcccaatgttacttgaatatctgtcatttaataaagttttactcccctcacatttctggttctcaacaattgaggtaaatcactatatctcatgtccttgaataaactctcacacacacaaatatgtatgcacattatatatacataaacacatatcgtggggactaaatacatgtaagtctaagtatttatgactttttttccctctcatgcctttttaaaaaaatgtatgatctacaatgcattatgggtgaagatacaaatggcagaagtaccggagcccccaactgccttacagctttgtcagggtgaccaaagagcaaaagatgttatacaataagaaaaaggagtgaactagcatagatgggaaaggcagttaagggaaaaaaaatgaacaaaaatgtaatttaagggaacttttagaaacttttgatgaaggttgtgtgctgtacttcctttgatataatattcttcaagaaaacctggatttaaaagtttctgcattcttcaatgttttcagagtcagagtttctttgcatgtgtcaccatgctgacattggacatggcataagaaa

SEQ ID NO: 98666 - DNA, 590 bp, Homo sapiens
ctcttcctcaaacaaacacacaaactaacatttattattttgaatatgaagagggaggagacactgagaagaaaattaaaaggagaaaaggtgaggatattgaattggaaaaagtattctaaaaatatctgtactaactttaaaatgggggtgattttaaaaaatgaaaaatccctctcctttatacacatatcgcctgtgtgatagaaaaaaaacccctaaaatttatataatttcattctaaaggaaagagctttgttgctctcgccttctagttatcagtttagaaatcctgctccattagggttggaatgttaaaaccaagaaaatcattgctgccttttcaagagttgagactttagctttacttttctatgagtctttatttatcaaaggtattctcaggaggtaatgatgaacctgaaactgttccagcctgtgctgaaatactcccacaccatgttgttggaatagatgtaagcactctttgtaaatccatgccagaaagttcttcccatttgaagtttttgccatcagattaagaggaggaaattcccatctgttcagaggcaacagtgaccaaaaaaaaa

SEQ ID NO: 98667 - DNA, 251 bp, Homo sapiens
tctggttttcggacatagcaaatacatgatcacatatcctcagggaccagtaactgatatacatttatagtgtatcagtgtgtggttacgtgtttgatgactagtccttttgtgaaattagttggtaatgtagcagtgtggcatagtggatgttagttgttaaaactgaaaagtggttcattaaagacaatttgtttttttgtgataaaattgtgtaatttttttagggttttagtctgaggatacaagag

SEQ ID NO: 98668 - DNA, 200 bp, Homo sapiens
caccattgccatgtggcccatgtaatgatgggaagatatgtgggctaaaggggaaagagggagatatttgtcatgtctacctgctcatggctcctagacaggatcctttctttccgcctattctagacaagatggctatgaaaatgtttatggttttggttgaattattttaaatttgctggggaaaggccattaaacac

SEQ ID NO: 98669 - DNA, 990 bp, Homo sapiens
tcctccttgaaactgatggcttggaaggcaaaggatttgcttgtagacagtacactttctcctttatatcaggaataatacatctttcttctgaaagtgttggttttgtttactgttttgggagaattctatgaaagtagatgatgttctctatgctttcctaagccttgtcttgtttaatcctcacaataccctcacataatggggtaaaatttatatttcacagacaaagaaatagcagctcagagaatttgaacagactttccaaaggcattctaagaactgcaagagctaggattcacacccaagccttctgcctcctgagccctcgctcttcccaaggcattaggcaccctttcattatttccttaatcatttacccattagtctgatcttcttgccaaaccaaacacctcattgttcagttttatgattaaataaaatttcttgaatagtaattggatatttggctcctggtctttaaattttatgtactagtttttgtttatttttgctttagcaggtttttacaaatttgtatcagcaggacatacaaattcttttgtaattggagctttggtttttatttctttaccaattattcagtttctttgatacatatccaggactgtaaaatatctacttttaaaagtaacagtgaggcaggacttatttcccagtctcaattgataaagtgaaaaaactggcagctgggcgcggtggctcacgtctgtgatcccagcactttgggatgtggaggcaggcagatcacaaggtcaggagatcagtaccatcctggctaacatggtgaaaccctggttctactaaaaatacaaaaaattagccgggagaggtggtacgtgcctatagtcccagctacccaggaggttgaagcagaagaatcacttgaacccaggaggcggaggttgcagtgagctgggatcgcggcactgcactctagcctgggcgacagagtgagactcaatctca

SEQ ID NO: 98670 - DNA, 493 bp, Homo sapiens
atgcaggagagagcactggggttttgtgtgacttaacaatgcacctggcccagtgctgtgcacctgctaaagccctgaaggtctgttagataggaaggctgggtggaggttgtttaaaatagcctatagttatttaaaaagtggcatgcacaggagagggaaatctagaagagggattcattgaattgaaagttgttatatgcagtaaaggatgttggttgtatcagagtctttctttcttcttttcctcgtttgtttaaaacataaaagggattcctctgacctaccccataggtagaaggactttaagtttcacgagcaagcctaactttcaattccttttgaatgagctatgtgacatttactcactgggtacgttccccctcctcagtgactgcaatttgaaaccctgggggtcttttaaaagcgaacagaactctgggccgtgttaatattcagagctgtttacaatggatgcagtttcaaaggctga

SEQ ID NO: 98671 - DNA, 594 bp, Homo sapiens
gacataaatgaccagacacaagatccactggccatgtgagaaacgtttcctgacatccaattcccagggacaccctcttatcacaggctctgtggctgctagaggtaaaggctcatttgggcttagaagctaatgctcttccccagtctaaactgacttcgtatgatctcacataaatctaagcataaagccaggacaacttcttcctacctaagtcagaagagagatgatgatttataacctgggtgggggagaacagtgagccacttcaccaccttcaggatgatccaactatttcctcactctctaaggtggagaaagcgtgtagaggccacgtgctttatacgctgaaggctatttaaaggattacaaagaatgtaaagtcatctgtgatatggctttcgagttataaatgtcaatggcagttaagtctgctgctctgggaactcctccaacaacaggttgacaacagcccaagccgacggctctggaggaggctgacagacagctgctctttcggtagttattcctgagagcgccaagaggcctctccaaaggcagctaggtatattacatgctggagggggaaagcga

SEQ ID NO: 98672 - DNA, 346 bp, Homo sapiens
ttgtgttattttctttggttttacagctgaggaaatggagtcctagggaatcatattacacagatctagaaagtgctgagaacacattttaaaggagaagggcaggacgtttatgcaaactgcttgtacagtctttatgtcttgttatcccccacagtagccttgtgagattaagtggtagtagtagtgatactcctaattttagttaaaggaattgagatacatggggataaataacttgaccaaggtcacactgcaaaggggcagctgctagaacagtctgattccaagttgcttgcacttagtcttggcaaagaaataataaataccgtatttccccccaaaa

SEQ ID NO: 98673 - DNA, 356 bp, Homo sapiens
cctctggcttttcaaggtttggtaagagctaggggtcccggtgctcctctggcttttgtaggtttggaaggaggggatccatctggcctcactctgcctcacccattaaatgctttgcccataggaaagtctgaagataacaccagcatgggaatttatttaaggggtgggaaccacaagctgggacaacctttgcccaagcaggaagcttataaaattcatctcagacagagggatggcaggctgctgccgggggtgggggccgccctcttctcccacccacccctgctggcatcagcagctgcaacagaatcctcctcacacctggtgcttatttataaactacccccttgcct

SEQ ID NO: 98674 - DNA, 864 bp, Homo sapiens
agttcagtgcaggtctgcaggaagggcctgcctccactcatgcaggtacctgggatcacctgtccattggctacactgccctttagggcctccaaatccccagctgaattattcccatccatctagtaggaaaggaaaaaagaatgttgaaggatcatgcaaaatgttttaggggccagtcctggacgtaaaatatgttacattggctagaatgctgttacacattgccacctatttcaagagatgctgagatttggagtcttcttgggtgcccagagatttgagtatcacctagcactgtttctgcttcagggaaatggaagtagaactctgaagctaaatcagaggactccaagcaaatgaagtgactgaaagcaagaatggctcattgcccttgagctacacagaaatgtataggtgggtgtattgggtcggttccctggaagcacaacctcagatggggattcttgtgcaaaagatacacggaggaagagctcaaggaagtaacttgcaatgaagcaaggggagcaagctggagcaggagaaaagatcaggcaaaggcatgctttcagaagtctagcctcggcctcatccacagggagctccagagagtgaatggtaccatgcagctggtcaaccttcttggaggagggagctgctgatagccttcagtagacagcacttgcactagccaagggatgagtgcaccagcccagtggaggggatctgggtagagcacctatgccatctgctataatagactctacgtgtcttctaggaaggacatgcttttccttttcgtatcctctacctgaagcaatatatcacgtactcagcagacgctcaataagtgtttgagaaatg

SEQ ID NO: 98675 - DNA, 234 bp, Homo sapiens
ttgatgcagtgaccacaaatttcttaacactgtataagtcttaaattaatcataacccaacctccgcaaattctgtagaaatagcctcaaagtaggtaatgcagttgggcgtggtggctcacgcctgtaatcccaccactttgggaggccgaggcgggtggatcacctgacatcaggagttcgagaccaggctgaccaacatggagaaaccccctctctactaaaaatacaaaa

SEQ ID NO: 98676 - DNA, 441 bp, Homo sapiens
gaccaccctcccacccaccattggatgagaaaacttttactatgactttagaatgtctcctgttctttaaaaagtatctttattttaaaattaatttttctaactgaagaatattttaggggaatgacttaaatagctataaggaaggatatatttataggggctataaatgcatcatttgtatttgaaatttctagcatccactacagtgtacgaagtgtattttagatggactggtaaaaaccagcagttgcaactgtctgttttgcattccttatgctctgcatctggccacacgtgacttgaacagctgaagcttctctttccaaagctagagccatcatcgtatttatgtctagcctgagatgttttccgatggtatacattcgaattgtaaagcagtgtaatttgtggctctcaacatgccttaaaagtcatttc

SEQ ID NO: 98677 - DNA, 499 bp, Homo sapiens
cacatctcagtgaagtttttcagaatgtttctgtatagttcttgtgtgaagatatttctttttccaccattgcctcaaagcgccaaaaatgtccacttgtagatactacagaaagagtgtttcagagttgctcttgtccgattgcttctgtctagattgtatgtgaacatagttccttttctaccataggccactaagtgctccaattgtccacctgaagattcttcaaaaagtgtgtttccaaactgctcaatcaaaagaaaggttcaactctgtaacatgaagacacacatctcaaagaagtttctcagaattcttctgtctagtttttatgtgaagatattacattttccaccattgcctcaaagcgccaaaaatgtccacttgcagatactacagaaagagtgtttcaaagtggctcaatcaaaagaaagtttcaactctatgagatgaatgcacacatcacatagaagtttctcagaatgcttctgtctagtta

SEQ ID NO: 98678 - DNA, 413 bp, Homo sapiens
ggcctctcctactttttgtagttgttgttgttttaaaccatcgaaaatatgttttggtctaccccgtgcatggtatggggatataaagaagtagaagactagttcctgccctcgaggtccaaacaaactaatactgaggtactgttacaaggcagtgtttgatttgttgtctaatgagtggttaaaacagtaactgctttgactctaaaggaaggtaacatcatcagaggcatattaagtcttttcaggaaaaggtgagacttgagtattaccttaaaatcagtgattctcggcaggacgcagtggctcatgcctgtaatcccagcacttttgggaggccaaggtgggtgaatcgcctcaggtcaggagttcgagaccagcctgaccaacatggtaaaaccccatctctacta

SEQ ID NO: 98679 - DNA, 279 bp, Homo sapiens
aaaaagcgtggatgacatctttctatattgtgcagtgatcttctggatatacttactattaagtgaaaaaagcaaagcagggaaatgtgtattctactgtttaagaaagaagagaaatgttggctgggcacagtgggtaatcccagcactttgggaggccgaggcaggcggattacgaggtcaagagattgagaccatcctggccaacatggtgaaaccccgtctctattaaaaatgcaaaaattagctgggcatgttagcgcatgtctatagtcccag

SEQ ID NO: 98680 - DNA, 163 bp, Homo sapiens
atgcatatcctccaagttgacagtccctaaagcaacccaactttcctttttctatgttcattgcctaattttttaggctatttcataagtatccttgtgaattcactatcaacattcagtatcagtgtgacctgcactccactgcactccagcctggacaaca

SEQ ID NO: 98681 - DNA, 474 bp, Homo sapiens
ttgacctatcttcactttttacatgccttcctcactaagcttaatcattcctagttttttatttaccagcgagagatatgtgactcctttttttcacttgaacactttttagaggctattgttgggttataaattggtcctaacttcgatattgttgtgtcctaacatcccatatggtccttagggaacagggaggcctgaagagagcaacagagatgggggaatgcccacttgctcaagcagtcagaatacacacaacattgataatttaagttagccatcttatatgagcatagttcatagcatcccaaaacaattacaatagtaacatcaaagatcactgaccacagaacaccgtaatagactgaaaagtttaaaatattgagagaattaacaaaatgtgacacaaagtgagcaccacagacttgctcacccagggttgccacaaaccatcaatttgttaaaaaaaaaaaa

SEQ ID NO: 98682 - DNA, 258 bp, Homo sapiens
acaaatgacaggtggctgctgacagaataggaggcaggaagaagatgagacctgcctggggtagtgcacatgttttgttccagccaaacagtcagatgaggtcttggtcttggacccgctgccagggaattcacaagcccgcttctgctgtggcctgggagctgaggtctttggttctgaaaccaaatgtaaattttggactctgaaatgcctgtctgtttagccagtttctctataatggtgattccaggaaaggaa

SEQ ID NO: 98683 - DNA, 451 bp, Homo sapiens
  misc_feature (62)..(62): n is a, c, g, or t
tatttgaaatttttataacccaagccctttaaagggacaagtcctggtcggccttattatanggtatcaacaattggcctcaaatgggaagagccagttgttgtagactgaattgtgtctctcccccaaatccatatgtagaaactctaacacaccatatgactggatttggagatcgttcctttaaagagatgattaaagttaaatagggtcataaggatgggttcttaatctgataggactagtgtccttataataagaggaagaaacatcagggatggacactctcacttttttaaagatcacatgatgacacagcaagaaggaaaccatctgcaagtcagaaggaggcctcaggaggaaccaatcctgctgtcattttggacagctgatcttggactttcagcttccagaactgtgagaaaataaatttatcttgctccagaaacac

SEQ ID NO: 98684 - DNA, 290 bp, Homo sapiens
aatagtagtacattcacggccactcatatccacaacacacaaacaaaaaacttttggtggactgttcacaatatgtgcctaaatcttttcagaggacaactttgactttcaagaggagattccaagtgacatcttgaaaccacctcaccagaaccattggagcacctgtggcctcggcacactgcttatcacttgaaaaatggaggaacaagtgttatatttatctgtgtgtctgacagtgtgagatgttagaccgagagaaaagcaaacaaataaatcacttaatcttg

SEQ ID NO: 98685 - DNA, 2660 bp, Homo sapiens
agccagcaccagtatgcacagcccccggccccagagacccgggaaggagtagggaggccgggccgtgcgcggaggagtggccgctgggttggaaacccggcccggcagggagcggggaaggcgcgctttcccggagaagaggactgtcagaaggacgtagaaggcacggttttactgtgaggagcaaagattctttacctacgcattttacaagaaatgtgcagaaagccattgataaatatacctgcaaatccttgtcatccttttcctccagcggaagccatacacccacgggagcccacacctcttggtctgggtcggccacacagagctctaccaccggctcatccacggagaggggctccgtttattcctggagagatgacgaatttgacgaagccagttcacagtcagtgcagcggttactctgggaggtggaggaaatgttatttgaagggaaagtgaaccctcagacccagagtctgctggccgaatgcggggagtggacaagaagatccctccatttgagagtattaggaagacagctgatcctgcccactgacgaaggcgtccagcatttccagggcagcactcctgcctccgcagtccacagacccccgctcagtgcctgcggacacagcagcaacatcagagagttgtgcatttctggctctcaaatagtcccagcagcactctcagcctctgccctgccaggccctgatgacacaggggttgctgacctaacggcacgttcatccctggaagaagaggtttaccatgtggatggaaagattgaggagtatttcgcttttgacagaaaagaggatgatgatgaatgtcttgaacaaaaaccagctcagcccggtaggaaatggcgcgaactcggacttcctcctgtttccccgcgtgactgtgtcaaagatgccgtggcagcagaagtgtttgatcacgtctggacaaatatggtagaacttttggaagagctgattagaaaacactgggaaactacactcacagaagggaaaaaacagagagaaacattgaaagtggctggaaacagatttccgcacgtcctcgttccacgcgctcacgccgatggagccagtggccccccgtccggacacgccgaggctcacggcatctccctggcttctcgtctgaacccgccccagattcatcacttctccagcagtttttatagtgacatgaatggtgtcatgacaattcaagcaaaaccgcttcagcggagacctgcctattttgctgacagaacgcagaatgagaaggaggacaaagcatcgggtggaggggcaggtgctctctcctccgcaccgcacagactgggacgggcctcagacactcatggattatcaccttctgcaaagaaaacaccagtgccctggaggctgccttctcttgcttcagattcacagagactaaaaactcccaacatctatagtgacgaagttcttcggggaacaaaactgccgactggcgtggaccacatggcttccccactggttcaaacgtcacggagcaggttccccccgctagtcacggagaccagggggcagaatacagcagttcctggatgccgccttgtttcttacagaggaaggcatctacaaaaccgtgtgttgagtgccatgcctgacggtacagaacgatcgcgtcttcgagaaagaacagccaccctggaacggttgtcaaggcccagcacaacccacacgttccggcagtcggatacgcctcgaaaaagttcattgacacaaatggaatttgctgctcacacatggacaggtcaaagtattttgacaggtcagcttttctccatatgtaaataaagtgatgtagtaagtgagatttcaagtttcagacagtgaaatggaagatgatctaccttgataagcctattttgctgtaggagggaatagcaaatgtttggggcctgtggcctgacctcagaaacctcgatcacagagcacacctgcagagacttacttacctgctgtgaggtcaagaagaggggaatgtccaaaagctctcaatgaactgggggcctcactcaaaaaaaaaaaaaaaaaatgctgtcttaggagcagtgagtacctctgtctgctatagcgttttcatgctctatttctaagtgaaactctactctcagattctctttgaaaatctgatgataaaaatgcttgagaaaattaacacagatttgctaattactttataacacaaggttttacagataaataggtattctcagcctggtatgctgtttgcaggatattctagtttgaatacgggccagtgatgtttccagttccagaacagtctccaacactgttttcaaggcgttagtgtggcctctggagtctgacgttggatttccaccctcgctctgccaccggctgtgcaaccctaggaatgtcccaacctctctggccctcagcttcctcttttataacaagcagggtacataaaatcattattggaaaactgtgaaaaggatctagctagataccaggcatgtattgctcagaaatgatgaattatgaaccatttgtattataaataacctgaaatttcagggataatttattgttttacagggaattttaaacatataattctaaaaataaatttcgtaacatgtaagc

SEQ ID NO: 98686 - DNA, 1431 bp, Homo sapiens
ttatcacagcactcgcagctgagtagctcacaggatttccttcccaggaatgagaaggaggacaaagcatcgggtggaggggcaggtgctctctcctccgcaccgcacagactgggacgggcctcagacactcatggattatcaccttctgcaaagaaaacaccagtgccctggaggctgccttctcttgcttcagattcacagagactaaaaactcccaacatctatagtgacgaagttcttcggggaacaaaactgccgactggcgtggaccacatggcttccccactggttcaaacgtcacggagcaggttccccccgctagtcacggagaccagggggcagaatacagcagttcctggatgccgccttgtttcttacagaggaaggcatctacaaaaccgtgtgttgagtgccatgcctgacggtacagaacgatcgcgtcttcgagaaagaacagccaccctggaacggttgtcaaggcccagcacaacccacacgttccggcagtcggatacgcctcgaaaaagttcattgacacaaatggaatttgctgctcacacatggacaggtcaaagtattttgacaggtcagcttttctccatatgtaaataaagtgatgtagtaagtgagatttcaagtttcagacagtgaaatggaagatgatctaccttgataagcctattttgctgtaggagggaatagcaaatgtttggggcctgtggcctgacctcagaaacctcgatcacagagcacacctgcagagacttacttacctgctgtgaggtcaagaagaggggaatgtccaaaagctctcaatgaactgggggcctcactcaaaaaaaaaaaaaaaaaatgctgtcttaggagcagtgagtacctctgtctgctatagcgttttcatgctctatttctaagtgaaactctactctcagattctctttgaaaatctgatgataaaaatgcttgagaaaattaacacagatttgctaattactttataacacaaggttttacagataaataggtattctcagcctggtatgctgtttgcaggatattctagtttgaatacgggccagtgatgtttccagttccagaacagtctccaacactgttttcaaggcgttagtgtggcctctggagtctgacgttggatttccaccctcgctctgccaccggctgtgcaaccctaggaatgtcccaacctctctggccctcagcttcctcttttataacaagcagggtacataaaatcattattggaaaactgtgaaaaggatctagctagataccaggcatgtattgctcagaaatgatgaattatgaaccatttgtattataaataacctgaaatttcagggataatttattgttttacagggaattttaaacatataattctaaaaataaatttcgtaacatgtaagc

SEQ ID NO: 98687 - DNA, 2549 bp, Homo sapiens
agccagcaccagtatgcacagcccccggccccagagacccgggaaggagtagggaggccgggccgtgcgcggaggagtggccgctgggttggaaacccggcccggcagggagcggggaaggcgcgctttcccggagaagaggactgtcagaaggacgtagaaggcacggttttactgtgaggagcaaagattctttacctacgcattttacaagaaatgtgcagaaagccattgataaatatacctgcaaatccttgtcatccttttcctccagcggaagccatacacccacgggagcccacacctcttggtctgggtcggccacacagagctctaccaccggctcatccacggagaggggctccgtttattcctggagagatgacgaatttgacgaagccagttcacagtcagtgcagcggttactctgggaggtggaggaaatgttatttgaagggaaagtgaaccctcagacccagagtctgctggccgaatgcggggagtggacaagaagatccctccatttgagagtattaggaagacagctgatcctgcccactgacgaaggcgtccagcatttccagggcagcactcctgcctccgcagtccacagacccccgctcagtgcctgcggacacagcagcaacatcagagagttgtgcatttctggctctcaaatagtcccagcagcactctcagcctctgccctgccaggccctgatgacacaggggttgctgacctaacggcacgttcatccctggaagaagaggtttaccatgtggatggaaagattgaggagtatttcgcttttgacagaaaagaggatgatgatgaatgtcttgaacaaaaaccagctcagcccggtaggaaatggcgcgaactcggacttcctcctgtttccccgcgtgactgtgtcaaagatgccgtggcagcagaagtgtttgatcacgtctggacaaatatggtagaacttttggaagagctgattagaaaacactgggaaactacactcacagaagggaaaaaacagagagaaacattgaaagtggctggaaacagatttccgcacgtcctcgttccacgcgctcacgccgatggagccagtggccccccgtccggacacgccgaggctcacggcatctccctggcttctcgtctgaacccgccccagattcatcacttctccagcagtttttatagtgacatgaatggtgtcatgacaattcaagcaaaaccgcttcagcggagacctgcctattttgctgacagaacgcagaatgagaaggaggacaaagcatcgggtggaggggcaggtgctctctcctccgcaccgcacagactgggacgggcctcagacactcatggattatcaccttctgcaaagaaaacaccagtgccctggaggctgccttctcttgcttcagattcacagagactaaaaactcccaacatctatagtgacgaagttcttcggggaacaaaactgccgactggcgtggaccacatggcttccccactggttcaaacgtcacggagcaggttccccccgctagtcacggagaccagggggcagaatacagcagttcctggatgccgccttgtttcttacagaggaaggcatctacaaaaccgtgtgttgagtgccatgcctgacggtacagaacgatcgcgtcttcgagaaagaacagccaccctggaacggttgtcaaggcccagcacaacccacacgttccggcagtcggatacgcctcgaaaaagttcattgacacaaatggaatttgctgctcacacatggacaggtcaaagtattttgacagaggacaactttgactttcaagaggagattccaagtgacatcttgaaaccacctcaccagaaccattggagcacctgtggcctcggcacactgcttatcacttgaaaaatggaggaacaagtgttatatttatctgtgtgtctgacagtgtgagatgttagaccgagagaaaagcaaacaaataaatcacttaatcttgaacactttgcactgtaaagagagtgaaagtcaaacccaccaagctgccttgctgaaagcatctccaaggttctgtaggctttgttcagaagcccctgatgtgtgtttgcagtccgtcattttatcaatgatacgcaaacataattagcatgtgtatgtactcacacactaattacatgtaagaatatattatctaggaatatgtcatttgtaactttgtactctgacgtattttctagtctcaccctattagtaattctgtcaaaatcctagacgctagtagatattagtatttgagacaatatgtcagagtctgaataagactcagcttgttctagtcatgctgagtttctcatatattttttaaaagtgcttccgccatgaacctctttgagaaatgtcagtggcaaaatctcccaagctaattttctttttctatgttccatcttcaaattcagacagttcacgtgaagtaccccacatttattgatcttagggttgaatataaacgcaattaaaagctatggcaggtga

SEQ ID NO: 98688 - DNA, 886 bp, Homo sapiens
agccagcaccagtatgcacagcccccggccccagagacccgggaaggagtagggaggccgggccgtgcgcggaggagtggccgctgggttggaaacccggcccggcagggagcggggaaggcgcgctttcccggagaagaggactgtcagaaggacgtagaaggcacggttttactgtgaggagcaaagattctttacctacgcattttacaagaaatgtgcagaaagccattgataaatatacctgcaaatccttgtcatccttttcctccagcggaagccatacacccacgggagcccacacctcttggtctgggtcggccacacagagctctaccaccggctcatccacggagaggggctccgtttattcctggagagatgacgaatttgacgaagccagttcacagtcagtgcagcggttactctgggaggtggaggaaatgttatttgaagggaaagtgaaccctcagacccagagtctgctggccgaatgcggggagtggacaagaagatccctccatttgagagtattaggaagacagctgatcctgcccactgacgaaggcgtccagcatttccagggcagcactcctgcctccgcagtccacagacccccgctcagtgcctgcggacacagcagcaacatcagagagttgtgcatttctggctctcaaatagtcccagcagcactctcagcctctgccctgccaggccctgatgacacaggggttgctgacctaacggcacgttcatccctggaagaagaggtttaccatgtggatggaaagattgaggagtatttcgcttttgacagaaaagaggagtaaatagaatcttatttgacattgacctcataaaataatattaatttatttgacattta

SEQ ID NO: 98689 - DNA, 281 bp, Homo sapiens
ctaactaagcccatcacggcgaaatcgataccaccacccaaaacaaaaaacctagttcacaatatgtgcctaaatcttttcagaggacaactttgactttcaagaggagattccaagtgacatcttgaaaccacctcaccagaaccattggagcacctgtggcctcggcacactgcttatcacttgaaaaatggaggaacaagtgttatatttatctgtgtgtctgacagtgtgagatgttagaccgagagaaaagcaaacaaataaatcacttaatcttg

SEQ ID NO: 98690 - DNA, 422 bp, Homo sapiens
attagggagactcgtcatgttttattttatttccagaagaggactgtcagaaggacgtagaaggcacggttttactgtgaggagcaaagattctttacctacgcattttacaagaaatgtgcagaaagccattgataaatatacctggtaagaattcaccttgcttcagattacaaaatcacaaaatgcccgtaacaaatgtgggaaggaagttagtgactggccatgaatttctaaaagtaagatgcagttttatttttaacctagtgtaaacatcacactgtaaaaatatttcaaaattagtatactgtgaaattaataaatatatttaatgaaagaaagaggaagcaggctcagaaaagtgaagccacttagccatccaagcccttccagcaaatgtgatttctttgctcatgttcatt

SEQ ID NO: 98691 - DNA, 468 bp, Homo sapiens
tgggcttgactgtttgattactgacagggaaaaccttagccctctgcctgtggatgattcttcattgaaacagaaacagaaatgatgggtcttttcattcattcaacccgtgcttaggagtatgttctaggtgccagactgttctaggcagtgctcaactaagcacagacaggtgcgttccctgttatcacagcactcgcagctgagtagctcacaggatttccttcccaggaatgagaaggaggacaaagcatcgggtggaggggcaggtgctctctcctccgcaccgcacagactgggacgggcctcagacactcatggattatcaccttctgcaaagaaaacaccagtgccctggaggctgccttctcttgcttcagattcacagagactaaaaactcccaacatctatagtgacgaagttcttcggggaacaaaactgtgagtctcatttctttcatagtaaac

SEQ ID NO: 98692 - DNA, 2045 bp, Homo sapiens
agccagcaccagtatgcacagcccccggccccagagacccgggaaggagtagggaggccgggccgtgcgcggaggagtggccgctgggttggaaacccggcccggcagggagcggggaaggcgcgctttcccggagaagaggactgtcagaaggacgtagaaggcacggttttactgtgaggagcaaagattctttacctacgcattttacaagaaatgtgcagaaagccattgataaatatacctgcaaatccttgtcatccttttcctccagcggaagccatacacccacgggagcccacacctcttggtctgggtcggccacacagagctctaccaccggctcatccacggagaggggctccgtttattcctggagagatgacgaatttgacgaagccagttcacagtcagtgcagcggttactctgggaggtggaggaaatgttatttgaagggaaagtgaaccctcagacccagagtctgctggccgaatgcggggagtggacaagaagatccctccatttgagagtattaggaagacagctgatcctgcccactgacgaaggcgtccagcatttccagggcagcactcctgcctccgcagtccacagacccccgctcagtgcctgcggacacagcagcaacatcagagagttgtgcatttctggctctcaaatagtcccagcagcactctcagcctctgccctgccaggccctgatgacacaggggttgctgacctaacggcacgttcatccctggaagaagaggtttaccatgtggatggaaagattgaggagtatttcgcttttgacagaaaagaggatgatgatgaatgtcttgaacaaaaaccagctcagcccggtaggaaatggcgcgaactcggacttcctcctgtttccccgcgtgactgtgtcaaagatgccgtggcagcagaagtgtttgatcacgtctggacaaatatggtagaacttttggaagagctgattagaaaacactgggaaactacactcacagaagggaaaaaacagagagaaacattgaaagtggctggaaacagatttccgcacgtcctcgttccacgcgctcacgccgatggagccagtggccccccgtccggacacgccgaggctcacggcatctccctggcttctcgtctgaacccgccccagattcatcacttctccagcagtttttatagtgacatgaatggtgtcatgacaattcaagcaaaaccgcttcagcggagacctgcctattttgctgacagaacgcagaatgagaaggaggacaaagcatcgggtggaggggcaggtgctctctcctccgcaccgcacagactgggacgggcctcagacactcatggattatcaccttctgcaaagaaaacaccagtgccctggaggctgccttctcttgcttcagattcacagagactaaaaactcccaacatctatagtgacgaagttcttcggggaacaaaactgccgactggcgtggaccacatggcttccccactggttcaaacgtcacggagcaggttccccccgctagtcacggagaccagggggcagaatacagcagttcctggatgccgccttgtttcttacagaggaaggcatctacaaaaccgtgtgttgagtgccatgcctgacggtacagaacgatcgcgtcttcgagaaagaacagccaccctggaacggttgtcaaggcccagcacaacccacacgttccggcagtcggatacgcctcgaaaaagttcattgacacaaatggaatttgctgctcacacatggacaggtcaaagtattttgacaggttcacaatatgtgcctaaatcttttcagaggacaactttgactttcaagaggagattccaagtgacatcttgaaaccacctcaccagaaccattggagcacctgtggcctcggcacactgcttatcacttgaaaaatggaggaacaagtgttatatttatctgtgtgtctgacagtgtgagatgttagaccgagagaaaagcaaacaaataaatcacttaatcttg

SEQ ID NO: 98693 - DNA, 2526 bp, Homo sapiens
gcgcggcgggcgcgggcgcgggcgcgggcgcgggcgcgggcgggtggggagccccagccccggggccgcgggggcgcgtgaccggctgtctgcgtggggcccgcgcgcggtgcctctgcctgacggtgcccgagcctagcgcggagcctggcgcgggggctgcgagcacaggcccggggctgatcgtaatcggaagaggactgtcagaaggacgtagaaggcacggttttactgtgaggagcaaagattctttacctacgcattttacaagaaatgtgcagaaagccattgataaatatacctgcaaatccttgtcatccttttcctccagcggaagccatacacccacgggagcccacacctcttggtctgggtcggccacacagagctctaccaccggctcatccacggagaggggctccgtttattcctggagagatgacgaatttgacgaagccagttcacagtcagtgcagcggttactctgggaggtggaggaaatgttatttgaagggaaagtgaaccctcagacccagagtctgctggccgaatgcggggagtggacaagaagatccctccatttgagagtattaggaagacagctgatcctgcccactgacgaaggcgtccagcatttccagggcagcactcctgcctccgcagtccacagacccccgctcagtgcctgcggacacagcagcaacatcagagagttgtgcatttctggctctcaaatagtcccagcagcactctcagcctctgccctgccaggccctgatgacacaggggttgctgacctaacggcacgttcatccctggaagaagaggtttaccatgtggatggaaagattgaggagtatttcgcttttgacagaaaagaggaaagggaaaaaacagagagaaacattgaaagtggctggaaacagatttccgcacgtcctcgttccacgcgctcacgccgatggagccagtggccccccgtccggacacgccgaggctcacggcatctccctggcttctcgtctgaacccgccccagattcatcacttctccagcagtttttatagtgacatgaatggtgtcatgacaattcaagcaaaaccgcttcagcggagacctgcctattttgctgacagaacgcagaatgagaaggaggacaaagcatcgggtggaggggcaggtgctctctcctccgcaccgcacagactgggacgggcctcagacactcatggattatcaccttctgcaaagaaaacaccagtgccctggaggctgccttctcttgcttcagattcacagagactaaaaactcccaacatctatagtgacgaagttcttcggggaacaaaactgccgactggcgtggaccacatggcttccccactggttcaaacgtcacggagcaggttccccccgctagtcacggagaccagggggcagaatacagcagttcctggatgccgccttgtttcttacagaggaaggcatctacaaaaccgtgtgttgagtgccatgcctgacggtacagaacgatcgcgtcttcgagaaagaacagccaccctggaacggttgtcaaggcccagcacaacccacacgttccggcagtcggatacgcctcgaaaaagttcattgacacaaatggaatttgctgctcacacatggacaggtcaaagtattttgacaggtcagcttttctccatatgtaaataaagtgatgtagtaagtgagatttcaagtttcagacagtgaaatggaagatgatctaccttgataagcctattttgctgtaggagggaatagcaaatgtttggggcctgtggcctgacctcagaaacctcgatcacagagcacacctgcagagacttacttacctgctgtgaggtcaagaagaggggaatgtccaaaagctctcaatgaactgggggcctcactcaaaaaaaaaaaaaaaaaatgctgtcttaggagcagtgagtacctctgtctgctatagcgttttcatgctctatttctaagtgaaactctactctcagattctctttgaaaatctgatgataaaaatgcttgagaaaattaacacagatttgctaattactttataacacaaggttttacagataaataggtattctcagcctggtatgctgtttgcaggatattctagtttgaatacgggccagtgatgtttccagttccagaacagtctccaacactgttttcaaggcgttagtgtggcctctggagtctgacgttggatttccaccctcgctctgccaccggctgtgcaaccctaggaatgtcccaacctctctggccctcagcttcctcttttataacaagcagggtacataaaatcattattggaaaactgtgaaaaggatctagctagataccaggcatgtattgctcagaaatgatgaattatgaaccatttgtattataaataacctgaaatttcagggataatttattgttttacagggaattttaaacatataattctaaaaataaatttcgtaacatgtaagc

SEQ ID NO: 98694 - DNA, 2578 bp, Homo sapiens
agccagcaccagtatgcacagcccccggccccagagacccgggaaggagtagggaggccgggccgtgcgcggaggagtggccgctgggttggaaacccggcccggcagggagcggggaaggcgcgctttcccggagaagaggactgtcagaaggacgtagaaggcacggttttactgtgaggagcaaagattctttacctacgcattttacaagaaatgtgcagaaagccattgataaatatacctgcaaatccttgtcatccttttcctccagcggaagccatacacccacgggagcccacacctcttggtctgggtcggccacacagagctctaccaccggctcatccacggagaggggctccgtttattcctggagagatgacgaatttgacgaagccagttcacagtcagtgcagcggttactctgggaggtggaggaaatgttatttgaagggaaagtgaaccctcagacccagagtctgctggccgaatgcggggagtggacaagaagatccctccatttgagagtattaggaagacagctgatcctgcccactgacgaaggcgtccagcatttccagggcagcactcctgcctccgcagtccacagacccccgctcagtgcctgcggacacagcagcaacatcagagagttgtgcatttctggctctcaaatagtcccagcagcactctcagcctctgccctgccaggccctgatgacacaggggttgctgacctaacggcacgttcatccctggaagaagaggtttaccatgtggatggaaagattgaggagtatttcgcttttgacagaaaagaggatgatgatgaatgtcttgaacaaaaaccagctcagcccggtaggaaatggcgcgaactcggacttcctcctgtttccccgcgtgactgtgtcaaagatgccgtggcagcagaagtgtttgatcacgtctggacaaatatggtagaacttttggaagagctgattagaaaacactgggaaactacactcacagaagggaaaaaacagagagaaacattgaaagtggctggaaacagatttccgcacgtcctcgttccacgcgctcacgccgatggagccagtggccccccgtccggacacgccgaggctcacggcatctccctggcttctcgtctgaacccgccccagattcatcacttctccagcagtttttatagtgacatgaatggtgtcatgacaattcaagcaaaaccgcttcagcggagacctgcctattttgctgacagaacgcagaatgagaaggaggacaaagcatcgggtggaggggcaggtgctctctcctccgcaccgcacagactgggacgggcctcagacactcatggattatcaccttctgcaaagaaaacaccagtgccctggaggctgccttctcttgcttcagattcacagagactaaaaactcccaacatctatagtgacgaagttcttcggggaacaaaactgccgactggcgtggaccacatggcttccccactggttcaaacgtcacggagcaggttccccccgctagtcacggagaccagggggcagaatacagcagttcctggatgccgccttgtttcttacagaggaaggcatctacaaaaccgtgtgttgagtgccatgcctgacggtacagaacgatcgcgtcttcgagaaagaacagccaccctggaacggttgtcaaggcccagcacaacccacacgttccggcagtcggatacgcctcgaaaaagttcattgacacaaatggaatttgctgctcacacatggacaggtcaaagtattttgacaggttcacaatatgtgcctaaatcttttcagaggacaactttgactttcaagaggagattccaagtgacatcttgaaaccacctcaccagaaccattggagcacctgtggcctcggcacactgcttatcacttgaaaaatggaggaacaagtgttatatttatctgtgtgtctgacagtgtgagatgttagaccgagagaaaagcaaacaaataaatcacttaatcttgaacactttgcactgtaaagagagtgaaagtcaaacccaccaagctgccttgctgaaagcatctccaaggttctgtaggctttgttcagaagcccctgatgtgtgtttgcagtccgtcattttatcaatgatacgcaaacataattagcatgtgtatgtactcacacactaattacatgtaagaatatattatctaggaatatgtcatttgtaactttgtactctgacgtattttctagtctcaccctattagtaattctgtcaaaatcctagacgctagtagatattagtatttgagacaatatgtcagagtctgaataagactcagcttgttctagtcatgctgagtttctcatatattttttaaaagtgcttccgccatgaacctctttgagaaatgtcagtggcaaaatctcccaagctaattttctttttctatgttccatcttcaaattcagacagttcacgtgaagtaccccacatttattgatcttagggttgaatataaacgcaattaaaagctatggcaggtga

SEQ ID NO: 98695 - DNA, 353 bp, Homo sapiens
caccccttttttttggccttattacattagttatttcctcaagaatatttagtgaatggctggtatccttaactctcccacccttctaaggaaagctatcaattgttccccattagtaatgtagcttgccgtgtgtgtgtaaatactctgttattatgccctttgattcacagtttttgtaggtgttccttttaaaaataattgcaagtgctttttctctatctatgtatatgaccataagggctttctcttattaaacatcaatatgatgaactatactcatttcttacattaaaaccacccatattgtcttagaacacaacccacttggttttaatgttattattctttta

SEQ ID NO: 98696 - DNA, 508 bp, Homo sapiens
agacacatgccaccatgaatgccatgttggccaggctggtctcgaacttctgacctcaggtgatccacctgcctcagcttcctaaagtactgagattacaggcatgagcctttgcgcctggcctcacccaagaagcattttatcatctgtgtcaacttcctccagggcctgtgtgggtaactcttactttgcctggccatcctacttactgcacttagaaaaagttttggatgataattgactttaagcatatataaatcagaaacttgatttcatttatctttgtgtccccagtgttgaacattgtgcctgacacatagtaactgcttattaagcacttattgaattataagttgaatacgttggattcatagagtttattgtttgtcctgaagatgtaaaatttttaaaaattcgatccccagagggcgctccagtggcagttggctctcccattttaaggaccagaagtgtttgaatgtcttcctctgatttctttttctttctt

SEQ ID NO: 98697 - DNA, 498 bp, Homo sapiens
cctagctgaagtgtagttgaccattcctgaaacacctgtcaggatacattaaactaaagccattgaatcattattttcatatatatccaatttctgttatgaaacagtactttgtttctaccctaagagctgaaatgtgaagtttagctgactgctttcaaatttggatatccatggaaacccaggtctaggaatgaattgaaataatttttaagattgcttttatttttattattattttaagtgtatttgaacatgcaataattgacatatttaaagtaagcaatttgataagttttagtacatgatacagcagtgaaaccatcaccgcagtgaagatagtaaacctatccctcatccccggggtgtccatgcccctttgtgatccctacccgccaccctccccacagcctcacctaccccccaggcaacaatttatgtctgagactataggttattttgcaatttttaaaataaatgcaaaatctataaaaatgg

SEQ ID NO: 98698 - DNA, 511 bp, Homo sapiens
aactgtcccctgcagatgggaacattctctctattttaatgtttccaaacaacagataggttcacttttttgcaggactgtaaggaggggttcattcatgatttttctttattgctgagagacaaaaaacctagatacctagatacatatatcttacccataagatactataagatcttcgtgaacagaaatgacttatccccataaaagctaagtctattctgtccctattcaatagccaatattaaagatgataatcaaatctatactacttacagctaaaattacaaataggtaaatctaaacgtgtcattgtagtagagccgcctctccaataccatgaactttatttggcttagttgggtatagaaaatagaaatatacagtggcaatgcagatatatatggctctttcctgatggtgttttgaggacagtactatttgtccctgagatctttcttctgcctggctgatctggtagcctgtatattaatttcaacttatttattgt

SEQ ID NO: 98699 - DNA, 350 bp, Homo sapiens
tcattctgccacctttgctatttctataacatgccaccattctctgacatcaaagtcactgcccttgttattccctccacttgaaatcctcttcctcagagagccccatagctagttcctcatgtccttcagaccttgactcaaatgtcagcttcttggtgcactcttctctggccatcccatctgcaatttcaactcaccacctcacacttcctatcccttttccatgctttgttttcttctccttagcactaagctttatctaatgtattatatgttttacttatttatctgattattgtccattttctcagtggaatatgagctccatataggcaaaagattttgcc

SEQ ID NO: 98700 - DNA, 578 bp, Homo sapiens
gttggttgagggttggagcacgaatcaaaagggtgtttggagttgctttaagagggttatgttgtaccaggttcagggactttgttatttttcatcctgggtggatctggaggtctcacagagcctccccaccggctctgacctccccagagagctaaaaccccacaggccccatgaccttgccccctgtcccatcccttcctggtagccagttacaccgtctgctcagagcgccaagttcagctgccagaatgaggattgcacagatcagggctgcagggaacttaaaggtggtctaacccagcaattttcgaactgtgctccttagcaccctgattctcagacatgtcccaggctctctgttggaaggaatgcaataggtctctgggtcccccttcctctgtgtcccctgactccactgcaatcaaatagacagacacatgttttctgtgttagtgttccatgtacttcattctcctgcttaaaaggagctttcatcgatctgctccagccacgccattttacagatgaggacactgaggcctagagaagtcaaatgacttgttttaggtcaccca

SEQ ID NO: 98701 - DNA, 672 bp, Homo sapiens
gagcgatagatgagctaattccttgctacagttacattttagttccatgccctctgtcacatgactttgcagtttctttcactagaggcagggcatgttgtcctgcctctttgatgttaggcctagtcatatgccttgctttagtccatcctgctccaataataagtgctccagttctgatactagttttaagaggccatgtaagtttccacccatcttaattgtgtttcttccattgccataagaaaatcgtgctctagctagatcaggcaactccaggtgaagggtgtcagagtatacatttttgctgtttaaagccactgaattttgggatggttgcttacacagcattgctatgccaatagctaactggtacaacacaacaaatttcactgtgtggcaaactcttcaagagtgcctacccataaacatttctctctttataaacacttttaatagacattttacaaaagatgatatataatgtccaacaagcacattaaaagatgttcaaaatcactgagtcgtcagggatatgcaaaccaaagctacaatgaaatggcatcacatacctactagaatagttagaattaaaaagacaattaccaaatgttggtgaggatatagaacaacttgaactctcgtgcaccactggtgggggtataaaatggt

SEQ ID NO: 98702 - DNA, 375 bp, Homo sapiens
ccctgggcatttggatgctgttgttcctgggttcaaagagtttgtgagtgtcctgtccagtttcatactccttgctttgacacagacatcccattagacctttctttcctgatgtgattgctcttctttgctatgcaaatttaaaacgtgtgaggagaaagctgtgttcatgcatgtgaatatgctgaactcctcctctggtctccctcacatctaccacatccaggaatggaagatcaagcttggtgactattttcactgaaagagacttttcacatcccaagcagaacaggcatctttcctggttaggtgctgttcaagtctgctgtgtgttttaaaccatgttccctgaagctgctttaggtaaatattggc

SEQ ID NO: 98703 - DNA, 296 bp, Homo sapiens
atgctgcgcagttcttgttctcaacacaaattttcgacaaatattgactcatgtgatagacccaatcagggtatttctcgatgcaagtgagtcctctgaagatggctcagttacaaatgagtatgaaggtgccagtgtccatgtctctgccctaaggcactgtcaaatggacttcgctgtttcacccaggggcacacacttgctcccagctatgacaatcaagttctcatccccagatttaagagatgtggaatggagagagagaaagcctggtgtctcttatgaggagtctcaga

SEQ ID NO: 98704 - DNA, 439 bp, Homo sapiens
tgtagatatttattttcccccaagactctaaaaagaggttttgtaagccaagaaaagtttttcctgttaaagaccagagcttttccagcctctacttatctatgaaaacttttttaaagatttgcacacacgctaagaatgaaggatgtaacgatgtatttcatgttgcaacccccaggggatcgggaccatccgattaaccatttagtatctaatattttactgaaggagttttcttctcaggttgctgaacaactttgtttccgtcttcgtcttctctgtggaaatcgtattctacagattgtgaaggtcttttctttttttaattaaaaaaggggtttatatttgggctgaacatgggggctcatgcctataatcccagaactttgagaggccggggcgggaaggttccttgagcccaggaattggagaccagcct

SEQ ID NO: 98705 - DNA, 809 bp, Homo sapiens
cctttttaaggctaaataacattttattgtctgtgtagatcaccttttgttgatccattcatacatcaaaaggcacgggttatttccaaaaccttttgcctatcatgaataatgctgttatgaacatggatgtctaaatatctcctcgagaccctattcccagttgttcagggtatatacctataggtggtattgccagatcatagggtacttctatttttcattttttgaggagccatccctactgttttccatagcagctgcaccattttacatttctaccaacagtgcccaagggttccagtttctccacatcctctccaacatttgttattttctattttgctttattaaattgatgaccatcccaatgggtgtgaggtgtatctcattgtggttttgatttgcgtttccctgtagactagtgatgttgagcatatgtccacatgctgttggccatttgtgtatcttctttacaaaaatgtttgttcaagagatgattcctaattgagagcgacagccccttgtcctgtatccaattgctccataagcttgtagtgcctccttttgtgggatgacccaaaatgcctacacccctttacagcactttgggaggcagaggcgggtggatcaagaggtcaggagttcgagaccagcctgaccaacatggtgagatgccatctctactaaaaatacaaaagttagccgggcgtggtggcaggcgcctgtaatcccagctactcaggaggctcactcaggagaattgcttgagcgaacccgggagctgaggttgcagtaagccgagatcg

SEQ ID NO: 98706 - DNA, 601 bp, Homo sapiens
aacctggaaccctaaggctttttccttttctttttagtgctagaaatctcctgttatgacatttatagtggctttttaaaaaattgtcttcagagtggcttcattgttccttaatcttttggtctgctttttcagaaaatctattacaaaatgaatatttaaactagaattgcttgggatagttgtattaaatggtcagttcttctaagaacatctaagattgtgctgattgtgattattttagtaatgctgaatttggaagcacagcatttggaaagatgaaacaaatgtggaataaatttttttgtttttgtttttgttttttgttttttttttttttgaggcagaatctcactctgtcacccaggttgtagtgcagtggcaagatttcctctcactgcaacatctgcctcctgggttcaagaaattctcctgcctcagcctcctgagtagctggggtcacgggcatgcaccaccatgcccaactaatttttgtatatttagtagagacggggtttcaccctgttggcctcgaactcctgaccttaagtgatccacccaccttggcctccaaaagcgctgggattatagcatgagccac

SEQ ID NO: 98707 - DNA, 226 bp, Homo sapiens
gaaccatgttttccaatgtgtggtgcctgaatcagcattgagatcagcattaaccgggaacattttcagaaagcaaattttcaagctgccttctttcctcctcacccatcgagacctgtgaagtcagcgatatgtgttttgcgaacacataaatctccttctaggagattcggtatgtgatatacctgtaaaacactgcttagactattaaacatattgatccatc

SEQ ID NO: 98708 - DNA, 770 bp, Homo sapiens
ccttggtgagacctcgctaccttataagcctcagataaaccgtatagaaagatgaataacacagagattataagttggtttagaatgcaaagatatataacgaatatcaaagaagcatcaattcctggtatggaaataatggcattaagcaaacttactccttttcctttcagtaggttaaaaatggacacattgtaattaaaattatttgaaatggaaaacgaacttaaatcttctgtcctaaaagttgactatgagtttttctatgaatactagttttcaccgtctcgaaaactttcacattaagagcatttgaaagcaaataaacagtaattattattgacctttttataatggtcagaatctggaagtaataaactctgtttaaatctttataggaactgaagtaactaaggagtttcatcctaattaggatgttttcgttgtgtagttatatatgttgattctgaaaacattgatcttgccgaaagaaaggaaaagaatggtagagatgcaggcagactgaagcaacagagcaacacatttccataactaataatctttcatagatatattggttctgataggagtccagatagacgcctgaaaagattgaatcaaattgggccagtttaaagtggggagtgggtatcactgcaagttggactagatcattatggttgatgacaagttactgttattttgactgagaatatcattatgtaatatattacttaaattgttgagccttttatttaactttcatcagt

SEQ ID NO: 98709 - DNA, 478 bp, Homo sapiens
cctaaactgtggtctttctgagatgtcaatggagtgtccaaggagttcagtaaggtttccactcgcttgtccagaacttttatctcctagtaatctataaaatctccagttcacctctcctttgcagctcttttctactaggccttgtaagctgttatctacaagcttagtatttgatcaaagacttaaggggaaccttttgcagatttctggagctctttttttcttctcccccttattctgccccacaaactccagccatctcagaagccccaaattctctgcttcttcagatcactgagaccactgtttccagcttaggctctgcctctccataacacagtttgggaagtgccctgggtagagacagtgacagtggggttttcccttctctcaaggatctcagtcttacatgagtattagtcaaaacctgacatacataaaacagtggctttatatattttcacaagttttatgc

SEQ ID NO: 98710 - DNA, 666 bp, Homo sapiens
ctaaatttaatgttttatttgcaaagaaatatttgccaaatggggcatacaggaaaactcagtggtcttcaatatgttggaagaacaaagagaaatttagcattttatgaaaaagggaaaatgttacctatggctcttttgagaaagctcattggcactaggaagggttgggagctggcaagctcagactggtaagcagtggtggacaaagtgaatcctagaattatatcaagttatctcagaagttttggataaatttgatttcaggttacaataaaccaaaacggtgaagcttgcagagaattttgttactgaaatgccagggattcggtgtagatcctgcagctcgtcacacagaaagccaatcactaagacaagtattttcaaggaacaggctttaatcaggtgctgcagctgaggagatgggatgccattctcaaatgtatctctctgaccaactgaaattaggggtttatataacaaggaagaaatgtggaaaaacaggagttagggagggttaagaaagataattgggtcaacaggaagcaggaggtcagttaggcaatcataatgggtgaagggtctgatgtctcactgtcccgattcagtgatatataagtttcagcaaattgatagtatctgggaggcctgatggttgctttcctg

SEQ ID NO: 98711 - DNA, 105 bp, Homo sapiens
tgtaggcaatggggtgtaggtgattggggtcaaggagatagaggtgtaggtgatggggtgttggtgattggggtgtaggtgatcagggtgtaggtgattggggtg

SEQ ID NO: 98712 - DNA, 151 bp, Homo sapiens
tcttaatgaagagaatataaggtctgtccctttctgcctgctgtgtagatatattgcccatatgaagtagtatttctcagtataaattttttttccctgcaaaaataaggatgtaagatgccactaatgtttagaggcatggagctcaata

SEQ ID NO: 98713 - DNA, 398 bp, Homo sapiens
atgagactatagaaagaaaaaattcagccgggcgtggtggctcacgcctgtaatcccagcactttgggaggccgaggcaggcggatcacgaggtcaggaaatcgagaccatcctggctaacacggtgaaaccccgtctctactaaaaataaaaaaaaattagccgggcgcggtggcgggcgcctgtagtcccagctactcgggaggctgaggcaggagaatggcgtgaacctgggaggcggagcttgcagtgagccgagatcgcgccactgcactccagcctgggccacagagcgagactccgtctccaaaaaaaagaaaaaaaaagtcaggaaatgtattagctcattcaacagatacctatactgagaactatactgagaatgtaccatatactag

SEQ ID NO: 98714 - DNA, 343 bp, Homo sapiens
gctgtttcaaattacctgtattgcacaggccattttaatggaaagaaaattagcttaaagataggaagtgccttattagctcagtaaagccatggtctgttcaattaaagtgttaacaaatatttcagaggaaagaatgtttagggtcataaatgaattcaacacagttgttcctaagcacttactatttacctgggaatgtgtactgtgtttggtgctttgaagataaatgttatttacaaaacacctagctaataaaaccttgcttcagaatgctgtgtttgacatcaaagatctttatactgaactttatggttgacaaggtttaatttcatttaagtat

SEQ ID NO: 98715 - DNA, 238 bp, Homo sapiens
gctttcctgccctggccttctccccactcagtgcctaggtcctccataatcgacccaacagctccgctctgaccttcctggtgcagccttttcaactggggctctgattcatacacgcactgccctagagctgcctgtactgcttacgagcaaaatgcttcacagagaggtgtgtggcacagcagaaaggaccaagggacaaaggaggtggactagggtccaaacctgataaacatct

SEQ ID NO: 98716 - DNA, 734 bp, Homo sapiens
gcttacagggctaaggaatatttatttcaaaaaggataactaaaagtaaaaaactgtatcactttcttaaaaaaaatgtgtatctggcacaaaatagaccttaatttagaactaaattttattcagagcatcctggcaacagagtgaaaaggaaagcacgtcagtttttatgattctgcaggtcagttaaagaaaatactcaagtcatcaacaatgtgtttttttctgttatcgaattctgtgagaaataaagcatgaagtgacgtcatagacaatgttcttgattatagtcttacaaaagacacagaagaattcttcaaatgcaccttctaaaagtcacccctctgtaaaagcaaaaagtaaaacagtgacccctaactgaataaagccactgctaaaatactcacgtcaggttgtttctggtgatctgctatgaaacaaggtagagcctaagtaacggttgtccatttctgtgtaacaaattacatcacaactttgctgcctaatatagcaaacatttatgatctcacagtttctaaagatctctttaggctgactggttctagttatggtctctcatgaggttgcagacaagctgttggccaggattatagcctctgaagacttgaccaggaccaaaggatccacttccaagcttgctcatatggctgttgagtgagaacttcagtttcttgccacagacttctctacagggctgcacaagagtttgcttt

SEQ ID NO: 98717 - DNA, 408 bp, Homo sapiens
ccaggctggagtgcagtggcacaatcacgggacctcctggattcaagcaatactctcatctcagcctcctgaatagctgggaccatagcacaagccctgtaagaatgtgagagcgctcaaggatgttggctactgggaataaacatttgtgactacaacccacaaaacaatctgcacatggctaatcaagagaagactgcattttcctatttttgtttatatcataccagtagaacattgtacattaaatctataatgatgataaactgcccattgggattttcttcattcttgtaatcacccttaggactcaaaaaaatcccgtgagtttgcacttttcaaattctgttgtgggaaatgctgcaattaggtgctattgaaccaatctttgaaaattaaaaatgctgt

SEQ ID NO: 98718 - DNA, 623 bp, Homo sapiens
cgcagagcggcacacagggcgcgccgcgctcgctcggcacgggcagctcagccggcctcacgccgccgtccgcaacagcagccgcgggcggggtgcagccacctccgtgagcgccgcagcccgccccactcggggcggggcccgcgggcaccggagagcggacggccgagcacgagggggctgcgcgcagctccgggcagggaccccgtctgcaccgggtggcctgcaagattgccggggtaggcagggggaggagaacgctcacccgttccggtctggcgctcccttttctccacacccacacgcctcccgctccacgctggcggcgcagctgctcccgctgccacagccgccaccgccgccgaagctcgcgccgccgccgctgccgccttggctgagcgcggtcacgtgacgcgatccgcggggagcctgggggcgggcgagtgcgcgcgcgcgcgcgcggaggaaccgcggctcggaccgggactgggagctgagcggcactgggagggcgtttaaggggaggacccggcgagcgcgccctcggctggcgagcgcgcgcctggcgattagaacttgccgcgcggtcgggaaagggtggccggagtgaggggcggaggtgg

SEQ ID NO: 98719 - DNA, 4833 bp, Homo sapiens
gtgtgacgaaacctgcttcggcggcccgaggtgggggttttgagtcggttagtggaggcagtgggagcaggatgggcggagcttctgttccaaaaatttcccctaagtgcggttgacagtgtgcaggcaggcgggggtgcgcggggcggtcagcgatctgcagcttcgcggggacagagatgtaacccaactcgttcacggatgttccgcgcgccgtgtcaccggctgcgggccagggtactcggaaggcgcgggcaggagcctggcgaggatgcaccttcccctgccttggaaagggaatggagaggccggcggcccgggagccgcatgggcccgacgcgctgcggcgcttccagggactgctgctggaccgccgaggccggctgcaccgccaggtgctgcgcctgcgcgaggtggcccggcgcctggagcgcctgcgcaggcgctccctcgtagccaacgtggccggcagctcgctgagcgcaacgggcgccctcgccgccatcgtggggctctcgctcagcccggtcaccctggggacctcgctgctggtgtcggccgtggggctgggggtggccacagccggaggggccgtcaccatcacgtccgatctctcgctgatcttctgcaactcccgggagctgcggagggtgcaggagatcgcggccacctgccaggaccagatgcgagagatcctgagctgcctcgagtttttctgccgctggcagggctgcggggaccgccagctgctgcagtgcgggaggaacgcctccatcgccctgtacaattctgtctacttcatcgtcttctttggctcacgtggcttcctcatccccaggcgggcggagggggacaccaaggttagccaggccgtgctgaaggccaagattcagaaactggccgagagcctggagtcctgcaccggggctctggacgaactcagcgagcagctggagtctcgggttcagctctgcaccaagtccagtcgtggccacgacctcaagatctctgctgaccagcgtgcagggctgtttttctgagaacatcctttccccctaatgaccgaggccagcaaatcatcctcatgggatgctccagaatttgtagctcccttaggaaaacaccaagctgggttaggagccgaaggcaaaggatgagaaaaactgtttttgaagtgggcaggtccccaaagcccttcttttcccatcactgtgacatctgcctgggcttgagtgctacggacttttcagtcttcctagtggaaaaatgtgacccaaaaactccttttcctttatcaaaaactttctgtctaaacacagctgggcaggcactcctgttttaaagttatttcggggtccctgaccctgccctggtggcttggcctgagactggagagagtgccatcctctgggtcctctccaagtcctactagtctttgaagtcctcaaaatgtgcgtgaggaaggcatttgcctctattccagaatttctgatacaaagaactccagaatccagagcaaatcagcccttctctgaacgttgtaggatggttcagaacccagagaggaccctggtgctgatatctcctcctcttccctttcccctcagcttacttactcccagatgcggcctgggtatgaagtaggcctttcctgagtggctcccaatccagtcctccaagtactcagaggggaagcccgtgaagccgtcatctaagtcctgctccctcacatgaagctgagggccagatagatggagcgactgccaacttcatttcccgacatcattgtgttcagaagagagtgatgggttttgagttagacagtcctgggcttgagacaggctttgtcactactgtgtgagtgtagccacctaatctctctgagactgtgtaaaacaaagatgataaaatctcaccctgttgtgagatattaaatgagccaaagtgcctagcatgatggtgctggctcatatagtgtagtccctggaatggcaaattaacatcacccaggaacttgttagaaaggcaaattcttggacacaaccctcctgatttatggaatcagaaactctggctgtggggcccagcaacctgagtttaaacaatttctctgggtggttctgcggcacactaaggtttgaaaatcactacaacaaatgctaacttctaatccccttgatgagctttcacgaagtctcacggcttctctagggactccatggtcttcagagtcgttcacagatgaccaaggacagactgtgtcccagaagccaaaatgagagagagagagagagcacgcgtacgtgcaccctggggcagtgtctcaccgtatgaataagggatgtaacactaaaagcccattagggggcagtgtttcccgcctgttgtagaaactggtacagaaaggaatatgaagttcctgaaactgacctttgtctattattaccttctctgaaaagtgccagtccatgtattttttatttattttaagtttgtaatttaatttttaattattgtttagtgtttgcatttaattttatttaatcaccacatttagaaaataataagagcaagtttctaaatgggagactgctgaggctctttgcaagagatgagattaagtttgagtttctaaggcagggcatgagctggaaatagcattgctttccttgattgtctctctccttcagggagattctttttctctagtgttttaagtgatcctttgaagtaagtgtggagagtcttgaatggcaagaccaggagctgagtttaagcttgtaatggaagcttgcattgtgggatatataactgaggaagcatatttatcctgaaggtattttgccagaaggtatcacttgacctggaaaaggaatctatttagttcaggaaagataaaaagtttagaggtatgtgaaggaagcacttagaacttgcaagcctgatgtcctatcaagttatgtcttctgggtgacagacaaaatagcttgtcttatggtggtgatgtgttgcattttcactttggggtctgtaagaaactgtcagtgaaaatatgtacaattccttcaatttccattcttaacaactgtaatgttgaaaaataagttgaaaagtctttgggaccatacatgcaaaaacggtgcctctgttacttaattatttaatattctataaatgtacccaatctgtccgcacccttcccagtgatggggcagtatgtctgaggaagtataatttcagtactggggtcggggagaggaggtgatgtttctacatttttattttttctataaattgcaattggtctgtatgctggtttattttgaaatttatattggtttcttttcaagctggtgtcatctcctagactgtttcacccagatgctagcattttttttttttttttgagacagagtctcactctgtcacctaggctggagttgcagtggtttgatctcggctcactgcaacctccgactcctgggttcaagcaattcttctgcctcagcctcctgagtagctgggattacagatgtgcaccagcacacccggctaattttttgtatttttagtagagacagggtttcgccatgttggccaggctggtcttgaactcctggccttatgtgatccgcccaccttggcttcccaaagtgctgggattacaggcatgagccacctcgcctggccagatgctagcattttagatcaaacaattcattttagatgaattgttttgtttcacaatcattttaaatcattttagaatgtacttcacattattagttgtgttatggcataaaggtacaaccattccctaactccatcttttattaatgcttaagtttaaattatattcttccaatgcctaagctattccctagaattaaactgggcacttttggaagcagcaacagtaacagcagcagcaaacttttcctctcatattttgggtgtatcaaaagttctagacttttgaagttatgatttcagtggcccactttatttctaaggaagagtgtctactttggaacgatactttgcacatagtaggaactcaagaaatacatttgaataattataattaactgtttagctatcttaatgagaatttgttgacaacaaaagatcatccatcgccttatgtgtgagtaagattggagcctctatcaagatttagtcaagttcagttagattgattctagaaacaaatatttatttctttcttttacggggatgtgaataaggcttttccttaaggccttcattctttaaacaaacaggttgaaatggtatgttgtaaaagagaagacgggagagaggtatttagatgataagtgtacttcacaaaaatgccaaagtttgaaaaataggtatgtttgttctaaatgtttaagtgcttctctgttaggttctggggcttgcaatcatttgaattgttctgtttcacaataaaggagattcactgggttctgcattttcaggattcaatagaactgctccattaaaaaaataatccttagcaagcattcgaatcctaactgctttgatgcacttgccctcgggcacctgtcatttccaatatggtaggtgtcaaagtcaaaagtatttactgggagaaaaaagagaggagtggttgtagaagtctccctaaatcagacatgtcaagcaatcagccaacgtggtgtatttctcattcaatattttagtgtgaattgagacactgagataaagacatcgtgcagagataaatggggatacagttaaatgtagcaactcttgagttcattttttcccactgtagcaaaattaatgctttctctttattgaaat

SEQ ID NO: 98720 - DNA, 1145 bp, Homo sapiens
gtgtgacgaaacctgcttcggcggcccgaggtgggggttttgagtcggttagtggaggcagtgggagcaggatgggcggagcttctgttccaaaaatttcccctaagtgcggttgacagtgtgcaggcaggcgggggtgcgcggggcggtcagcgatctgcagcttcgcggggacagagatgtaacccaactcgttcacggatgttccgcgcgccgtgtcaccggctgcgggccagggtactcggaaggcgcgggcaggagcctggcgaggatgcaccttcccctgccttggaaaggtagaactggggagtgcgggagggtgaaggtggcccggaaaagaacacctcttcgcaaccaaaaaaaaaaaaaaaaaaaaaaaaagaggggaattaggggaaaattgtgttttatttcaaagcggcacacttcagaaacccagttcattaattcacgagcccagtgtgggtgtgtcaatatttagtgggaattcaagattttgaagaagatgtttacaaagataagaaagaaaagaagagaaataatagtagagaaaagaaaaaagacagaggggggggaggggacagtagcaaagatatcaccccaaaaggggggcggcacacgaactacgagggaggacacaagaggttattagtaagaaaaaaggggggggcgccccataatagcggtgaggaggacatctaataatcaaagagcaaagaagaggaagtagcgggcgcagataaaaacaacagcagggggcagagagagggagagaaaacacctgattaagcccaatgctggggagactacacctgttgtggaggacagaagaggacacacccctatcaaaaccgcatggggggggggaggcagaaaaacaaaatcaagatgggggacgaaaccagacacaaaaccacgcacaacaaggaggagagatatattaaaccgacgacccacagagaggagcagacgataatctaacaagagactagacaagaagagactcatacgacacgcgggtctaaaccacagaacacgcgacgcgacaagaataaagcagctgcgacgagagacgtcaataagaaaatagatggaaccccacaaaggaggagaagatggaataaatgaaggaacacaattatatt

SEQ ID NO: 98721 - DNA, 4784 bp, Homo sapiens
gtgtgacgaaacctgcttcggcggcccgaggtgggggttttgagtcggttagtggaggcagtgggagcaggatgggcggagcttctgttccaaaaatttcccctaagtgcggttgacagtgtgcaggcaggcgggggtgcgcggggcggtcagcgatctgcagcttcgcggggacagagatgtaacccaactcgttcacggatgttccgcgcgccgtgtcaccggctgcgggccagggtactcggaaggcgcgggcaggagcctggcgaggatgcaccttcccctgccttggaaagggaatggagaggccggcggcccgggagccgcatgggcccgacgcgctgcggcgcttccagggactgctgctggaccgccgaggccggctgcaccgccaggtgctgcgcctgcgcgaggtggcccggcgcctggagcgcctgcgcaggcgctccctcgtagccaacgtggccggcagctcgctgagcgcaacgggcgccctcgccgccatcgtggggctctcgctcagcccggtcaccctggggacctcgctgctggtgtcggccgtggggctgggggtggccacagccggaggggccgtcaccatcacgtccgatctctcgctgatcttctgcaactcccgggagctgcggagggtgcaggagatcgcggccacctgccaggaccagatgcgagagatcctgagctgcctcgagtttttctgccgctggcagggctgcggggaccgccagctgctgcagtgcgggaggaacgcctccatcgccctgtacaattctgtctacttcatcgtcttctttggctcacgtggcttcctcatccccaggcgggcggagggggacaccaaggttagccaggccgtgctgaaggccaagattcagaaactggccgagagcctggagtcctgcaccggggctctggacgaactcagcgagcagctggagtctcgggttcagctctgcaccaagtccagtcgtggccacgacctcaagatctctgctgaccagcgtgcagggctgtttttctgagaacatcctttccccctaatgaccgaggccagcaaatcatcctcatgggatgctccagaatttgtagctcccttaggaaaacaccaagctgggttaggagccgaaggcaaaggatgagaaaaactgtttttgaagtgggcaggtccccaaagcccttcttttcccatcactgtgacatctgcctgggcttgagtgctacggacttttcagtcttcctagtggaaaaatgtgacccaaaaactccttttcctttatcaaaaactttctgtctaaacacagctgggcaggcactcctgttttaaagttatttcggggtccctgaccctgccctggtggcttggcctgagactggagagagtgccatcctctgggtcctctccaagtcctactagtctttgaagtcctcaaaatgtgcgtgaggaaggcatttgcctctattccagaatttctgatacaaagaactccagaatccagagcaaatcagcccttctctgaacgttgtaggatggttcagaacccagagaggaccctggtgctgatatctcctcctcttccctttcccctcagcttacttactcccagatgcggcctgggtatgaagtaggcctttcctgagtggctcccaatccagtcctccaagtactcagaggggaagcccgtgaagccgtcatctaagtcctgctccctcacatgaagctgagggccagatagatggagcgactgccaacttcatttcccgacatcattgtgttcagaagagagtgatgggttttgagttagacagtcctgggcttgagacaggctttgtcactactgtgtgagtgtagccacctaatctctctgagactgtgtaaaacaaagatgataaaatctcaccctgttgtgagatattaaatgagccaaagtgcctagcatgatggtgctggctcatatagtgtagtccctggaatggcaaattaacatcacccaggaacttgttagaaaggcaaattcttggacacaaccctcctgatttatggaatcagaaactctggctgtggggcccagcaacctgagtttaaacaatttctctgggtggttctgcggcacactaaggtttgaaaatcactacaacaaatgctaacttctaatccccttgatgagctttcacgaagtctcacggcttctctagggactccatggtcttcagagtcgttcacagatgaccaaggacagactgtgtcccagaagccaaaatgagagagagagagagagcacgcgtacgtgcaccctggggcagtgtctcaccgtatgaataagggatgtaacactaaaagcccattagggggcagtgtttcccgcctgttgtagaaactggtacagaaaggaatatgaagttcctgaaactgacctttgtctattattaccttctctgaaaagtgccagtccatgtattttttatttattttaagtttgtaatttaatttttaattattgtttagtgtttgcatttaattttatttaatcaccacatttagaaaataataagagcaagtttctaaatgggagactgctgaggctctttgcaagagatgagattaagtttgagtttctaaggcagggcatgagctggaaatagcattgctttctcttgaatggcaagaccaggagctgagtttaagcttgtaatggaagcttgcattgtgggatatataactgaggaagcatatttatcctgaaggtattttgccagaaggtatcacttgacctggaaaaggaatctatttagttcaggaaagataaaaagtttagaggtatgtgaaggaagcacttagaacttgcaagcctgatgtcctatcaagttatgtcttctgggtgacagacaaaatagcttgtcttatggtggtgatgtgttgcattttcactttggggtctgtaagaaactgtcagtgaaaatatgtacaattccttcaatttccattcttaacaactgtaatgttgaaaaataagttgaaaagtctttgggaccatacatgcaaaaacggtgcctctgttacttaattatttaatattctataaatgtacccaatctgtccgcacccttcccagtgatggggcagtatgtctgaggaagtataatttcagtactggggtcggggagaggaggtgatgtttctacatttttattttttctataaattgcaattggtctgtatgctggtttattttgaaatttatattggtttcttttcaagctggtgtcatctcctagactgtttcacccagatgctagcattttttttttttttttgagacagagtctcactctgtcacctaggctggagttgcagtggtttgatctcggctcactgcaacctccgactcctgggttcaagcaattcttctgcctcagcctcctgagtagctgggattacagatgtgcaccagcacacccggctaattttttgtatttttagtagagacagggtttcgccatgttggccaggctggtcttgaactcctggccttatgtgatccgcccaccttggcttcccaaagtgctgggattacaggcatgagccacctcgcctggccagatgctagcattttagatcaaacaattcattttagatgaattgttttgtttcacaatcattttaaatcattttagaatgtacttcacattattagttgtgttatggcataaaggtacaaccattccctaactccatcttttattaatgcttaagtttaaattatattcttccaatgcctaagctattccctagaattaaactgggcacttttggaagcagcaacagtaacagcagcagcaaacttttcctctcatattttgggtgtatcaaaagttctagacttttgaagttatgatttcagtggcccactttatttctaaggaagagtgtctactttggaacgatactttgcacatagtaggaactcaagaaatacatttgaataattataattaactgtttagctatcttaatgagaatttgttgacaacaaaagatcatccatcgccttatgtgtgagtaagattggagcctctatcaagatttagtcaagttcagttagattgattctagaaacaaatatttatttctttcttttacggggatgtgaataaggcttttccttaaggccttcattctttaaacaaacaggttgaaatggtatgttgtaaaagagaagacgggagagaggtatttagatgataagtgtacttcacaaaaatgccaaagtttgaaaaataggtatgtttgttctaaatgtttaagtgcttctctgttaggttctggggcttgcaatcatttgaattgttctgtttcacaataaaggagattcactgggttctgcattttcaggattcaatagaactgctccattaaaaaaataatccttagcaagcattcgaatcctaactgctttgatgcacttgccctcgggcacctgtcatttccaatatggtaggtgtcaaagtcaaaagtatttactgggagaaaaaagagaggagtggttgtagaagtctccctaaatcagacatgtcaagcaatcagccaacgtggtgtatttctcattcaatattttagtgtgaattgagacactgagataaagacatcgtgcagagataaatggggatacagttaaatgtagcaactcttgagttcattttttcccactgtagcaaaattaatgctttctctttattgaaataaattgctcattcctcaaaaaaaaaaa

SEQ ID NO: 98722 - DNA, 341 bp, Homo sapiens
gatgaagcccatcgttaacgttccctgggagagaagcagaagatagcattattcctatttccatatgcagagataaggtcctgagaacttgtgtggctccccccggattccagaacaggtctttgagaactcgtctcatgatccactggaaacagacccgttcccctagcgtggcagtggctgctccgctgaactcgtgccaagttcccgctggcgtccgggcagcagggcgggagcggcggctggcacggagactccaggctgaccgcgtgtctatgtccccgcagggaatggagaggccggcggcccgggagccgcatgggcccgacgcgctgcggcgc

SEQ ID NO: 98723 - DNA, 4860 bp, Homo sapiens
gtgtgacgaaacctgcttcggcggcccgaggtgggggttttgagtcggttagtggaggcagtgggagcaggatgggcggagcttctgttccaaaaatttcccctaagtgcggttgacagtgtgcaggcaggcgggggtgcgcggggcggtcagcgatctgcagcttcgcggggacagagatgtaacccaactcgttcacggatgttccgcgcgccgtgtcaccggctgcgggccagggtactcggaaggcgcgggcaggagcctggcgaggatgcaccttcccctgccttggaaagggaatggagaggccggcggcccgggagccgcatgggcccgacgcgctgcggcgcttccagggactgctgctggaccgccgaggccggctgcaccgccaggtgctgcgcctgcgcgaggtggcccggcgcctggagcgcctgcgcaggcgctccctcgtagccaacgtggccggcagctcgctgagcgcaacgggcgccctcgccgccatcgtggggctctcgctcagcccggtcaccctggggacctcgctgctggtgtcggccgtggggctgggggtggccacagccggaggggccgtcaccatcacgtccgatctctcgctgatcttctgcaactcccgggagctgcggagggtgcaggagatcgcggccacctgccaggaccagatgcgagagatcctgagctgcctcgagtttttctgccgctggcagggctgcggggaccgccagctgctgcagtgcgggaggaacgcctccatcgccctgtacaattctgtctacttcatcgtcttctttggctcacgtggcttcctcatccccaggcgggcggagggggacaccaaggttagccaggccgtgctgaaggccaagattcagaaactggccgagagcctggagtcctgcaccggggctctggacgaactcagcgagcagctggagtctcgggttcagctctgcaccaagtccagtcgtggccacgacctcaagatctctgctgaccagcgtgcagggctgtttttctgagaacatcctttccccctaatgaccgaggccagcaaatcatcctcatgggatgctccagaatttgtagctcccttaggaaaacaccaagctgggttaggagccgaaggcaaaggatgagaaaaactgtttttgaagtgggcaggtccccaaagcccttcttttcccatcactgtgacatctgcctgggcttgagtgctacggacttttcagtcttcctagtggaaaaatgtgacccaaaaactccttttcctttatcaaaaactttctgtctaaacacagctgggcaggcactcctgttttaaagttatttcggggtccctgaccctgccctggtggcttggcctgagactggagagagtgccatcctctgggtcctctccaagtcctactagtctttgaagtcctcaaaatgtgcgtgaggaaggcatttgcctctattccagaatttctgatacaaagaactccagaatccagagcaaatcagcccttctctgaacgttgtaggatggttcagaacccagagaggaccctggtgctgatatctcctcctcttccctttcccctcagcttacttactcccagatgcggcctgggtatgaagtaggcctttcctgagtggctcccaatccagtcctccaagtactcagaggggaagcccgtgaagccgtcatctaagtcctgctccctcacatgaagctgagggccagatagatggagcgactgccaacttcatttcccgacatcattgtgttcagaagagagtgatgggttttgagttagacagtcctgggcttgagacaggctttgtcactactgtgtgagtgtagccacctaatctctctgagactgtgtaaaacaaagatgataaaatctcaccctgttgtgagatattaaatgagccaaagtgcctagcatgatggtgctggctcatatagtgtagtccctggaatggcaaattaacatcacccaggaacttgttagaaaggcaaattcttggacacaaccctcctgatttatggaatcagaaactctggctgtggggcccagcaacctgagtttaaacaatttctctgggtggttctgcggcacactaaggtttgaaaatcactacaacaaatgctaacttctaatccccttgatgagctttcacgaagtctcacggcttctctagggactccatggtcttcagagtcgttcacagatgaccaaggacagactgtgtcccagaagccaaaatgagagagagagagagagcacgcgtacgtgcaccctggggcagtgtctcaccgtatgaataagggatgtaacactaaaagcccattagggggcagtgtttcccgcctgttgtagaaactggtacagaaaggaatatgaagttcctgaaactgacctttgtctattattaccttctctgaaaagtgccagtccatgtattttttatttattttaagtttgtaatttaatttttaattattgtttagtgtttgcatttaattttatttaatcaccacatttagaaaataataagagcaagtttctaaatgggagactgctgaggctctttgcaagagatgagattaagtttgagtttctaaggcagggcatgagctggaaatagcattgctttccttgattgtctctctccttcagggagattctttttctctagtgttttaagtgatcctttgaagtaagtgtggagagtcttgaatggcaagaccaggagctgagtttaagcttgtaatggaagcttgcattgtgggatatataactgaggaagcatatttatcctgaaggtattttgccagaaggtatcacttgacctggaaaaggaatctatttagttcaggaaagataaaaagtttagaggtatgtgaaggaagcacttagaacttgcaagcctgatgtcctatcaagttatgtcttctgggtgacagacaaaatagcttgtcttatggtggtgatgtgttgcattttcactttggggtctgtaagaaactgtcagtgaaaatatgtacaattccttcaatttccattcttaacaactgtaatgttgaaaaataagttgaaaagtctttgggaccatacatgcaaaaacggtgcctctgttacttaattatttaatattctataaatgtacccaatctgtccgcacccttcccagtgatggggcagtatgtctgaggaagtataatttcagtactggggtcggggagaggaggtgatgtttctacatttttattttttctataaattgcaattggtctgtatgctggtttattttgaaatttatattggtttcttttcaagctggtgtcatctcctagactgtttcacccagatgctagcattttttttttttttttgagacagagtctcactctgtcacctaggctggagttgcagtggtttgatctcggctcactgcaacctccgactcctgggttcaagcaattcttctgcctcagcctcctgagtagctgggattacagatgtgcaccagcacacccggctaattttttgtatttttagtagagacagggtttcgccatgttggccaggctggtcttgaactcctggccttatgtgatccgcccaccttggcttcccaaagtgctgggattacaggcatgagccacctcgcctggccagatgctagcattttagatcaaacaattcattttagatgaattgttttgtttcacaatcattttaaatcattttagaatgtacttcacattattagttgtgttatggcataaaggtacaaccattccctaactccatcttttattaatgcttaagtttaaattatattcttccaatgcctaagctattccctagaattaaactgggcacttttggaagcagcaacagtaacagcagcagcaaacttttcctctcatattttgggtgtatcaaaagttctagacttttgaagttatgatttcagtggcccactttatttctaaggaagagtgtctactttggaacgatactttgcacatagtaggaactcaagaaatacatttgaataattataattaactgtttagctatcttaatgagaatttgttgacaacaaaagatcatccatcgccttatgtgtgagtaagattggagcctctatcaagatttagtcaagttcagttagattgattctagaaacaaatatttatttctttcttttacggggatgtgaataaggcttttccttaaggccttcattctttaaacaaacaggttgaaatggtatgttgtaaaagagaagacgggagagaggtatttagatgataagtgtacttcacaaaaatgccaaagtttgaaaaataggtatgtttgttctaaatgtttaagtgcttctctgttaggttctggggcttgcaatcatttgaattgttctgtttcacaataaaggagattcactgggttctgcattttcaggattcaatagaactgctccattaaaaaaataatccttagcaagcattcgaatcctaactgctttgatgcacttgccctcgggcacctgtcatttccaatatggtaggtgtcaaagtcaaaagtatttactgggagaaaaaagagaggagtggttgtagaagtctccctaaatcagacatgtcaagcaatcagccaacgtggtgtatttctcattcaatattttagtgtgaattgagacactgagataaagacatcgtgcagagataaatggggatacagttaaatgtagcaactcttgagttcattttttcccactgtagcaaaattaatgctttctctttattgaaataaattgctcattcctcaaaaaaaaaaa

SEQ ID NO: 98724 - DNA, 4858 bp, Homo sapiens
gtgtgacgaaacctgcttcggcggcccgaggtgggggttttgagtcggttagtggaggcagtgggagcaggatgggcggagcttctgttccaaaaatttcccctaagtgcggttgacagtgtgcaggcaggcgggggtgcgcggggcggtcagcgatctgcagcttcgcggggacagagatgtaacccaactcgttcacggatgttccgcgcgccgtgtcaccggctgcgggccagggtactcggaaggcgcgggcaggagcctggcgaggatgcaccttcccctgccttggaaagggaatggagaggccggcggcccgggagccgcatgggcccgacgcgctgcggcgcttccagggactgctgctggaccgccgaggccggctgcaccgccaggtgctgcgcctgcgcgaggtggcccggcgcctggagcgcctgcgcaggcgctccctcgtagccaacgtggccggcagctcgctgagcgcaacgggcgccctcgccgccatcgtggggctctcgctcagcccggtcaccctggggacctcgctgctggtgtcggccgtggggctgggggtggccacagccggaggggccgtcaccatcacgtccgatctctcgctgatcttctgcaactcccgggagctgcggagggtgcaggagatcgcggccacctgccaggaccagatgcgagagatcctgagctgcctcgagtttttctgccgctggcagggctgcggggaccgccagctgctgcagtgcgggaggaacgcctccatcgccctgtacaattctgtctacttcatcgtcttctttggctcacgtggcttcctcatccccaggcgggcggagggggacaccaaggttagccaggccgtgctgaaggccaagattcagaaactggccgagagcctggagtcctgcaccggggctctggacgaactcagcgagcagctggagtctcgggttcagctctgcaccaagtccagtcgtggccacgacctcaagatctctgctgaccagcgtgcagggctgtttttctgagaacatcctttccccctaatgaccgaggccagcaaatcatcctcatgggatgctccagaatttgtagctcccttaggaaaacaccaagctgggttaggagccgaaggcaaaggatgagaaaaactgtttttgaagtgggcaggtccccaaagcccttcttttcccatcactgtgacatctgcctgggcttgagtgctacggacttttcagtcttcctagtggaaaaatgtgacccaaaaactccttttcctttatcaaaaactttctgtctaaacacagctgggcaggcactcctgttttaaagttatttcggggtccctgaccctgccctggtggcttggcctgagactggagagagtgccatcctctgggtcctctccaagtcctactagtctttgaagtcctcaaaatgtgcgtgaggaaggcatttgcctctattccagaatttctgatacaaagaactccagaatccagagcaaatcagcccttctctgaacgttgtaggatggttcagaacccagagaggaccctggtgctgatatctcctcctcttccctttcccctcagcttacttactcccagatgcggcctgggtatgaagtaggcctttcctgagtggctcccaatccagtcctccaagtactcagaggggaagcccgtgaagccgtcatctaagtcctgctccctcacatgaagctgagggccagatagatggagcgactgccaacttcatttcccgacatcattgtgttcagaagagagtgatgggttttgagttagacagtcctgggcttgagacaggctttgtcactactgtgtgagtgtagccacctaatctctctgagactgtgtaaaacaaagatgataaaatctcaccctgttgtgagatattaaatgagccaaagtgcctagcatgatggtgctggctcatatagtgtagtccctggaatggcaaattaacatcacccaggaacttgttagaaaggcaaattcttggacacaaccctcctgatttatggaatcagaaactctggctgtggggcccagcaacctgagtttaaacaatttctctgggtggttctgcggcacactaaggtttgaaaatcactacaacaaatgctaacttctaatccccttgatgagctttcacgaagtctcacggcttctctagggactccatggtcttcagagtcgttcacagatgaccaaggacagactgtgtcccagaagccaaaatgagagagagagagagagcacgcgtacgtgcaccctggggcagtgtctcaccgtatgaataagggatgtaacactaaaagcccattagggggcagtgtttcccgcctgttgtagaaactggtacagaaaggaatatgaagttcctgaaactgacctttgtctattattaccttctctgaaaagtgccagtccatgtattttttatttattttaagtttgtaatttaatttttaattattgtttagtgtttgcatttaattttatttaatcaccacatttagaaaataataagagcaagtttctaaatgggagactgctgaggctctttgcaagagatgagattaagtttgagtttctaaggcagggcatgagctggaaatagcattgctttccttgattgtctctctccttcagggagattctttttctctagtgttttaagtgatcctttgaagtaagtgtggagagtcttgaatggcaagaccaggagctgagtttaagcttgtaatggaagcttgcattgtgggatatataactgaggaagcatatttatcctgaaggtattttgccagaaggtatcacttgacctggaaaaggaatctatttagttcaggaaagataaaaagtttagaggtatgtgaaggaagcacttagaacttgcaagcctgatgtcctatcaagttatgtcttctgggtgacagacaaaatagcttgtcttatggtggtgatgtgttgcattttcactttggggtctgtaagaaactgtcagtgaaaatatgtacaattccttcaatttccattcttaacaactgtaatgttgaaaaataagttgaaaagtctttgggaccatacatgcaaaaacggtgcctctgttacttaattatttaatattctataaatgtacccaatctgtccgcacccttcccagtgatggggcagtatgtctgaggaagtataatttcagtactggggtcggggagaggaggtgatgtttctacatttttattttttctataaattgcaattggtctgtatgctggtttattttgaaatttatattggtttcttttcaagctggtgtcatctcctagactgtttcacccagatgctagcattttttttttttttttgagacagagtctcactctgtcacctaggctggagttgcagtggtttgatctcggctcactgcaacctccgactcctgggttcaagcaattcttctgcctcagcctcctgagtagctgggattacagatgtgcaccagcacacccggctaattttttgtatttttagtagagacagggtttcgccatgttggccaggctggtcttgaactcctggccttatgtgatccgcccaccttggcttcccaaagtgctgggattacaggcatgagccacctcgcctggccagatgctagcattttagatcaaacaattcattttagatgaattgttttgtttcacaatcattttaaatcattttagaatgtacttcacattattagttgtgttatggcataaaggtacaaccattccctaactccatcttttattaatgcttaagtttaaattatattcttccaatgcctaagctattccctagaattaaactgggcacttttggaagcagcaacagtaacagcagcagcaaacttttcctctcatattttgggtgtatcaaaagttctagacttttgaagttatgatttcagtggcccactttatttctaaggaagagtgtctactttggaacgatactttgcacatagtaggaactcaagaaatacatttgaataattataattaactgtttagctatcttaatgagaatttgttgacaacaaaagatcatccatcgccttatgtgtgagtaagattggagcctctatcaagatttagtcaagttcagttagattgattctagaaacaaatatttatttctttcttttacggggatgtgaataaggcttttccttaaggccttcattctttaaacaaacaggttgaaatggtatgttgtaaaagagaagacgggagagaggtatttagatgataagtgtacttcacaaaaatgccaaagtttgaaaaataggtatgtttgttctaaatgtttaagtgcttctctgttaggttctggggcttgcaatcatttgaattgttctgtttcacaataaaggagattcactgggttctgcattttcaggattcaatagaactgctccattaaaaaaataatccttagcaagcattcgaatcctaactgctttgatgcacttgccctcgggcacctgtcatttccaatatggtaggtgtcaaagtcaaaagtatttactgggagaaaaaagagaggagtggttgtagaagtctccctaaatcagacatgtcaagcaatcagccaacgtggtgtatttctcattcaatattttagtgtgaattgagacactgagataaagacatcgtgcagagataaatggggatacagttaaatgtagcaactcttgagttcattttttcccactgtagcaaaattaatgctttctctttattgaaatggtcgccgatccgggatcctctgaa

SEQ ID NO: 98725 - DNA, 290 bp, Homo sapiens
ttcctccatgttcaaaataaaaattaaacatattgctgaatttttatttattttatgataattaggaaaaagaaatgtgaaaaaccctgttatatataactgttatgcagcaattatatttacttattaaatctattcaattaaatgtggaatgattcatttaaacaatgagcatcataggtatttttatctggtcttacttttatttcataccattattgtcatggatttagtgaataggagtaaaactatttattcaaaatcaagggtacaaaataaataaatacata

SEQ ID NO: 98726 - DNA, 618 bp, Homo sapiens
aaattttctaattaccacattaaaatagtaaaaaccaggtgaaattaattttaagaaaatactgtattttatatatatatctccaaaatattatttcagcatataaccagtgtaaaaactataaatgagatcattgacattttttttcataccacatttttagaaccctgtgtgtgtttacactgacagcacattccacttgagaccagtgctgcgggactggggagtgcaagcgtcagggtcccagccgaagccctttagcttgggacttcacagccacagcctgagtcccagctcacaactccagaccaaattcccctcccagctcatgtgctgcgatcaagacagatgccacacatggcctggatccccacccccctggcctgctgtgttggctgggcttttccttggagcatggcccctggtgcttctgccactcctacctccctgcccacccccgaaaccccatccctcagagggaccgggtatttttcaacatcctcatccagatcaaggccccattgacattggagagaattcaagcccaacagggaattccattacttatcattgagcactgactaagatttttttttttaactagactttttctgaaac

SEQ ID NO: 98727 - DNA, 248 bp, Homo sapiens
gcataagtaagaactgcagtataatgaacacttgctatgagccagacacagtgttggaggtggtataggtactccaggaggaagacgtctccagccagttagctcaggtgtgtttgtatggcaccagtgccccaagatgacaatattcaaaaatgccagacttcttgaagtttagacttgagagtctcccagtgtcatttctactacattcttttggttaaagcaagttacctggctaaacctagagt

SEQ ID NO: 98728 - DNA, 902 bp, Homo sapiens
cccagctacttgggagggtgagatgggaggattgcttgatcctgggaggtggaggttgcagtgagctgtgtttgtgccactgcactccagcctgggcaacagagcaagaccccatctcaaaaaaaattaagcaggtatggaggccagaatgtcacaagacagagaggacttgaaagtagggaaaaaagggacaatatttacttttgtcaaaaagtaacaattactttttaaagaagtataacaattataggaaggagagagaaaaaatagttcaagggaagaggccaagttaaggaaaggtttttgtcttgttttgttattgttgatttaagacagagaagacctgcagctatgtagaggtggaggaaagaaactacagtatctactaccctattcttctaacctattcttctaatttgctcactgtaaaaagagaaaccgaagactagaaattaaacagggtggaatatggtcttagatgggaaggaatgaggtcaagaacacaaagagaagcatgtcttagaaaagggggatgcatggctgaaaagaggtaagtcttgaaggtagatgggaagaagttttgggaatggtcatatctaataatttagttttttctctatgaaataggaggcacagtcaactttgacagttctaagaggcttgagaagaataaaacgtttgtaatacctcttccagggaacacaatagtaaaccacttaggaaccagtagaaggattgctaagcagtattaggaagcctgtgtagcatatggccctctcaaataggtagagatgtttttagatatttaagaggaattaacattaacaaaaccaagggacaaagccaagctcaagtcccataaaacatggatattttattccagctctaggaaatgggaaaaa

SEQ ID NO: 98729 - DNA, 185 bp, Homo sapiens
acgacccgctgcccccacgggcagcccgtcctgtctcacaggcccgctgccccacaccggtcggagacggcagcagctcccgacgctgctgggacaacgggcgggtgaacctgcgaccagtggtgcagctgattgacatcatgaaggacctgacacgcctctcccaggacctgcagcacagtggt

SEQ ID NO: 98730 - DNA, 241 bp, Homo sapiens
agtgagaccctgtttcaaaaagaaaaaagaaaaaaaaatgagtttttgaaattactgtgttatatatacttgtattgttttaaaagaaaacttgaatatagaaataaatgggtctacagttagagagactgggtatttataaataaacataatatatttgtttgtttgttggaggccaactgactggaatttgcttttgcaacatgctgttaaagctaaactcttttctacctaacctttt

SEQ ID NO: 98731 - DNA, 290 bp, Homo sapiens
  misc_feature (24)..(24): n is a, c, g, or t
  misc_feature (46)..(46): n is a, c, g, or t
  misc_feature (58)..(58): n is a, c, g, or t
cactgtcctttttccatatttttntccaggaatctttgaatttttntaagtaactttntttttcagagtcttccttccatattccttctccaaagagtgaaatatgtaaatatatggacgtttttcattgaatcaaaatggaagttttgccaaatgatcaaagtgttagtccaatggtatttaaatattaaaaagagatgattattataagcataatgtcagaattaatttaaacaaattataattaatgtaatatgattttaggaaggatgaaacactttatgagaagt

SEQ ID NO: 98732 - DNA, 1148 bp, Homo sapiens
gagctcagggccgctcgcaggaggccgggaacatggcggggcagcccgcggccaccggctcgccgtctgccgacaaggacggaatggagcccaacgtcgtggctcggatctcgcagtgggcagacgaccacctgcgcctagtccggaacatcagcactggaatggccatagctggaataatgttacttttgagaagcattcgactgacatcaaaatttacaagctcttcggatattccagtagaatttataagaagaaatgttaaactacgtggacgattacgccgaataactgagaatggtttagaaattgaacatatacctattactttacctattatagcttcattgagaaaagagccacgtggtgctttgctggttaagttggctggagtagaactcgctgaaactgggaaggcatggttacaaaaagagctaaaaccttcccaattactatggttccaacttcttggaaaggagaattcagcactcttttgctatcttctggtgaataagggtggatatttcagcgtgaatctgaatgaagaaattttgagaagaggccttggcaaaactgttcttgttaaagggcttaaatatgattctaaaatctattggacagttcacagaaacttacttaaagctgaattaacagccttaaaaaaaggagaaggaatatggaaggaagactctgaaaaagaaagttacttagaaaaattcaaagattcctggagagaaatatggaaaaaggacagttttttaaaaacaacaggatcagatttcagcttgaaaaaagaaagttattatgaaaaacttaaaaggacttatgaaatatggaaagacaacatgaacaactgctccttaatactgaagttcagagaacttataagtcgcataaactttcgtagaaaagggtgaaacggtcaagaaatctagaggtaaccttctccaaagagtgaaatatgtaaatatatggacgtttttcattgaatcaaaatggaagttttgccaaatgatcaaagtgttagtccaatggtatttaaatattaaaaagagatgattattataagcataatgtcagaattaatttaaacaaattataattaatgtaatatgattttaggaaggatgaaacactttatgagaagt

SEQ ID NO: 98733 - DNA, 458 bp, Homo sapiens
ctgtgttatatatacttgtattgttttaaaagaaaacttgaatatagaaataaatgggtctacagttagagagactgggtatttataaataaacataatatatttgtttgtttgttggaggccaactgactggaatttgcttttgcaacatgctgttaaagctaaactcttttctacctaacctttttagaagagccacgtggtgctttgctggttaagttggctggagtagaactcgctgaaactgggaaggcatggttacaaaaagagctaaaaccttcccaattactatggttccaacttcttggaaaggagaattcagcactcttttgctatcttctggtgaataaggtaagcaatgtgaagaaataactagcaatatcttattcttcttattacttatatgtaaacacttatttaattagaactttggatatataatgggactgacttttttt

SEQ ID NO: 98734 - DNA, 198 bp, Homo sapiens
cccatcagttgttgatgcttagaatggttagcagaagtaggtaggaaacactcagacctcaattttcatgaacttcacttttcacagtattttaaacaattagagatgttggaaagaggtaaggaagaattttactatttagtctgctgcacatattcttttgttgttgtttttttgtttgagacagaatttcactct

SEQ ID NO: 98735 - DNA, 478 bp, Homo sapiens
tgttggagagaaaatgatgttggaagaggaatagacttatgatgctggagagaggggaaaaaacatggaaataaggctgaaggttccttacaagtcaccagaaaacagcaaccagaatacacagaaaaggaaggtaactcttaagagaaaggatacttcttggaattgggaaaaagggaggagaaaagagacaaaaggattttgatattaaagaagaaggtttactcaagatagtctagatattactggtaaaagggaacttctcttgaaacagtagaaaaagaaatgtggactggggatgtgtgaaaagaagacattttagaaacagtcactaaggtaaggctcaagtcagtgagacagcccagatatgaaaatgtgcttcattttcaaggcccaaaaaagagtttccaaattttaacattcctttctctccggaaattcttttttattttgagacaagagtcacactctgttgccc

SEQ ID NO: 98736 - DNA, 334 bp, Homo sapiens
actttttctacaatagaaaaaggaaattgccttaagagaaacatatacaaagtttatgagaatactggagaagaaggccttttgtctgtctatgattaagatggcaaaggttagggaagtctttgcagaagaaggatttgagctaagaatttgccatgaacaaacagtgcaagggtgttagtgtaaagatatatacaaaagcatagtatgttctggatactgaattcttgagcattcctggaatgtagtatgaggcagagagttgcaagaaatgatgttggacaagaaatcagaaatcatatgtcatctagaactttatctctcttttacagta

SEQ ID NO: 98737 - DNA, 129 bp, Homo sapiens
accaggcagatctactcaagtgccaaggtagttggtggattatctgcatagcttggatttaacctgttctccgtgtccaggatggtgtctgattctctcaaaacgcatgtcagaagacggtgctgacca

SEQ ID NO: 98738 - DNA, 375 bp, Homo sapiens
atctcgccatgttgcccaggctgggctatatgtatatatattttaaagtattggtaaggatgtggagaaatcggaaccctcctatgttgctgatgggaatggaaaatggcacactcattgtggaaaataatttgggagctcctcaaaaagttaaacatgaagcccccatatgacccagcaattccactcctaggtatttatccaagagaaagaaaaacgtgctcccacataaaaacgtgtatatgaatcttcacagcagcattatttgtaacagccaaaaggtgaacacaacccaaatgtccgtctgtagatgaatggatacagaatgtgatctgtccatgcaatgaaatgtggctcagccacagaaaggaatga

SEQ ID NO: 98739 - DNA, 267 bp, Homo sapiens
actaatgtagatgacaggttgatggctgcagcaaaccaccatggcacgcgtatacctctgtaacaaagctgcatgttctgcacaggtatcccagaaattaaagtatgattaaaaaaaatttctagtaatagtaacactactagtaattcaaatgaagtgtgtgtaacagaagaaataaaaaaaaaattaaaatgctacatctgaaaatacctatttcatacaaagcaaggaggtaaagaagggatagaacatatttttttaaaatat

SEQ ID NO: 98740 - DNA, 309 bp, Homo sapiens
gagagggaaatttttttgagaagtatgatctgtgagagtctaacttttctgtaagaagattctgttagaggcttttgtaaagaaaaagtaattacttgaaggacagtgtgtttttctttcgtaggaatctcatagctcttaccaaattgagtaggaaggaattaataaagcattcgagtatacttttttgggttgtttttttctcccatttctgttcgttttaatttttgaagtttcaccttgtcatttgtataaattatagtttgagacattagatgtaaaagatgtagagttgaaactgaaagtaaa

SEQ ID NO: 98741 - DNA, 1659 bp, Homo sapiens
  misc_feature (694)..(695): n is a, c, g, or t
  misc_feature (715)..(715): n is a, c, g, or t
  misc_feature (795)..(795): n is a, c, g, or t
  misc_feature (812)..(812): n is a, c, g, or t
  misc_feature (815)..(815): n is a, c, g, or t
  misc_feature (824)..(824): n is a, c, g, or t
  misc_feature (878)..(878): n is a, c, g, or t
  misc_feature (1325)..(1325): n is a, c, g, or t
  misc_feature (1398)..(1398): n is a, c, g, or t
  misc_feature (1400)..(1400): n is a, c, g, or t
  misc_feature (1492)..(1492): n is a, c, g, or t
  misc_feature (1495)..(1495): n is a, c, g, or t
  misc_feature (1549)..(1549): n is a, c, g, or t
ggccgagggaaacacaaccccaagcagcctggagtaagtggtcccgaggcagctcaagacagtttggttttattcatttcagagagacaggaattgcagggaaaatcatgaatcagtgcctggaaggtgtaagttccattggcagaaagggtgggacctgtggaaggggggttagaaggcacaggtagttgagggattctgtaggtggcagctggttgagagtgttgaatctttgtctaaagtttggaggaggtaggaaggaatgctgaaggaagggggtctgttatctgccacttcattccatcccagccaaaaaacagacctgtttctcgagattttatgaattctaaggcgtaactttacctttgccttgcgtggccttaggtcttgtttgtaatttggtatcttgttgccacaaggagtctgtttttccagtcagataatgtctgtttttacatgaatgtgcgtcagttgctgcatgtaaactcctaaagggagagggtataaggagacctgtctcacctcccatcctgtcatacagaggcactcaattttcagggttttttgggggttcccttggccaagagccagtcacttcacttagctgggaaggtactttgtttttgtttttgtttgagacagagtctcctgtagcccagggtggtgtgcagtggctctatcttggctcactgcnncctccaccttccgggttcangcgattctcctgcctcagcttcccgagtggctgggattacaggcatgtgccaccacacccggctaatttttgtatttttngtagagatggggtttcnccntgttggccnggctgttcctgaactcctgacctcaagtgatccactggcctcggcctcccaaantgctgggattacatgtgtgagccacctcaccaggccagaaggtatgtttttatttttagtttacaggttgaaggctggacttttataaggtacatgaggagacaaaccagataaatgcttgattggttgcagagatgcagtcaccttatttggacttgtcaacccgaaataatcgaaagtttcagatttcaactggaagagtttattcaagcaaaaagatagcaatggcccatttgggaaaaacacagactccagagaaatggactcagtactccaaaattggaagttaagttcttgcttatattactgggaaaagaggtcctgatcagatcccaagagagttcttggatctcatacaggaaggaattcaagacgagtcggaaagtacagtgcaaagagagtttattgaaagctactctgggccagcatgatggcttaggcctgtantctaagcactttgggaggccgaggtgggaggatcacttgaggtcaggagtttgagaccagcctgggcaatatngngaaaccccatctcttccaaaaataacaaaaattagccgggtgtggtggcctgcacctgtagtcccaggtactcgggaggctggatgggacantcncttgaacccgggaggcagaggttgcagcccagctgaggacacgccactgcactncagcttgggtaacagagtgagaccccatctcaaaaaacaaaaacaaaacaaacaaacaagacagagttcaagaccaacgtggccaacacagtgagaccctgtctctattt

SEQ ID NO: 98742 - DNA, 612 bp, Homo sapiens
tgatacttgactgcggttcctctttgcctgtgccgtcacctgggattggaattctgcatttcccacccccaattcccttctccagtcatctaactcctctgcttcctccaatactcagctaaggcattacctcctcctagaagccttccctgaaatcctcaagcagttctctttctttgacttccctctttggagcctcaactgtctctttgggtttgtctgtcctgctagactgaacgtaaataactaatgagggtatctgcatggaaagaaacagacccttctaagtgctgtgttaagtaacttcactgaaccagatgagagcattagagcagctgctttctagggttttgccagctcctgtatgcggacgtgaggctgctggggatgttgctattagtgataaagttaagggtccaagaggttctttgcttcacgactacgtcattggaggctgataagccatggccaagtgtgttcaaggtctccagctgtcataaaagtgtctgcttgtttattttaggtagataagtgttgctattattcctgggatggtaggaaaagccgggggcaagaaatcactctgtgaagatatattgagatccctggaac

SEQ ID NO: 98743 - DNA, 259 bp, Homo sapiens
gaaacatgcccacctcagggtggggccttctgctgccttcctactcagattttctaagcccattctgtaaaattaatagcaagctaaaggtaggtgagataggcctatggagacattttttctacaaagggacatgcagcatttatgaaaactgttggcccacatgtgacagtgtttaggtcctgagtacttgaaaagtatttggtggccactcaaaaagcataccttgccccttacctgcatgatttggatttgctgt

SEQ ID NO: 98744 - DNA, 485 bp, Homo sapiens
acatactgccatgggggagggtggggacactgaggaaagataaggcaagggctgtggaagctgccccaggctgccccatttcactactgtggttaactggcaaaggagtccatgcaaatgagtgcaggatgtccaaatcgcagcactgtttcacacatcatcatttcaagtcaccgactgacaggatttagcactctgtgtctggcagcaaccagcagtgaagcagagagaattccactggattatccaaagcatctgacccgcaaatgaggagtgagcagaacatttttaaaaaacaactcttgagtggttcagtgagccaatttgacatcgaagagagacacacaaacatccagccacctctgaggcaaaaggtcaatttcttctgcttgtcctcggtcctcagaatccaagttactgatgtgagctctgtccctcattttcctagccaaaggggtagatgtgaagcacagacaggccagata

SEQ ID NO: 98745 - DNA, 746 bp, Homo sapiens
tgcttgaactctggaggtggaggttgcagtgagctgagatcatgccactgcactccagcctgggtgacagagtgagactatgtctcaaaaaaagaaagaaagaaagaaagaaaaatttgaagtatagaggggaatcacaaaaattctaaatggtaactcatgtcaggaacctgaaagtcaagtcttcacttcagcattgggaagtatatgaaactgttttcggaccacacaactctgtgagctcatcgctaagaattggtatgcaaggtcttcagaagggtaggcaatttgtaaactccttttgacttagctggtaagacagaaagttcttttttcatggctaaatgatacttgagaaaagaaaaaatgtggtgaagctgaatgtatctagttgaaataaaaatgcctacctttctcctgcataggcaaaatatactacttacaagaaaaaaaggaatttatgaatagaaatagaatcaggtcacagtgcatttcctaattctccactggattttattactcaagcactgtatttttaccttttatcatagctgtcattcgtccttgtactttagatagcagcttatcaacccttgttatatccttaccttctttagggtgatgatcttatctttatttttgaccacacttcctgtgcctgccccttttcttacatcaatttctgttccacttgggattttgtactcacagatgtgacatgaatatttatgagattaaagtgaatg

SEQ ID NO: 98746 - DNA, 448 bp, Homo sapiens
atcatgctcccctttccccagtcttctttatcatctcccctcttcctgcatcccctgtctccccccacagctcggcagttggcagtagcgtaggagttggagtagatgcagggggaagggcatggacgtcatcacagggcagggtgagcagagcgtgggcagagatgtggatgcaggaatgcctggcacatgaggagggtccagcattgatgagctagatagagccaaaagcctgtttctgggctggtaggagctgaggtgggcagggtgagatgatggtgggccttcagagttcagcagtctgggttcgagggagtaggaactaggaagggcctgaggtttcttgtgcagatatcttgtgatgaaaactaccaaaccgtatccctttttgaagttaagatttttgtttaagttttttctttcatcttgtgatgaaaactgtgattca

SEQ ID NO: 98747 - DNA, 199 bp, Homo sapiens
caagttgacaaaagtaggcttcagaagatcagtaataacaaacttctccaatctaaagcaggatgttcgaacccatcgcaaagaagctaaaaaccttgaaaaaagattagacgaatggctaactagaataaacagcatagagaagaccttaaatgacctgacagagttgaaaaccatggcacaagaactacgtgacaca

SEQ ID NO: 98748 - DNA, 663 bp, Homo sapiens
ttttttttttcaaaacagttttgcttttggttgatttgccttggggaatattgctcactggggtcctcatgcatcagtttagaaataaagacttaaattcttttactttaattaatcaactctaattttcacatttgattatggtgttccacgaggctcacacgggtatccaatgtccagctccccaggctggcatgtcaaacgtgacttttttaaccctttgctttcctatggcctcaggtcaaataattccaagagaatcaacctctgaaaattggaatggctgttcccttgaaatgctggtggccctgttcttttcaggtcccctcacctaccagaaagctaacagcaatctaatccattctgctaccgcatatcatgttttcagggttcttggggtcaatggtctcccaggaaaaatccagtcccaagggaccatctgtaagtgacaggagggtgatgctctcatcactgtcccccgtttccaattctgtcaccatcaaaatgggggtcgtagtgttaagttggaaagtactgttgatgtacatgtggcctctcacttgggaagccaaacatttgtacccaatctagttttctttaatctgtgtttaaaactatctgctagataagctttaaatcagtcttattttaagaaaacactac

SEQ ID NO: 98749 - DNA, 1610 bp, Homo sapiens
  misc_feature (1251)..(1251): n is a, c, g, or t
ggtctttcaggcagtgcaggtcagcctggagcctggagatccctgtgtagaacagagactccctctcagaagccacagagacatttgtgaagcagctcagtagctttcttacagcgtctttgaaagtgactggggccttctgatccacatgaacacagtagatgttttggggagtgtagatggccctcaagagtctttcaaatgtatcagtctttgcggatgaccatgacataggccaaagggaactcggcttcgtctttggacacaggttccattatgcagtgattttggatcaagtatcgctggcaggttattatttctcaatggcgtcactgttatattttcatccaagaacattttcttgcctgtcacaatcatgccacacacttctgcaaggactgaagagtttgagatcttcccccatggaagatatttttgcgggacctaatagttactatacaggaataaaagagttatggacgtggccataagccctaggaccaacccaaatgcctctacctttatttttcctatggtcttttctggattcatcactcacctgattttatgccattgctgaagtcagtctgcaggtccctgcccagacttgagaaatgtgctctagcaacttatttgcagcaagaagtgcaatatgaccatttacttaaaagaaggaggatcaaccacaagtcggtagctcttctatttaaaaaatcaggtgactctttgaacatgagccagtggggccagctgaccacttcacaaaagccaggcacagttgggcacctctgtctaggtcaaccacaaattaagaccctagcaaattggccacagctgccagctcagggtgtttttcccatgtggagtacaggtggaatgtgtgttcatttggcacctctttttcccatgcagagccaccatcaccatcactgatgtcacctttgaatgcaagggacactatatttcttcaacttcaggcaatcacagttgtcctgaagtaggtcaccatttacgtggacagcacccagaactcctcgatagtggggtctctttacttaaaaataaagatcaagaatttatagtatttcaggattgaaaggaatcttgcagattattctcaccaattgattcagttacaaataaagaacactgacaatgacccataacgactattctatcacattttgtctccattttctcactgatggcctgagagggcctatggctgctttcacgttacaatggcagggntaagttgttgccacatctgaccaccgaagcttaaaatgttttccatctggcctttaccagagaaggtttgctgaccctctcctctgtatctacggatgtcccttgtataccactgtgcttgcactacatcaagacagcgattgtggacttgataccattttacaactttttgctttattttcaagatttcctcgtgaatgccagaatgacacgatatttggtagcaaagcatgagcttcaaagagaggtttgcgtgggtctagatcctggctttgctagtcctagttgtgtgacgttgggcaaatcacttttcctatctgtcttaatttctttgtcagtaaaataaagataataccagt

SEQ ID NO: 98750 - DNA, 383 bp, Homo sapiens
tcacagaacatgacataggtttcaaatggaagaactcttctaatgaagatggagaataacacattgtaaactagtatctttcacaacctaattgacactttcggtgactttttttggtgaataaacatcttaacatattcattttcccctatacacattttgattacacctcataatgcaacacggtaaaaaggacgtgattgacttttctgtgcaacctactaaaatatgtcctttcttataaggaaattaattttggttgcaacttttacctgtcacttttcatgaacctcaccaccacataattcaagacagagatatattaactatatactgaagtcttaagtatttgggggtagaagacacctttgaaaacctgaata

SEQ ID NO: 98751 - DNA, 731 bp, Homo sapiens
tgttcgttggtacccctacgtgctgaaatgaagagttctggagagaatctgagggatttgaggaatttcagatgttggggattttttcccccgcacagggagcggtattctgccctgtctacacattagaatcacttggcctggacaaaagcttttttaaaaaagcgttcccctcatctcctccccccaaaccccgcatttccatccactagattctaatgcgtaagcaggagtgacaactactgcccttgtgcttttttgggaacaagaaattgtccagggaaaagataaacgccaatcagtctctgatctcagtactagtctattttaagctaattaagcattgatttttttttttaagtttatgacaaactgctattttccattcagttaaactaaatgcgttttaatgataggacggtaattaatctaacctattaatgaaaagctgtatgtctcgcagaactatgataaactacctaatgacgtcagctaagggtctagaaatggaagaatgatcgctatatcttttttaaaaaatagaatttaggcatcttgggaaaaaaagaagctaatctacactggatttctgttagtgtgaagacttttgtccctgtacctgctagggcttacctgtaaatgaagtaagatggtcaacaccagggaaacaagtgttcctggtgcctggcagtggaacaccttgactatcttggaaagaattaactggcccc

SEQ ID NO: 98752 - DNA, 688 bp, Homo sapiens
ttttcataccaagaaaaaaaccagatgtcttaagatttgcaggcttttttttctttcattacatggattagacatcatttataacagagagaaggctaaagcaaagaactagactatgaagcagtagatgtgcagtggtatccctgccaatctgtgtcatgggcttcccattctttccatggtgctgcatgttgcagaagtgagcatggtcctttctttcagatctctgggtcagagctgggaatctgcagtaggcagtgggatcttgaaaatacaatgccaacactagaaaagagtttggaaagctttccagaggtactaaatttgagctcagcgtaaagaatcttcaaccctctgattttcatgcattcttttggagaccaaatctgaaagcacctcttgggagagcccattagcaggtcgtactacttttaccttaattctcacatggaggaatctacaaagcacttttattacctcatagaatcttctccaaagcttatgtcgagatcatttttcccacttgacagataaggaatctctggcttcgagttgttttcccaaagtccaagacctcattcattggtattaagttgatccagaatttgatagcaatttcacgcaatgatgaaaaccagggtgaactagaagaaggtctacaagaacaaagcgggaatgagcttttata

SEQ ID NO: 98753 - DNA, 348 bp, Homo sapiens
ttgcacaatatttccctaataatttgcagtgagctgagagtcaaacttaaaactgtaaactccggggtctgccatccttccctggtactgtcagagaacactcctccgccttgtcattttaaaacttcttttcggccgggcgcggtggctcacgcctgtaatcccagcactttgggaggccgaggagggcggatcacgaggtcaggagatcgagaccatcctggctaacacggtgaaaccccgtctctactaaaaatacaaaaaattagccaggcgtggtggcggcgcctgtagtcccagctactcgggaggttgaggcaggacaatggtgtgaacctggagggcagc

SEQ ID NO: 98754 - DNA, 305 bp, Homo sapiens
cactttcaacatccatatttctaccagtagccttcaagataattgtcttagtcatttggactgctctgacaaaatactataaactgggtagcttataggcaactgaaatttatttctcacagttctggggtctgggaagtccaaaatcaaggtgttggcaaattcagtgtctagtgagggcctgcttcctcacagatggctccttccctctgtacccttatatggtgggagggtagaactccggtcccttcatcccttataagggaatgacctaatcacctcccaaaggccccacctcctaatat

SEQ ID NO: 98755 - DNA, 337 bp, Homo sapiens
ctattgtgaatagtgttgctatgagcattcatttgcaagcttttgtttgaacctcagttttcaattctttggggtgcatacttaggaggggcattgctgggacatacggaaacgctatgtttaacttactgaggagccaccaaattgttttcccagcagttgcaccattttacatatccaccaaaagcaatgcgtgagtgttccaatttcctaacatcctcaccaatacttattttcaagtttttttttttttgacactcgctctgttgcccaggctggagtgcagttgtgcaatcttggctcctgcaacctccacctcctgggttcaagcgattct

SEQ ID NO: 98756 - DNA, 796 bp, Homo sapiens
aaaaaaccatacatacagtgagatatcacttcatatccactagtctgggccatcatttttaaaatggaaaatcacaagggctggtgaggatgtggagaaattgtaacactcatgcaatgttggtgggaatgtaagatggtactgccactttggaaaagagtgtggaggttcctcagtaaggttaaacacagaattaccatatgatctagtaattctactcctaggtacatacctcagagaattgaaaacaggtgttcaaacagaaatttggacttaatgttcatagcagctccatccacaatagccaaaaggtggaaacaacccaagtttccatgaacagataaacagatcaacaaaacgtgctatgttcatacaatggaagagtattagctccaaaaggaagcactgatgcattctacaacatggttgagcctagaaaacatgctaagtgaaagaagccagacacaaaagaccaatgtatgactccactgatgtgaaatctccagaatggaccaatccctacagaggggagcagatcagtggctgcccagagcttggaggaggggaatagggagtcactccttcctgggcaccaggtttcggtttggggtgatgaaatgttctataaccagacagtggtgatggttgcataacattgtaaatatgcttaatgccactggattgcacaatttaaaatggttatgatggtaaattttatgttatgtgtgttttaccacgtacacacataaaacttattttgtgccattaaaaagaaaaagctctatgaagcaaaaaa

SEQ ID NO: 98757 - DNA, 337 bp, Homo sapiens
gcatcttccaagcacagctccctgccccacagttcctccctcgcacctactgaggttctgagctgtcagccccccagtattgaaactcaaaaaattagggaacatgataacgcattctgccctaatattgtccttttaatgtctaattatcattgtagacaaagtggcttgaacttaggctttcatcctagaagctttaccacttttactgtttctatacttttgtagctaataagtcaaatgtagaacaaagagaaggctgcatttgttcaggaaactgtaaatctgtcccatttgatcacaatcctgttgaaaggaagaagccttacgaggacag

SEQ ID NO: 98758 - DNA, 136 bp, Homo sapiens
cgtccgcgctgactctatgagtatcccttcgactgtggactcagaggggcccggatggaggccctgggacacggggctgggactgatgcacgccaggcagccctgggcaacgtcaggatcttggtcaagttctttc

SEQ ID NO: 98759 - DNA, 418 bp, Homo sapiens
ccatatctaactcaagctctaacaacttctttaaaaagaagcttttgctgctacagaaagaatttctgcaaagcaggaagcctgaagtcagcaatgattaaactgccccttgaaacccttagctacttgcacgtctctttgtctttggggtctcatctcagcaattcgtttcagcttcagtctgcaccaggatctcaaatctgtcatggcgagggcaagaagaaatgccctcctaacaagactctgggcatcgctggagctgcctgcaatccagacttccaaagactcatattcttcatgagcaggtaacgaagctcataggaacaggagaaactgcacaaaagcagaaaatgacaattcagaacacacacccatccagtgatggcattaaggaaatcctcaaagcccttagcaatgt

SEQ ID NO: 98760 - DNA, 622 bp, Homo sapiens
aagtgctgggactacaggcgctcatcaccacgcccggctaacttttttgtatttttagtagagacggagtttcctcgtgttagccgggatggatgtcctgtctttctattgtatcctctccctcacttggggaggaggcagtgatgttcctgttttgcagaagagccggatcgggcagccagagagttgaagtgacctgcccaaaaagggttcaacctaaatccttgggcttcctgtccagggctctgtaggatgtcagccatccccagaatcaggcattctcaggatgtcctgtgaagaaacacacttctccatcccctgctggaaaaaccatgacaatctctccgcagggaagaacgcggctttgaggtggggagtggctgaccgaggccctttgtggtttctaaatggcagaatgagagaggtgggggcgttgagggtgtcacgcccaggaagcagttggggagggcagggctggacactgaccaagcctagcctgggtgcaggaactgagcttgggatttttgcttggggccctctagggattaggatgaattgtcagatgagttctcagcagacagggctttagggaactggtccagggaaataagacgtagagcca

SEQ ID NO: 98761 - DNA, 406 bp, Homo sapiens
acaaggggaagaatttgtctattgaagaaaaacattatgtgcagttgcttaaagttctgtagagacagtctggagcttaggttaattcgcagacactaacctcctgcagaagccacaaaaggttattacgcataacccatggttcccacaggcaggcatccttgatatggaaaattgagacaaagcaggagaaggattaaaacaggctcatcaaaaaggtcttagctgattcttagttgattcttctgttttctccacttggagtttagtttgtactgtacttctaccattatctccttattattctgtgggacaacagcctgaatctaaaaatctgaaagaatatgttgtcccacccacagctccaattgaaaataaaaaacagagaggataaaaattggcctat

SEQ ID NO: 98762 - DNA, 384 bp, Homo sapiens
actgagaggtggcttctgggctaaaggaaaggttcaaagtggggtagggctgtttaccataaacataggtgggttagtggggactgccttttgcagggggctgtccactccacactgcaatgagccagtcaaatgggagttccaagaccagaggaaacctagcccagagcttgagtcttccaggctaaccctgggtcctggggggaccaggagatgagacccagggaatagtagtgtccatgtcggtcatctcaaaggttcaaagcaggctgggaggtcaagtctgcagatgggctgactgggcagtggaagtgataaggttggccagttaatgatgggttgatatattcatctgttttcacactgctatgaagaactatgtgg

SEQ ID NO: 98763 - DNA, 350 bp, Homo sapiens
cagcctgggcaacagagctagactctgtctcaaaaaaataaataaataaaaagaatggttacccaggtgcggtgctgtgcacctgtggtcccagctacttgggaggctaaggtaggagcatcttttgggtctgggaggtcgaggctgcagtgagccatgattgcaccgtagtgctacagcctgggtggtggcgtgagaccctgtcttcaaaataaaaataaaaataatgtttgggggctgggcaaaatgattctcacttgtaatcttagcactatgggaaattggggaaggcagatcacttgagcccagaggttcaagaccaccctgcacaacatggcaaaaccctctct

SEQ ID NO: 98764 - DNA, 701 bp, Homo sapiens
aatatgaggaggcctcccggccccagcctcctgcctgcctctccaaggactccacgcctgacgaacccgacgtccatttctccaagaagttcctgaacatcttcatgagtggccgctcccgctcctccagtgccgagtccttcgggctgttctcctgcatcatcaaccgggaggagcaggagcagacccaccggaccatattcaggtttgtgcctcgacacgaagacgaacctgagctggaagtggatgaccctctgctagtggagctccaggctgaagactactggtacgaggcctacaacatgcgcactggtgcccggggcttctttactgcctattacgccatcgaagtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtgtcaaggccgatgactcccaggaggccaaggggaataaatgtagccactttttccagttaaaaaacatctctttccgcggatatcatccaaagaacaacaagtactttgggttcatcaccaagcac

SEQ ID NO: 98765 - DNA, 228 bp, Homo sapiens
ctaagaaaggcctggacaaaatattgcttaaaggtgttctagaagagaaaaatgagagaggtaaacaaatcggggggtgagtggaaaagagataatatcgttatgttgctagttaactgtttcccaaacatgtggttaactttcatacctacttgcctttcctcctgcttttctcttggtcctctctctggctggctgagccccattcagcaactgtgggtgcgagtc

SEQ ID NO: 98766 - DNA, 1033 bp, Homo sapiens
ctaagaaaggcctggacaaaatattgcttaaaggtgttctagaagagaaaaatgagagaggtaaacaaatcggggggtgagtggaaaagagataatatcgttatgttgctagttaactgtttcccaaacatgtggttaactttcatacctacttgcctttcctcctgcttttctcttggtcctctctctggctggctgagccccattctttgacaattcagcttttatatgttgttatagcttttcctcattcctttatgcagaatttcttatttatccatgtcctcatagcacctaatgtacctgtagacagtgtttctaaatggagttgcagacctctttgagaataaatatgaaatgtgtgaatcctcttcctagaaaaatctacattttactcttttgcaaataatttcagagaaagcctggattcctagaggcctgttccatagaccccagattaagaacccctggcttttgtttgtttgttttactttaaaaaattacttggctaggcacagtggctcatacctgtaattctggtactttgggaggctgagatgggaggattgcttgagcttgggaggtcagggttgcagtgagccatgattgagccactgcgctctagcgtgcgagacagaacgagactctgtctcaaaacaaaaatccagggttctaggtagttaaaaaaagaaaaaagaattatttcaactttattcatatttctttggctggggtgtagggggctgggggcgcatatttgcaaaaacttgaaactaattccattaaagtgacaaaaatgtaaataatctctctctttttgccatactgtataattaaaaatatgtagcagttaaaagtcttaccaaaattggccggtgcactggctcacacctgtaattctagcactttgggagactgaagtggattgacaaaaggattgcttgaggccaggagtttccgaccagcctgggcaacatggcgagaccctgtccctacaaaaaaaaattttttttaattacttgggcatggtggt

SEQ ID NO: 98767 - DNA, 1522 bp, Homo sapiens
aaccccctttccccggctcccccgcagtttcccgggccggcagaggcgccgcagcgtcggagcaatgcaaggctaagccgggaagatctgcctgcactgcaagtgtccccaggaggagcacatggtgacagtgatgccgctggagatggagaagaccatcagcaaactcatgtttgactttcagaggaactcgacctcagatgatgactcaggctgtgctttggaagagtatgcctgggtcccgccgggtctgaagcctgaacaggtaccattctggatgggagcatgctggtggtttgggtgtttcactttgccttactggtccttcctcattccagttctgtaggaagagtagactttgctgattcagagaagtggtagggctaaatatgttgaagatgccaggggccccagtggaaaatgaggaagggaaatgaaattgagccaggagtgatccattgctaattcattctgtattgtcattattaactgttaccaggagaatcacttgaacccaggaggtggaggttgtggtgagccgagatcgtgccattgcattccagcctggatgacaagagcgaaactcagtctgaaagaaagagacagagagagagagaaaagaaaaagaagaaagaaagaaggaaagaaaagaaagaaagaaagaaagaaagaaagaaagaaagaaagaaagaaagaaagaaagaaagaaagaaagaaagaaaatatgtatgttagataatcttcagtcaggcatgagttatagtgctgttgggcatgagttatagtgcttgttggccataagttaaatgttaatgaatcaacaatacatattaagtaagttgcccttaaaaagaaacacacatgaaacaaggttatggattaatgggttaacgaaaatgttgggaccagaggctcacaggaacctaaccccatatttctcctaggaggaatgtttagtattcagaaattcagtgtttgctgtgattttatagcacataactgccatgaataaagagaatcacttgtgtttacctttgcaaaatgtaatatcctgtttacatagtactctcttctttccctgctgtggcagggattatggctatttacaaatggttggttccttcttcttccaggcacaaagggggaatgtactttctcagtccgtttaaagttaggcatgtccatgagacttgctttcaccaatgaaacctgaacagaagtcacatgtatcatatccaggaaaaaagcttttcactgccagtgttcagctccaaccatccttttctctgctgccatcctcatggaggcatatctccatatggagcccccatcacctgggtctctgcctacctataggaggatacagtgtgagacagaaataaaatcatggtatagataagggtttaagatacagaatatatacggttcaacaagaagacaactcagttaaaagatgactgaaggacttcaatcaacatctctccaaagacaatatacggtcggctgataagcacatgaaaag

SEQ ID NO: 98768 - DNA, 1081 bp, Homo sapiens
ggcacgtcatatgctggagactaacagagaaaatggtaaagccagctctcaggggagtctgccgagaaagccctaccctctggttcaccagcatgtctgctgaattctctgtttctaggaaaatttactagctttatttttccctcacagagagagggaaaaatcccagatatggatgatttgcctgactcttgctttaaggatgaatttctctgcttaccataggaaactcatctgctgttgactttcataaagagtcaggactgcagaagtcagttacatcctgctgggggaatcatcttcccagtaagtgggaataggcacatggtttgagtaatgggcaagtcatctatatgctttctgtccttcaggtacaccagtactatagctgtctcccagaagagaaagtcccttatgtcaacagtcctggagagaaactgcgaatcaagcagctactacaccagctgccgccacatgacaatgaggttcgatattgcaactccctggatgaggaagagaagagggagctgaagcttttcagcagccagaggaaacgcgaaaacttgggccgcgggaatgtcaggcctttcccagtcaccatgacaggagctatttgtgaacagtgcggaggccagatcaatggtggagacatcgctgtgtttgcgtcacgcgctggccacggcgtttgctggcacccgccgtgcttcgtatgcactgtctgcaatgagctcctggtggatctgatctacttttaccaagatgggaagatatactgtggcaggcaccatgctgagtgcctgaagccgcgctgtgctgcctgcgatgagatcatctttgcagatgaatgcacagaagctgaggggcgacactggcacatgaaacacttttgctgcttcgagtgtgagacagtgctgggcggccagcgctacatcatgaaggagggaagaccctactgttgccactgcttcgagtccttgtatgcagaatattgtgacacctgtgcccaacatataggtatcgaccaaggtcaaatgacctatgatggccaacactggcatgccactgagacctgtttctgctg

SEQ ID NO: 98769 - DNA, 660 bp, Homo sapiens
ggcacgtcatatgctggagactaacagagaaaatggtaaagccagctctcaggggagtctgccgagaaagccctaccctctggttcaccagcatgtctgctgaattctctgtttctaggaaaatttactagctttatttttccctcacagagagagggaaaaatcccagatatggatgatttgcctgactcttgctttaaggatgaatttctctgcttaccataggaaactcatctgctgttgactttcataaagagtcaggactgcagaagtcagttacatcctgctgggggaatcatcttcccagtaagtgggaataggcacatggtttgagtaatgggcaagtcatctatatgctttctgtccttcaggtacaccagtactatagctgtctcccagaagagaaagtcccttatgtcaacagtcctggagagaaactgcgaatcaagcagctactacaccagctgccgccacatgacaatgaggttcgatattgcaactccctggatgaggaagagaagagggagctgaagcttttcagcagccagaggaaacgcgaaaacttgggccgcgggaatgtcaggcctttcccagtcaccatgacaggagctatttgtgaacaggtaagcatggattcaggggagtgaagaggcattgttc

SEQ ID NO: 98770 - DNA, 975 bp, Homo sapiens
aaccccctttccccggctcccccgcagtttcccgggccggcagaggcgccgcagcgtcggagcaatgcaaggctaagccgggaagatctgcctgcactgcaagtgtccccaggaggagcacatggtgacagtgatgccgctggagatggagaagaccatcagcaaactcatgtttgactttcagaggaactcgacctcagatgatgactcaggctgtgctttggaagagtatgcctgggtcccgccgggtctgaagcctgaacaggtacaccagtactatagctgtctcccagaagagaaagtcccttatgtcaacagtcctggagagaaactgcgaatcaagcagctactacaccagctgccgccacatgacaatgaggttcgatattgcaactccctggatgaggaagagaagagggagctgaagcttttcagcagccagaggaaacgcgaaaacttgggccgcgggaatgtcaggcctttcccagtcaccatgacaggagctatttgtgaacagtgcggaggccagatcaatggtggagacatcgctgtgtttgcgtcacgcgctggccacggcgtttgctggcacccgccgtgcttcgtatgcactgtctgcaatgagctcctggtggatctgatctacttttaccaagatgggaagatatactgtggcaggcaccatgctgagtgcctgaagccgcgctgtgctgcctgcgatgagatcatctttgcagatgaatgcacagaagctgaggggcgacactggcacatgaaacacttttgctgcttcgagtgtgagacagtgctgggcggccagcgctacatcatgaaggagggaagaccctactgttgccactgcttcgagtccttgtatgcagaatattgtgacacctgtgcccaacatataggtatcgaccaaggtcaaatgacctatgatggccaacactggcatgccactgagacctgtttctgctg

SEQ ID NO: 98771 - DNA, 103 bp, Homo sapiens
cctgctccatgacctcagtgcattcttagaaagtctgcgagcctcagtttcctcacctggaaaatgggtacaatactaccgaaaagagaaaaatagctcagag

SEQ ID NO: 98772 - DNA, 273 bp, Homo sapiens
gtatcattggcaaacttccctctacacagctgaggcttaacaacaatttttgttattttcacgtttccaagttccaaatgttagcaccccctttttctttacttttgttagtgtgacagtggatataagggaagtgctcaatttaagaaggattcaaagaaaaaaaaaaaaaagaatgatccaatcagggctccagcttcttcaaatgttcccaagcccagagttttctacatggttcaaacacacacacacacacacacacacacacacaca

SEQ ID NO: 98773 - DNA, 552 bp, Homo sapiens
atcagcgagtgatcagatgtccaagtttgaagcgtgagggagtctggctggagtgggtgtttgggaggcaacggcttgggggtgatgttgagtttctggcctgtgttgtctcacctggaaaaagagggtgcaaggaggagaggttgtgccctgtgcagtcaggtgcatgaggaggctatggccaaggagagtggacgcaggcactcatggaagtggggctggagacctggagagggtagtggccagggagccagggtgcagtgactctcagcaaggccccttggctcatgggccaggtccagctaccacatttttgtaagtgaggtcctgtggggtggcacaccccatgttgatgtcttgtgtgtggccactttcattccaccccagcagagctgtgtagtggtgacggagaccatgcgtggtccttcacggagagtgcagtgcctggcatgggagggccggagaggtctgggggctgagagagagagggtgggatcagggccccgggaggagggtctggccttggaggtgaaaagggaccacgttctcctg

SEQ ID NO: 98774 - DNA, 342 bp, Homo sapiens
gcattttacacacattggaggagtcgtatgcactgtttttctctgttgccgacggaggcaagaaggccttctaattagtctaacttaaacggatgggattcacttaacaaaagcaagaagaaaagcacacgaacaggtgtcttaatgcatttggatagtttctttgcggtgtgtgtgtgtgtgtgtgtgtgtgtgtgtgtgtcttggtgaaggtgaggggctgtattttcaccaagccttttcataatcaagtttgctttgcaaaccttatggccttgcaccccgcagaacagtccttcctaatagcagggatgctctgtcatggttttctgtaaattatca

SEQ ID NO: 98775 - DNA, 866 bp, Homo sapiens
ccccagaatttcctgtgcaatcgcaggtccttctcattccctcttgggccaacccatgtcccaggaaatggatatagctatggaggattaaaaaaatttcttttcacatctcttcatctggattggcatctgacagaaacctgctcgcccattcccttcatttcctccctcaaggagatgattaatacgcctgggcaatgctcatcaatatctttggacagatcaactggagttttcattaaacccatattaatgtcctagatacacagctgtggacaggttattctggaggaaaaaaaaaagaaaagaaaaaagaagaatgaaaaagaaaaagaaaaaaaaaccttccacttcagttaactatttgccaagaattaacagaaacctggccccttccctcattagggcttcttccaccaacatgttttgatgtatatttcatgaggataaacaaacattcatttcactttgggaaggtgtttgccgtaatgtattgtcagcgtacccagcaatgaggggacattaatttcaattctggtgtttaaacactttggcgagtcccaattactcattccccagctcgataggagccctggaggaaggtcgttgcctctctgcgtggcctgcggcaccaaggggaggcgcgacgccaccctccagccagacacaggtcttctttggctgagagagcagggatgaggcaagacggggttgttccctcctattccttagtcaaatagtgacatgaagggccacttcagggaatacccagacttgcattacagcagtttccatgaaaggctgtgtgcaaagaagagttcaggaaatcagatcctatttttttcttagcccacatctgaggatga

SEQ ID NO: 98776 - DNA, 760 bp, Homo sapiens
gtttccccaaacgtcctcatacgttttcagcccccacacccccctctcactcctgcccctgatccatacctatcccagaccagaggcctctccccatttccactcaatgcagtccctcctcagtgggctatctgatacatcctgatatcttaaggagaagagatggtgatagggaaattcagcccctcccccatcttgcaccctagagttcttcgtttcagtgcccgcgccgtgcccccgtcggtggctcaagccccagtattttcccagcaacctatctttagtctgtgcacacctccctgagcctgcttcttccttccagaaaataagccagaccaaggggatggggtccttttacctggaagttgtccaaggatgcagggtgcaaggggccctgggaagtgtttctccagagcaggaatgtgggatgtccagggtctgcagagtcctggcttgttgacttgtctaccttgggctcagatatcctgaaattttggcttactgttaacatttatgttaaaattaggcctttcagagcttggggagcagaaaatctatcaagcttccaaatgcgaaattgaagcagcctgtcttggaagatgaacatgtcaattttagtgaagtttgtcttacgtttttacctctgcaagttatttaagctagaagctccccagtttatagatggttcccccaaaaactaaggccttaggtgggagttggggggggcgttgacttaagtctcccagatacttagtagcaa

SEQ ID NO: 98777 - DNA, 645 bp, Homo sapiens
acatcaccaccttctgctagctatgcaatgctctccatcctacaggactcacatccagggtgacgagctgcagatcaaggtggattaaacagagctggaggcaggggttccattgaatagaaacacagaagcagagctgcctgggagactgcatgcagggaaatgatggcaggagctctctccatgggaggttatagcagctcttgatggaggaaaatgggaatctgtgagttcttagaagctgaagaaaaaagatcctggaactttaccatagggcagaggatgatggaagacgtaggatctgacgttggttctgccctttggaatttgtacgtaggctttagcttttcccaacaataagcacggcaatctgcaatttcttcacatctgagtggcagtgacttcactcataggtagtatcaaatggcctgcaaccagtggcatttgcttattctgccaaggtattatgccaacactgcctggaatctatgctcattatggaggaggcagagcaagatagccagatagaaccctccagcgatcatccccctggaggacatcaaattgaactattcacctaagaaagcaccttcataagaatctacatcatggccattaaaaaagcattggttaaataaatatcga

SEQ ID NO: 98778 - DNA, 461 bp, Homo sapiens
  misc_feature (5)..(5): n is a, c, g, or t
  misc_feature (21)..(21): n is a, c, g, or t
  misc_feature (31)..(31): n is a, c, g, or t
  misc_feature (59)..(59): n is a, c, g, or t
ttganttacgaatttaaatangactcactanggggaaatttggcccctcgaggcccaanaaattcgggcacgaagaactgcctgactgcttgttcgtctcactggtgtgagctccagcatcccctttgctcgaaatggaccccaactgctcttgcgccactggtggctcctgcacgtgcgccggctcctgcaagtgcaaagagtgcaaatgcacctcctgcaagaagagctgctgttcctgctgccccgtgggctgtgccaagtgtgcccagggctgcgtctgcaaaggggcatcggagaagtgcagctgctgtgcctgatgtgggaacagctcttctcccagatgtaaatagaacaacctgcacaacctggatttttttaaaaatacaacactgagccatttgctgcatttctttttatactaaatatgtgactgacaataaaaacaattttgactttaa

SEQ ID NO: 98779 - DNA, 412 bp, Homo sapiens
cggacgcgtgggtcgacccacgcgtccgctgcctgactgcttgttcgtctcactggtgtgagctccagcatcccctttgctcgaaatggaccccaactgctcttgcgccactggtggctcctgcacgtgcgccggctcctgcaagtgcaaagagtgcaaatgcacctcctgcaagaagagctgctgttcctgctgccccgtgggctgtgccaagtgtgcccagggctgcgtctgcaaaggggcatcggagaagtgcagctgctgtgcctgatgtgggaacagctcttctcccagatgtaaatagaacaacctgcacaacctggatttttttaaaaatacaacactgagccatttgctgcatttctttttatactaaatatgtgactgacaataaaaacaattttgactttaa

SEQ ID NO: 98780 - DNA, 629 bp, Homo sapiens
ctgggaggagggtggaaggcaacctcggggaaactgggaaaggcggcctggacttcgggaacaccgcgtacctgcgggggcacagccccacccgagcgaacgggctccaaaggggaggtcccgcggtgcccaccgcgcagagctcagggggtggtgcgcccggcccttctgcggcgcacagcccagcccaggaacgcgggcggtgcggactcagcgggccgggtgcaggcgcggagctgggcctctgcgcccggcccgacctccgtctataaatagagcagccagttgcagggctccattctgctttccaactgcctgactgcttgttcgtctcactggtgtgagctccagcatcccctttgctcgaaatggaccccaactgctcttgcgccactggctgctgttcctgctgccccgtgggctgtgccaagtgtgcccagggctgcgtctgcaaaggggcatcggagaagtgcagctgctgtgcctgatgtgggaacagctcttctcccagatgtaaatagaacaacctgcacaacctggatttttttaaaaatacaacactgagccatttgctgcatttctttttatactaaatatgtgactgacaataaaaacaattttgactttaa

SEQ ID NO: 98781 - DNA, 695 bp, Homo sapiens
ctgggaggagggtggaaggcaacctcggggaaactgggaaaggcggcctggacttcgggaacaccgcgtacctgcgggggcacagccccacccgagcgaacgggctccaaaggggaggtcccgcggtgcccaccgcgcagagctcagggggtggtgcgcccggcccttctgcggcgcacagcccagcccaggaacgcgggcggtgcggactcagcgggccgggtgcaggcgcggagctgggcctctgcgcccggcccgacctccgtctataaatagagcagccagttgcagggctccattctgctttccaactgcctgactgcttgttcgtctcactggtgtgagctccagcatcccctttgctcgaaatggaccccaactgctcttgcgccactggtggctcctgcacgtgcgccggctcctgcaagtgcaaagagtgcaaatgcacctcctgcaagaagagctgctgttcctgctgccccgtgggctgtgccaagtgtgcccagggctgcgtctgcaaaggggcatcggagaagtgcagctgctgtgcctgatgtgggaacagctcttctcccagatgtaaatagaacaacctgcacaacctggatttttttaaaaatacaacactgagccatttgctgcatttctttttatactaaatatgtgactgacaataaaaacaattttgactttaa

SEQ ID NO: 98782 - DNA, 506 bp, Homo sapiens
  misc_feature (5)..(5): n is a, c, g, or t
  misc_feature (21)..(21): n is a, c, g, or t
  misc_feature (31)..(31): n is a, c, g, or t
  misc_feature (59)..(59): n is a, c, g, or t
ttganttacgaatttaaatangactcactanggggaaatttggcccctcgaggcccaanaaattcgggcacgaagaactgcctgactgcttgttcgtctcactggtgtgagctccagcatcccctttgctcgaaatggaccccaactgctcttgcgccactggtggctcctgcacgtgcgccggctcctgcaagtgcaaagagtgcaaatgcacctcctgcaagaagagctgctgttcctgctgccccgtgggctgtgccaagtgtgcccagggctgcgtctgcaaaggggcatcggagaagtgcagctgctgtgcctgatgtgggaacagctcttctcccagatgtaaatagaacaacctgcacaacctggatttttttaaaaatacaacactgagccatttgctgcatttctttttatactaaatatgtgactgacaataaaaacaattttgactttaaaaaaaaaaaaaaaaaaaaagttttgcgtcgacgcggccggcaatt

SEQ ID NO: 98783 - DNA, 1209 bp, Homo sapiens
  misc_feature (847)..(847): n is a, c, g, or t
ccggggactggagcaggagggctgcaccgggactccgggacaggcccagttgaaaacggcggggcgagggggtggggtggagacgcccgcgacgccaaggctggggtcccggaaagcgcggggaggagggtggaaggcaaaggcaacttcggggaaactgggaaaggcggcgggacctcggggacactgcgtaccacccggcgcacagcccctcccgcgcaaacccgagccaaaggggcggtcgagcggcgcactcggagcggagctcaggggatggtgcgcccggcacttatgctgggctcagcccagcccagcccaggaccgctggcggtgcgaacccagccgggcgggtgcaagcgcggggcagggcctctgcgcccggccccctcccctgagtagaaaagcagccgcaggctgtggcgctccaccacgccgtccgggtgggcctagcagtcgctccatttatcgcttgagatctccagccttaccgcggctcgaaatggaccccaactgctcttgcgccactggtggctcctgcacgtgcgccggctcctgcaagtgcaaagagtgcaaatgcacctcctgcaagaagagctgctgttcctgctgccccgtgggctgtgccaagtgtgcccagggctgcgtctgcaaaggggcatcggagaagtgcagctgctgtgcctgatgtgggaacagctcttctcccagatgtaaatagaacaacctgcacaacctggatttttttaaaaatacaacactgagccatttgctgcatttctttttatactaaatatgtgactgacaataaaaacaattttgacttgaaaaaaaaaaaaaaaaaaacaanacaagacacacaacgcagcacaagagcacgccgcttgtgttggggcgcggcccgcggcgccccccagagaagaaggcttgttctcgagaacaccatctcccttatgggggccgacgagggcccccacgacaaggggctcgagcagagaaccgggggggcaccaagtgggggtgcccccacgaggaggaaaaccccgggggaccggcagaacaacgagagcggtgcgggatggaccatctcttcccgccgcgaaaaagaaaaggcccccggggggggccaccgcgggagagtcctttggagcacaagagccccaagaggggggccgttagcgaagagggcgcctatcaggacgggctccacac

SEQ ID NO: 98784 - DNA, 295 bp, Homo sapiens
ggctcggcacctattggactttcttccagcatttttctcttgggacacaaatcccaactgtagcatctatggtttcagaacagagctgtgccagacgtaaaaagcttcctctgggtctgggttctgagctccagccaggcttgctattggggcagggcggtgcccggtcaagtctactgctacctctctctccccttcttccccaggctgctgttcctgctgccccgtgggctgtgccaagtgtgcccagggctgcgtctgcaaatcctgctgactaacaatgaagcctggaaga

SEQ ID NO: 98785 - DNA, 1632 bp, Homo sapiens
ctgggaggagggtggaaggcaacctcggggaaactgggaaaggcggcctggacttcgggaacaccgcgtacctgcgggggcacagccccacccgagcgaacgggctccaaaggggaggtcccgcggtgcccaccgcgcagagctcagggggtggtgcgcccggcccttctgcggcgcacagcccagcccaggaacgcgggcggtgcggactcagcgggccgggtgcaggcgcggagctgggcctctgcgcccggcccgacctccgtctataaatagagcagccagttgcagggctccattctgctttccaactgcctgactgcttgttcgtctcactggtgtgagctccagcatcccctttgctcgaaatggaccccaactgctcttgcgccactggtaagggaagctctgcgccctggaatccccatttcccagccctattacagagggtctctgggtttcaggaagtcgcattttaagttctgagcgacggggactccagtacttcgttagatgctttcttcctgatcacgcccctgagagcattgccctcatccctgggcctctacgtcagagttaagaatactgaggctcaaggctgaactgctccacatcacccagttggtcatgggcctgctggctgggccccagtgctctgtccaggctctgagcaatcagtgtggttgggggtgctggaaacattgactcttcagagttcaggacagaaggttctggctcgcagtctcaatattcctgggttgtatgtgcacgtggggaccttcctggtgcggttaaaacaggagggtccttgcccttcccagcgtttagtggagaggacatggggcttctgttcctctgtcctgagtgggaaaggagctctgagggctggccctgcacagaggagggggcactggagactcactgacccactgctgtaccttctgcatctcactcactgcccactgcgttttcctcttccttgtaggtggctcctgcacgtgcgccggctcctgcaagtgcaaagagtgcaaatgcacctcctgcaagaagagtgagtgcggggccatctccaggaatctggggctgtggctcaggttgggagggaactcaaggctggccctgagtgcatccttctggggaactgggctttctttgccctcattgcccgtgtcattccctctccaggctttctgccctaaattcagatggggcaggacagcatttttctcgtgggacacaaaccccaactgtaccccctatggtttcagaacagagctgtgccagacgaaaaaaagcatcctctgggtctgggttctgagctcgagccaggcttgctattagggcagggaggtgcccggtcaagtctactgccacctctcactctccccttcttccccaggctgctgttcctgctgccccgtgggctgtgccaagtgtgcccagggctgcgtctgcaaaggggcatcggagaagtgcagctgctgtgcctgatgtgggaacagctcttctcccagatgtaaatagaacaacctgcacaacctggatttttttaaaaatacaacactgagccatttgctgcatttctttttatactaaatatgtgactgacaataaaaacaattttgactttaa

SEQ ID NO: 98786 - DNA, 921 bp, Homo sapiens
  misc_feature (755)..(756): n is a, c, g, or t
  misc_feature (760)..(760): n is a, c, g, or t
  misc_feature (768)..(768): n is a, c, g, or t
ctgggaggagggtggaaggcaacctcggggaaactgggaaaggcggcctggacttcgggaacaccgcgtacctgcgggggcacagccccacccgagcgaacgggctccaaaggggaggtcccgcggtgcccaccgcgcagagctcagggggtggtgcgcccggcccttctgcggcgcacagcccagcccaggaacgcgggcggtgcggactcagcgggccgggtgcaggcgcggagctgggcctctgcgcccggcccgacctccgtctataaatagagcagccagttgcagggctccattctgctttccaactgcctgactgcttgttcgtctcactggtgtgagctccagcatcccctttgctcgaaatggaccccaactgctcttgcgccactggtggctcctgcacgtgcgccggctcctgcaagtgcaaagagtgcaaatgcacctcctgcaagaagagctgctgttcctgctgccccgtgggctgtgccaagtgtgcccagggctgcgtctgcaaaggggcatcggagaagtgcagctgctgtgcctgatgtgggaacagctcttctcccagatgtaaatagaacaacctgcacaacctggatttttttaaaaatacaacactgagccatttgctgcatttctttttatactaaatatgtgactgacaataaaaacaattttgactttaaggaaaaaaaaaaaaaaaaaaaaaaaaaaaaaaaaaaaaaaaaaaaaacaaaaaaaaaaannaaangaacaaanaaaaaagaaaaataagacaaacaatgaagaccaaataagcaacgaacaaagcaacgaagaaaaaaacaagaaataagaaaacagaaccagaaagaaaccagacgacacacgacagcagaactaaaaaaacggaacatgagacaaagacattcc

SEQ ID NO: 98787 - DNA, 809 bp, Homo sapiens
  misc_feature (5)..(5): n is a, c, g, or t
  misc_feature (21)..(21): n is a, c, g, or t
  misc_feature (31)..(31): n is a, c, g, or t
  misc_feature (59)..(59): n is a, c, g, or t
ttganttacgaatttaaatangactcactanggggaaatttggcccctcgaggcccaanaaattcgggcacgaagaactgcctgactgcttgttcgtctcactggtgtgagctccagcatcccctttgctcgaaatggaccccaactgctcttgcgccactggtggctcctgcacgtgcgccggctcctgcaagtgcaaagagtgcaaatgcacctcctgcaagaagagtgagtgcggggccatctccaggaatctggggctgtggctcaggttgggagggaactcaaggctggccctgagtgcatccttctggggaactgggctttctttgccctcattgcccgtgtcattccctctccaggctttctgccctaaattcagatggggcaggacagcatttttctcgtgggacacaaaccccaactgtaccccctatggtttcagaacagagctgtgccagacgaaaaaaagcatcctctgggtctgggttctgagctcgagccaggcttgctattagggcagggaggtgcccggtcaagtctactgccacctctcactctccccttcttccccaggctgctgttcctgctgccccgtgggctgtgccaagtgtgcccagggctgcgtctgcaaaggggcatcggagaagtgcagctgctgtgcctgatgtgggaacagctcttctcccagatgtaaatagaacaacctgcacaacctggatttttttaaaaatacaacactgagccatttgctgcatttctttttatactaaatatgtgactgacaataaaaacaattttgactttaa

SEQ ID NO: 98788 - DNA, 354 bp, Homo sapiens
  misc_feature (14)..(14): n is a, c, g, or t
cggcttccccagancccacccccgccccccggctcctgcaagtgcaaagagtgcaaatgcacctcctgcaagaagagctgctgttcctgctgccccgtgggctgtgccaagtgtgcccagggctgcgtctgcaaaggggcatcggagaagtgcagctgctgtgcctgatgtgggaacagctcttctcccagatgtaaatagaacaacctgcacaacctggatttttttaaaaatacaacactgagccatttgctgcatttctttttatactaaatatgtgactgacaataaaaacaattttgactttaaaaaaaaaaaaaaaaaaaaagttttgcgtcgacgcggccggcaatt

SEQ ID NO: 98789 - DNA, 718 bp, Homo sapiens
caccacgccgtccgggtgggcctagcagtcgctccatttatcgcttgagatctccagccttaccgcggctcgaaatggaccccaactgctcttgcgccactggtaagagaagccgaccctgcgccctaggaatcccatttcccagccccagtactgagggtctctgggtttgaggaggtcgcatttaagttctgagcggaagggaattcctttacttccttaggtgctttcttcctgatctcccctctgagagcactgccctccctcctgggcctctgggtcagagttaaggatactgagggtcaaggcagtcccgctccacatcacccagttggttagggtcctgctggctgggccccagtgttctcctccaggctctgagcaatcagggtggactgggggctggagacatttgagtcttcagggttcagcacagaaggttctggctggcaatctcagtattcctgggttgggtgtgcccctgggaccttcctggtagggtaaaacaggagggtgcttgcccttcccagcgttagtggagaggacaggggctttccctgagtgggaaaggagctctgagggctggccctgcacaaaggagggggcactggagactcattgacccattgctgtaccttcttcatctcactcactgcccactgcgtttttctcttccttgcaggtggctcctgcacgtgcgccggctcctgcaagtgca

SEQ ID NO: 98790 - DNA, 826 bp, Homo sapiens
ccggggactggagcaggagggctgcaccgggactccgggacaggcccagttgaaaacggcggggcgagggggtggggtggagacgcccgcgacgccaaggctggggtcccggaaagcgcggggaggagggtggaaggcaaaggcaacttcggggaaactgggaaaggcggcgggacctcggggacactgcgtaccacccggcgcacagcccctcccgcgcaaacccgagccaaaggggcggtcgagcggcgcactcggagcggagctcaggggatggtgcgcccggcacttatgctgggctcagcccagcccagcccaggaccgctggcggtgcgaacccagccgggcgggtgcaagcgcggggcagggcctctgcgcccggccccctcccctgagtagaaaagcagccgcaggctgtggcgctccaccacgccgtccgggtgggcctagcagtcgctccatttatcgcttgagatctccagccttaccgcggctcgaaatggaccccaactgctcttgcgccactggtggctcctgcacgtgcgccggctcctgcaagtgcaaagagtgcaaatgcacctcctgcaagaagagctgctgttcctgctgccccgtgggctgtgccaagtgtgcccagggctgcgtctgcaaaggggcatcggagaagtgcagctgctgtgcctgatgtgggaacagctcttctcccagatgtaaatagaacaacctgcacaacctggatttttttaaaaatacaacactgagccatttgctgcatttctttttatactaaatatgtgactgacaataaaaacaattttgacttgaa

SEQ ID NO: 98791 - DNA, 989 bp, Homo sapiens
  misc_feature (737)..(737): n is a, c, g, or t
  misc_feature (743)..(743): n is a, c, g, or t
  misc_feature (747)..(747): n is a, c, g, or t
  misc_feature (755)..(755): n is a, c, g, or t
  misc_feature (989)..(989): n is a, c, g, or t
ctgggaggagggtggaaggcaacctcggggaaactgggaaaggcggcctggacttcgggaacaccgcgtacctgcgggggcacagccccacccgagcgaacgggctccaaaggggaggtcccgcggtgcccaccgcgcagagctcagggggtggtgcgcccggcccttctgcggcgcacagcccagcccaggaacgcgggcggtgcggactcagcgggccgggtgcaggcgcggagctgggcctctgcgcccggcccgacctccgtctataaatagagcagccagttgcagggctccattctgctttccaactgcctgactgcttgttcgtctcactggtgtgagctccagcatcccctttgctcgaaatggaccccaactgctcttgcgccactggtggctcctgcacgtgcgccggctcctgcaagtgcaaagagtgcaaatgcacctcctgcaagaagagctgctgttcctgctgccccgtgggctgtgccaagtgtgcccagggctgcgtctgcaaaggggcatcggagaagtgcagctgctgtgcctgatgtgggaacagctcttctcccagatgtaaatagaacaacctgcacaacctggatttttttaaaaatacaacactgagccatttgctgcatttctttttatactaaatatgtgactgacaataaaaacaattttgactttaaggaaaaaaaaaaaaaaaaaaaaaaaaaaaacttggggggggnttggcncctnggagaagngttttataaacactctgttttggggggcgggccacattatggtatactgtgaacacatgtgcaaacggggtgtcccataggaaaacccgcgcactgaactagggtgtgggttttctaacaattaaaaaacggggcgggaacacgacgtgttttggaacaactcaagagggggttggagacaacgggcctatcaaccggggtcaagggagcgaatcagtgggacggggggtgggn

SEQ ID NO: 98792 - DNA, 349 bp, Homo sapiens
acaagcagtcaggcagttggaaagcagccccaactgctcttgcgccactggtggctcctgcacgtgcgccggctcctgcaagtgcaaagagtgcaaatgcacctcctgcaagaagagctgctgttcctgctgccccgtgggctgtgccaagtgtgcccagggctgcgtctgcaaaggggcatcggagaagtgcagctgctgtgcctgatgtgggaacagctcttctcccagatgtaaatagaacaacctgcacaacctggatttttttaaaaatacaacactgagccatttgctgcatttctttttatactaaatatgtgactgacaataaaaacaattttgactttaa

SEQ ID NO: 98793 - DNA, 1343 bp, Homo sapiens
  misc_feature (5)..(5): n is a, c, g, or t
  misc_feature (21)..(21): n is a, c, g, or t
  misc_feature (31)..(31): n is a, c, g, or t
  misc_feature (59)..(59): n is a, c, g, or t
ttganttacgaatttaaatangactcactanggggaaatttggcccctcgaggcccaanaaattcgggcacgaagaactgcctgactgcttgttcgtctcactggtgtgagctccagcatcccctttgctcgaaatggaccccaactgctcttgcgccactggtaagggaagctctgcgccctggaatccccatttcccagccctattacagagggtctctgggtttcaggaagtcgcattttaagttctgagcgacggggactccagtacttcgttagatgctttcttcctgatcacgcccctgagagcattgccctcatccctgggcctctacgtcagagttaagaatactgaggctcaaggctgaactgctccacatcacccagttggtcatgggcctgctggctgggccccagtgctctgtccaggctctgagcaatcagtgtggttgggggtgctggaaacattgactcttcagagttcaggacagaaggttctggctcgcagtctcaatattcctgggttgtatgtgcacgtggggaccttcctggtgcgttctgttcctctgtcctgagtgggaaaggagctctgagggctggccctgcacagaggagggggcactggagactcactgacccactgctgtaccttctgcatctcactcactgcccactgcgttttcctcttccttgtaggtggctcctgcacgtgcgccggctcctgcaagtgcaaagagtgcaaatgcacctcctgcaagaagagtgagtgcggggccatctccaggaatctggggctgtggctcaggttgggagggaactcaaggctggccctgagtgcatccttctggggaactgggctttctttgccctcattgcccgtgtcattccctctccaggctttctgccctaaattcagatggggcaggacagcatttttctcgtgggacacaaaccccaactgtaccccctatggtttcagaacagagctgtgccagacgaaaaaaagcatcctctgggtctgggttctgagctcgagccaggcttgctattagggcagggaggtgcccggtcaagtctactgccacctctcactctccccttcttccccaggctgctgttcctgctgccccgtgggctgtgccaagtgtgcccagggctgcgtctgcaaaggggcatcggagaagtgcagctgctgtgcctgatgtgggaacagctcttctcccagatgtaaatagaacaacctgcacaacctggatttttttaaaaatacaacactgagccatttgctgcatttctttttatactaaatatgtgactgacaataaaaacaattttgactttaa

SEQ ID NO: 98794 - DNA, 411 bp, Homo sapiens
gatccgccctcctcaaccccgggagtagctgggattacaagcatgcaccaccacgcctggctaatttttgtacttttagtagaaacagggttttgccatgttgcccaggctggcctcaaactcctgggctcaagggatcctcctacctcagcctcccaagtgctaggattataggtgtaagccaccgtgcccagccaaaagttctttttaaaattatttattttcatatgtaatacacaaatacattctcttttttctaattttttctggctttcaagtaacatctttagaagcttttcttgctcttaatggcacaaaagtaaggacaagagaatgaatttaaactagcaggaggtttatttacacttgggaatttcttttgaggagtcaagatgccacacagaaaacaaa

SEQ ID NO: 98795 - DNA, 397 bp, Homo sapiens
gcaaaaaaaaaaattattatctccactttaccagtgctgacacttcaccaatgtagggctctcagtgactagcccagggtcatgcacagcctgtttcagcagctaccttggacttgaacccagctcggtctgtctgactcaatgcctatagtcttaacctttccagcagctgcttctttgtcaaacaggtcctcccgcagggtttcacagcccagccccttactcaacaagtatttattgacaggcctcaggaacactaggcaagtaggatagcaatgaacaagatgctgaccttgaccttgaccctgcatccatagtatgagcattttaactgggggaggtttgcaaagttctcttaaacagtctactacatgctctgtaagcattttcttatgga

SEQ ID NO: 98796 - DNA, 449 bp, Homo sapiens
cccggccagaggaaagccctacctatagcacaccccaaatcccaccaggcggcctcagggctgggcaccacagccaagcccgcagccacgggcggcactcccgcgctcacagagggcctctgccctcctaccggggacctgcttgctcctgggggtgacagtgggagggacaccccaacagagcaatagccaaggtcccggccaggcccaccagcccctcaaggcccatcccaccatcctgaggttctggacagcctctgcaaggagacctccctcttcctcccagattcctccctaggcctgccagaggtctcacaccaccatggggcattaaaaggataaaatctcaggacagagatacagggtgctggcacatgatcccaggcagcccctgcctcgggagaatcccgggttcagagcaaggatgagtcaccatggcctgtccctcc

SEQ ID NO: 98797 - DNA, 310 bp, Homo sapiens
  misc_feature (25)..(25): n is a, c, g, or t
gctgccgcctactactactaaattngcggccgctcgactaagagcccttaccagagcataggatatgacctcttgcagcaacagctccatatggattaataaatcaattgaattaactcatttaattaccctgtgccggcaactgcttgtggttctggagctttggagatgagttaacaatagacagagagacattttccagtttactgctatgcaagctactccaagagttgtgatactggctcttgcaagagtggtaaacagcagagaattttacaggtgtcgacgggcagggagagatggagaaatg

SEQ ID NO: 98798 - DNA, 267 bp, Homo sapiens
gcattagttcatttcatcctcataattatcatacatgttaactactagtatgtctgttatactaaggtagttggtctaaaatcacatctggagtgtgaagtggtagagcagaccttggatgccaggggtgaacagttctagtatatagcttcttatttatgcctagtgttccattattggaacactaagcttgtggtagttatttatatctcactgatcaaggttattgccaaggtctgatttttcacaaaaaaaaaatttgcaacc

SEQ ID NO: 98799 - DNA, 850 bp, Homo sapiens
ggcgggtgggaagtacctgccgccatcttgctcaccagcctccaaaatgcggctggggctcctgagcgtggcgctgttgtttgtggggagctctcacttatactcagaccactactcgccctctggaaggcacaggctcggcccctcgccggaaccggcggctagttcccagcaggctgaggccgtccgcaagaggctccggcggcggagggagggaggggcgcatgcaaaggattgtggaacagcaccgcttaaggatgtgttgcaagggtctcggattatagggggcaccgaagcacaagctggcgcatggccgtgggtggtgagcctgcagattaaatatggccgtgttcttgttcatgtatgtgggggaaccctagtgagagagaggtgggtcctcacagctgcccactgcactaaagacgctagcgatcctttaatgtggacagctgtgattggaactaataatatacatggacgctatcctcataccaagaagataaaaattaaagcaatcattattcatccaaacttcattttggaatcttatgtaaatgatattgcactttttcacttaaaaaaagcagtgaggtataatgactatattcagcctatttgcctaccttttgatgttttccaaatcctggacggaaacacaaagtgttttataagtggctggggaagaacaaaagaagaaggtaacgctacaaatattttacaagatgcagaagtgcattatatttctcgagagatgtgtaattctgagaggagttatgggggaataattcctaacacttcattttgtgcaggtgatgaagatggagcttttgatacttgcagggtaagacca

SEQ ID NO: 98800 - DNA, 649 bp, Homo sapiens
taatttattgggtgcccactgtgtgctaaatatcttctaggtgagcaagactaagtcctttcttcatagaaaccgactaatgttaatgttaattaggtcaataaatgctagaaagagagggggtgctattttagattgggtaagcagggaaagcctctctgaggaaatgacattaggagtttgccttgaaaaaaactaaagaaccatacacatatgccccttttgccatttacactggggagccaaactttttaccagcatttatttcatggtgttattatccagtttttcatgtacagtagatgttggctctttattacttgatttttatcaacttttcttcttcagacagttataaccactagccctgtttggcacagcagcctcctacttccttgtacctccattctcatttttgccagttgtccttctctgtactatctcttcctctttactctcctatggtgggcatgtttttagtttttctgacttcatttgtgtctgatcattctcccattcaaaggtaattatctcttatgagaaaatgtctatatatgtacacgcatgcatacacatatatatgtatcactgtcattacacacatcatcagcatcaggaatgtttttatagatttgaaatcagagtctat

SEQ ID NO: 98801 - DNA, 403 bp, Homo sapiens
ctccctatcttccatgctccttcctcagatacccacgtggctcactcccttatctcctcaaatatgaccttctgaactccagagcagccaataaaaataataaaacagacatattggtaacaaacctcaggtgaaggtaaaagagaattataagaaatactcaattcgaaataaggcttaaaaagaggaaaatggtagaaagaaaacacgggatacatagaaaccaaatagtaacgtttaagacaaaccatatcaatgattacatgaaatgcaagtggtcagagcatcaaattagaaatcaaagattaacaaattggattaaaatggaaggtccaactgttttaagaaaagcaaaaattagccgggcgtggtggcgggtgcctgtagtcccagctattcagga

SEQ ID NO: 98802 - DNA, 284 bp, Homo sapiens
cagatgtgatttgccattaaatttcagcgtttttaagtaaaccgatatcattacaatcctcatggaaaagctatacatcaaagaaaacatctgtgtgtcaaagagagaagagagaagagagaaaaagtggcatcagtgaatgagttgatcaggtttgctcatcttactaccgctttgaactaagtctgttcatgtaattctacaacatttcagaaggaaagctgctgttttcttctgctgacaaaggcagtaggggcttgagcaatgaaaaaaaaaacaagata

SEQ ID NO: 98803 - DNA, 503 bp, Homo sapiens
ggtaatttttgttcccctttccatgttgacctttttaaaaagaagtcactgtgcccagcacatatttaagaattggaaaaacatgctccacctcctgctaggcagagcttctacaatgccatttgtgtttctttaccatggacaatttctctattctgctccatgcattatttatattcatcatttaatatatcatataaaatatatgaaatcacaaatatttacttcacactataattactagtttattgattttgttcctcaaattgttttagagtttgccatgtaaggtctttcagatgattcctataccattttgatatatctacgttgttgcagtttgattttgttttttgtttgtttgtttgtttgtttgactgctttgttggttgtgttattgtttagcattttattactttctggcactataaagtgttcaagcttaattgttttgattccctacccaagcctaatgttcgtaatttcttcaaggagtttttatt

SEQ ID NO: 98804 - DNA, 686 bp, Homo sapiens
acagaaagtgtcatctggagcggagaacgaggggctgctttattctaatgggctttttctttagattgtctcagtcctctgttggatcgcgttcacccctggcgccagggccctctggccccactcaaacgttgtgtgtgtgtgtgtgtgtgtgttgatgttgttgcggggggagtgttgagatcgcctctcccctcaacctgtggcatagtcagcagacatcaacatgcccagctgtctttttcttttggcttcaaaataaacctcaagggtggacagtgaagaagcatcagagcgcaggactagtgcaggtcggggatggggtctgctggggactgcccccggataaaatgtggaacaaattatcccaacacagccgggatcgctttgacttcggggtcttggggcccaaggccctaagcgttggaaaggacactttgcctatgcagcagctttcccggcagaaagtgaattcaaatcgaagatgtttcaccacgcgggttttgcctaagtatgcattttttcacacctctctaaaaaacaaccacaaacaaacagaaaaaacaaaacaaaacaaagaaaacacaacgatcctttggactttcagaccaccaggatgtgagtcaaacgaaatctcgtgttaacaccccgcttcttccctgctggaggccaccgggagtccggga

SEQ ID NO: 98805 - DNA, 425 bp, Homo sapiens
gaacttaacactcaggtagtcctgtctccctgaaggccagagaggaaaaatgacctatccaggatgacaggtggtttatttgagacaacactatactcatataaaagcataaaaatttttctgaattactcatcaaagcagagataaaggactgaaagaatgtatcagaaacccaaaacagaacccaaagatgaagggtccacctcattattattctgccacatggaaaatattccatggctgaagtccttcactctgctcttttatgttcactttattggctttttccttcattctgatatttttcctggagaaataactgtcactagtgttcaagagctgactcttcatgaactaggtcaaattaaaacatggttctgctccttttccaagacattttgttcatcctaaaatgcttttctttc

SEQ ID NO: 98806 - DNA, 363 bp, Homo sapiens
cacatggatcattctcaagcatggaccatatgttaggccacaataaaagtctttaaaaaatttttggccaggtgcagtggctcacgcctgtaatcccagcactttgggaggccgaggcaggtggatcacgaagtcaggagattgagaccgttctggctaacatggtgaaaccccatctctactaaaaatacaaaaaaattagccaggtgtggtggtgggtgcctgtagtcccagctacttgggaagctgaggcaggagaatggtgtgaacccaggaggtggagcttgcagtgagctgagattgcgccactgcactccagcctgggcgacggagtgcgactccatctaaaaaaaaaaaaaaatt

SEQ ID NO: 98807 - DNA, 205 bp, Homo sapiens
agtggtatttctgggaaagctgcatttaccacctcctaaatgtcttcttctcccattgattctgatctcttgttttaccagtaagtcaactaggaggagaaacactggacatgatgaataaaataggtagtgctgagaagaagagaaacagaaggcatggacaatgtgcccaagaagagaaatatctgaggacatggccaatcca

SEQ ID NO: 98808 - DNA, 486 bp, Homo sapiens
acattcataggactggcaggcaaataattgatggtctcaaggatgaatcagagtttagtcattcaacaagcacttattatcacctgctatttgccagggaaaagtgatgcaggtccaaaatcctttatccaaaactctttattgagagggagtttctctctgtcgcccgggctggagtgcggtggagcaatctcggctcactgcaacctccacctcccaggttcaagcgattcttgtgcctcagcctcctgagcagctgggattacaggtacccgcctccacacctggctaatttttgtatttttagtagagatggagtttcattatgttggccaggctggtctcgaattcctgacctcaagtcctcccgcctcgcctcacacttgtaattccagcacttggggaggctgaggtgggaggatcacttgagcccagaagtttgagaccagcctgagcaaaatggcgagcacctatctctaaaaaaat

SEQ ID NO: 98809 - DNA, 554 bp, Homo sapiens
cttgtcccccaggctggagtgcagtggcgcgatctcggctcactgcaacctctgcctcctgggttcaagcgattctcctgcctcagcctccacagtagctgggattacaggcgtgagccacagagcctggccgtatttctaggttttatggctggcctcgcaggagaggggttctggtttctatgacctgcactggggaagaggcattctactttccgtggcctaccttgaggggtggtggggtgcgggcaagggaaggggccagagggtcagagagcccttgcctctgaggcccttccggtgtcctgcagttcctcagtgtgccaaaaccacaggccttggggtatcattttctgagccccagcatatccctctattttgcccttaggtctggaggaaggttccagggcatttgcccttggtgggtgcaggtagggaggatctgcgggtcttcctcatgccaggagtcttatcccagaatcaaaggctcctggtgggtaggagcgtgtcccatgtgcagcacgcttggctgtccgaagttgctgatgagaagc

SEQ ID NO: 98810 - DNA, 761 bp, Homo sapiens
acagctccaggcatttcctcaggaagctgccctccaccttcatccacctcagacgcgtcctgcagagccctctggagaaccagcttcaggttctgcctattttgacgctgcctaaaggagcccacgaagaagtaaatgatggggttggcactgctgttaagagcggacaggaaaatagaaactagatgaacatgacaaaataagacttccctgtccacgtggatccataaaaataggaaaaactgaatgccaaagggcaggccacagaggaggaagaccagtactgtgagcaggatggtcacgtacagcctggtcagcggtatcttccgggatccacagagaatcctgatcagcaggaccaggctggacccacagagaaccacacataaaaaaatcagccacgcgactgtgatgaaatctgatgtttgacaccaagcagaatcagcaccactgaacaggaagccacataacatccactccaggatgctccgcagcagggacagggcccagagcaggacacacaccaccgctgacaggtgtgtggggcggtggcagcggtaccagatgggccacaggacggacaggcagcgctcggtgctcacggcactcagaaagctcaggcctgcaaagtaggaaaacatcatcacaggatagaggattttagagatggtatgggggatactgatgaagcttaacagggaatatataaggcggccgctgaggaagaggaagtctgctgcggccaagttgaggatgtagat

SEQ ID NO: 98811 - DNA, 701 bp, Homo sapiens
acgtgaaagggaactgggcgtttgccgcagggaaaagtaaggtgtttctgctctcgcgccatatgcagttcccgcgggatctcgttgagggcggggcacccagttccttacgaaagggatggagggggtggtacttctaaagttggcggtgtttcgtaccggccgcgggatttcgcggactggggcgctgaggttctttgagcggcgtgtggacctgaattccctggaaacaggctggggccgcgaggggcctccgctccgggcggggtccccagatagccccgcctcgaataaaaatgacgagcacgggtcctctctcgggcccgcagtgggtggactgcgtcgcagacccgtagtggaggcgcccagctcgccggggagattcgagtggaaaccctcacggccgccggtggtgggccccggcgcggcgctgggctccggcgggtctgcgctggggagggccagggcccctgaagccggcgtccctcttaggggacgcgcctgggtgtgtcttcaccgtttgcctggtgagttggagacagggtctcgctccgtcgcccaggctggagtgcagtggtaggatcagggttcattgtagcctccgcctcagcctctggagtagctgggacctcaggcgcgcgccaccacgcccggctaattttttaaatttttttgtagagacggggttgggggaggcgggg

SEQ ID NO: 98812 - DNA, 254 bp, Homo sapiens
tcaagttaagaactccccgtaatctagtagggaacatttaatggacaactgaaaagcttaataaaggaaaatataaaaatcagtaagtagtagtttctccctcgtgctctgtttcttaagatataccttctatcgtttattaaaatcccctccaaagttttgttttaaaaatcccccatgttttttgttttgtttggtttttttgagacggagtcttgctctgttcccaggatggaatgcaatggcgtgatctc

SEQ ID NO: 98813 - DNA, 324 bp, Homo sapiens
ccaaaaggtctctccaatagttgagaacactgagctttaacaaagcctaggggtgtctatctccaacccccagaacctccaaggcctgtggtttcccatgcccctgctagacgcacccatggtgggtgggggtgcccatggtaactcacaccatcaggtaaatggcagagtaccagctccatgcattggctcattaagctttgcaagcatcaggtatctggggtactgttgagttcctgtgcccaggcatggaggaagagtgggagttaaagatcagtctctgaccttatggggaccttagcctctctgggaaagcaaagctaa

SEQ ID NO: 98814 - DNA, 428 bp, Homo sapiens
ggccagcatttgaaccagagtctactaacagagctgaaggtgtaagtaacatgagtctgccttccaagccaggccgttaactctgatggcaggaacagagatttttgttttcatttaggcaaccccaggatacttgaatagtgcctggtttataatctatgataaatgttgagtgtagtcagctgggtgtggtggctgatgcctgtaatcccaacactttggaaggctgaggcgggcggatcacgtgaggtcaggagttcgagaccagcctggccaacatggtgaaactccgtctctactaaaaatacaaaaattagcctggtaatcccagctacttgggaggctgaggcaggagaactgattgaacctgggaggcggaggtcgcagcgagccaagatcgtgctgctgcattccagcctgagcgatgg

SEQ ID NO: 98815 - DNA, 206 bp, Homo sapiens
agcggactggagtttggttctcgaggcggcggcagcgagcggcggcggctccggcggctcctcctcctcctttggtggcggcggcggcccgggaccgagacccggccccggctcccctctccgccaccccgggcgcgccgcagaacgccccggcgccgcggggaacatgcggctccggctcccggaggccggcgagtgagtgaccc

SEQ ID NO: 98816 - DNA, 394 bp, Homo sapiens
ttatcagtggaaagagaatcttggtaaaaaagggcagctgactaagtggcctcaaccctattgggcacttctttggggttctcccacgttgattattctgcttctacccttgtacatgtctggacaacaggtttgttttttacaaacaaaaatcccttctctttcttcctctcttgatagctgaggcaagtgagcatttaaaaaagatattccaacaactttaaaggaggacacgagaagatagggaaatataaatagtatcagtaaaatggctggcctggggatccatccttgcttgcttgcttgcttcagactggggctttgtttctttccaaacctgtcaggattcccagctcttcgccggcctccacgtggggtgccctcttttatgttc

SEQ ID NO: 98817 - DNA, 3624 bp, Homo sapiens
  misc_feature (1)..(1): n is a, c, g, or t
  misc_feature (332)..(332): n is a, c, g, or t
ncagtactgtacaaggaaaacccgtcggatctgttattgcgggatacttgtgaaatatacataggattctttcttatggctgcatcccggatctggaaattttacttggggaccaggaggatttgaaaggctgcatgtactcagaagatttgcaagcaacactccaattcttgtcatagagctcgcagacttctcacttatcggcttttttccttccttattttttaagaattattcttattttcccctctctttttctgctctctcctctctcagtctctccttttctatctgcctcttcatttttctcctagtctgttttttttttcccngctctgcacctggattgtatcttcagcaaacaatcgggcactttgagaactaactggagacagtcttgtagggaagatctgtatggaattatctgcttttatggtgaacttggcatttgtgaatgggaatcttgttcacaatattaattgctagcaaaaacaagaaaaagaacacaggagtaaaacgtggatttttctgaatacgcattgtgatgaccagcaattaccttaccgactaatatccagaggagaataatttggaagactgttgtggggaacagcctttaagagctggaagatgaaagctccgattccacacttgattctcttatacgctacttttactcagagtttgaaggttgtgaccaaaagaggctccgccgatggatgcactgactggtctatcgatatcaagaaatatcaagttttggtgggagagcctgttcgaatcaaatgtgcactcttttatggttatatcagaacaaattactcccttgcccaaagtgctggactcagtttgatgtggtacaaaagttctggtcctggagactttgaagagccaatagcctttgacggaagtagaatgagcaaagaagaagactccatttggttccggccaacattgctacaggacagtggtctctacgcctgtgtcatcagaaactccacttactgtatgaaagtatccatctcactgacagtgggtgaaaatgacactggactctgctataattccaagatgaagtattttgaaaaagctgaacttagcaaaagcaaggaaatttcatgccgtgacatagaggattttctactgccaaccagagaacctgaaatcctttggtacaaggaatgcaggacaaaaacatggaggccaagtattgtattcaaaagagatactctgcttataagagaagtcagagaagatgacattggaaattatacctgtgaattaaaatatggaggctttgttgtgagaagaactactgaattaactgttacagcccctctgactgataagccacccaagcttttgtatcctatggaaagtaaactgacaattcaggagacccagctgggtgactctgctaatctaacctgcagagctttctttgggtacagcggagatgtcagtcctttaatttactggatgaaaggagaaaaatttattgaagatctggatgaaaatcgagtttgggaaagtgacattagaattcttaaggagcatcttggggaacaggaagtttccatctcattaattgtggactctgtggaagaaggtgacttgggaaattactcctgttatgttgaaaatggaaatggacgtcgacacgccagcgttctccttcataaacgagagctaatgtacacagtggaacttgctggaggccttggtgctatactcttgctgcttgtatgtttggtgaccatctacaagtgttacaagatagaaatcatgctcttctacaggaatcattttggagctgaagagctcgatggagacaataaagattatgatgcatacttatcatacaccaaagtggatcctgaccagtggaatcaagagactggggaagaagaacgttttgcccttgaaatcctacctgatatgcttgaaaagcattatggatataagttgtttataccagatagagatttaatcccaactggaacatacattgaagatgtggcaagatgtgtagatcaaagcaagcggctgattattgtcatgaccccaaattacgtagttagaaggggctggagcatctttgagctggaaaccagacttcgaaatatgcttgtgactggagaaattaaagtgattctaattgaatgcagtgaactgagaggaattatgaactaccaggaggtggaggccctgaagcacaccatcaagctcctgacggtcattaaatggcatggaccaaaatgcaacaagttgaactccaagttctggaaacgtttacagtatgaaatgccttttaagaggatagaacccattacacatgagcaggctttagatgtcagtgagcaagggccttttggggagctgcagactgtctcggccatttccatggccgcggccacctccacagctctagccactgcccatccagatctccgttctacctttcacaacacgtaccattcacaaatgcgtcagaaacactactaccgaagctatgagtacgacgtacctcctaccggcaccctgcctcttacctccataggcaatcagcatacctactgtaacatccctatgacactcatcaacgggcagcggccacagacaaaatcgagcagggagcagaatccagatgaggcccacacaaacagtgccatcctgccgctgttgccaagggagaccagtatatccagtgtgatatggtgacagaaaagcaagggacatcccgtccctgggaggttgagtggaatctgcagtccagtgcctggaactaaatcctcgactgctgctgttaaaaaacatgcattagaatctctagaacacgaggaaaaacagggtcttgtacatatgttttttggaatttctttgtagcatcagtgtcctcctgttttaccatgtcttttaccattacattttttgactttgttttatatgtcgttggaatttgtaaatttacattttttttaaagaagagactgatgtgtagatagaaaaccctttttttgcttcattagtttagttttagaatgggtttttattttatttccttttttaaaattttactttgcttttaacatttccttggggtgcttggacaaatctatccgatgggacaaggagcaccggattctttctcgggttctgcctagcatcaactgggccacgtcggccttcagagaacagtgcaacaaatgccagcattgccattcgggggaaaaaaaaaaaaaaaaaaaaaagatgagaagaacacttgttcataggagggccccaccagtcagagccctgaatctcttccttgtcccacctcattccccacctctacctttctaatggcggcatgatgtgtaaactctgtgcaggggtgggggcgggtctaactgtcttaacattcaagtcactgctcttcagaatacactctagacccaaaggtgtgctaatcacttcacagtgaccactacagagtactaagaagagaagatcaagggcatgaaattggggaagagtgttatttccgttttttaaatgagttgatgtacccttatatatatatacatatatatataaatataaatatatataaaaacaacaaaacaaaacaaaaaaagaaaa
